United States Patent 7,745,391 (HUMAN THROMBOSPONDIN POLYPEPTIDE) - sequence listing, part 157

SEQ ID NO: 408359 - DNA, 1568 bp, Homo sapiens
agcggcgctttttacgacgcggcaggcgcggcgcgcttagttgccggagctgaacggcgcggagctggtctgaggcgagccgagccgagcgagcgcggcggtggggccgagaggacgcgcaggtggcggcgttgccatgtcgcacggtcacagccacggcgggggtggctgccgctgcgccgccgaacgggaggagccgcccgagcagcgcggcctggcctacggcctgtacctgcgcatcgacctggagcggctgcaatgccttaacgagagccgcgagggcagcggccgcggcgtcttcaagccgtgggaggagcggaccgaccgctccaagtttgttgaaagtgatgcagatgaagagcttctgtttaatattccatttacgggcaatgtcaagctcaaaggcatcattataatgggagaggatgatgaagaaagggagccagatcagacctttagtctgaaccgggatcttacaggagaattagagtatgctacaaaaatttctcgtttttcaaatgtctatcatctctcaattcatatttcaaaaaacttcggagcagatacgacaaaggtcttttatattggcctgagaggagagtggactgagcttcgccgacacgaggtgaccatctgcaattacgaagcatctgccaacccagcagaccatagggtccatcaggttaccccacagacacactttatttcctaagggctggccaaggctcccatagaggcgctgtgtcagtgaagatgtacgactacctgttgggaaggacaaagggatgaggctccagagagagttggctgccacagcctctgccaagctttgtctttggggcttgctgcagaaacctggcctacggaagatacgacaccactgggagggttgtgtaggtgccaggggaccatcgtggttctctagggcgctgtggaaattgggtcttgggctgggtggcatctggcagtcatggataacacttgcttttccagttaatgtggccatgtgattccaagtgtcatgttgctttgtggcaagattgttgtgtgacttgtttttttgtttttgtttttgtttttttaaaggaaactatttgtgggctataggaaactttctgatgcctccggattgtgttagtagtagccatcaggagggtctccaactaaaacacttgttcctgcttgctcctttcccctctcattgttcagcattcttgtcaagttgcccagcttggagttgtctgtcacgcacatgtgtcctgtggttatagctagaaggacaggagtctcctgctgatgcgtgatagcttaagcttggggagaaggtcttttccactgcctagctaagcagtctggggagagcatggggatcatttctatgtgtgtgggtaatctggtcagtaagattgagacttagttaagattccccttggaaattccttaatgtttattagcttctaactagtgttgtaagtccgatgccagaatttggagatttgagttcttcttttcatggcttttattcactgtgactaataagcttcctaataaatccttgccagacttaa

SEQ ID NO: 408360 - DNA, 1292 bp, Homo sapiens
tggattaaagatatttgtaggctagacgcggtggctcatgcctgtaattccagcactttcggagaccgacgtaggcggatcacctgaggttgggagttagagaccagcattgccaacatggtacaagaatattccacagatgtcctttgatgatacagaaagggagccagatcagacctttagtctgaaccgggatcttacaggagaattagagtatgctacaaaaatttctcgtttttcaaatgtctatcatctctcaattcatatttcaaaaaacttcggagcagatacgacaaaggtcttttatattggcctgagaggagagtggactgagcttcgccgacacgaggtgaccatctgcaattacgaagcatctgccaacccagcagaccatagggtccatcaggttaccccacagacacactttatttcctaagggctggccaaggctcccatagaggcgctgtgtcagtgaagatgtacgactacctgttgggaaggacaaagggatgaggctccagagagagttggctgccacagcctctgccaagctttgtctttggggcttgctgcagaaacctggcctacggaagatacgacaccactgggagggttgtgtaggtgccaggggaccatcgtggttctctagggcgctgtggaaattgggtcttgggctgggtggcatctggcagtcatggataacacttgcttttccagttaatgtggccatgtgattccaagtgtcatgttgctttgtggcaagattgttgtgtgacttgtttttttgtttttgtttttgtttttttaaaggaaactatttgtgggctataggaaactttctgatgcctccggattgtgttagtagtagccatcaggagggtctccaactaaaacacttgttcctgcttgctcctttcccctctcattgttcagcattcttgtcaagttgcccagcttggagttgtctgtcacgcacatgtgtcctgtggttatagctagaaggacaggagtctcctgctgatgcgtgatagcttaagcttggggagaaggtcttttccactgcctagctaagcagtctggggagagcatggggatcatttctatgtgtgtgggtaatctggtcagtaagattgagacttagttaagattccccttggaaattccttaatgtttattagcttctaactagtgttgtaagtccgatgccagaatttggagatttgagttcttcttttcatggcttttattcactgtgactaataagcttcctaataaatccttgccagacttaa

SEQ ID NO: 408361 - DNA, 1316 bp, Homo sapiens
tctaattctgatacagagtgtcttactctgtggcgcagactagattgcggtgagtacaatattgactgactgcgacgagcacctactaggtataagcgagtgtgttgactaagcctcccaagtagctgggactacaggcgcctgccaccacgcccggctaattttttgtatttttagtagagacggggtttcaccgtgttagccaggatggtctccatctcctgacctcatgatctgcccgcctcggcctcccaaagtgctgggattacagtatcatctctcaattcatatttcaaaaaacttcggagcagatacgacaaaggtcttttatattggcctgagaggagagtggactgagcttcgccgacacgaggtgaccatctgcaattacgaagcatctgccaacccagcagaccatagggtccatcaggttaccccacagacacactttatttcctaagggctggccaaggctcccatagaggcgctgtgtcagtgaagatgtacgactacctgttgggaaggacaaagggatgaggctccagagagagttggctgccacagcctctgccaagctttgtctttggggcttgctgcagaaacctggcctacggaagatacgacaccactgggagggttgtgtaggtgccaggggaccatcgtggttctctagggcgctgtggaaattgggtcttgggctgggtggcatctggcagtcatggataacacttgcttttccagttaatgtggccatgtgattccaagtgtcatgttgctttgtggcaagattgttgtgtgacttgtttttttgtttttgtttttgtttttttaaaggaaactatttgtgggctataggaaactttctgatgcctccggattgtgttagtagtagccatcaggagggtctccaactaaaacacttgttcctgcttgctcctttcccctctcattgttcagcattcttgtcaagttgcccagcttggagttgtctgtcacgcacatgtgtcctgtggttatagctagaaggacaggagtctcctgctgatgcgtgatagcttaagcttggggagaaggtcttttccactgcctagctaagcagtctggggagagcatggggatcatttctatgtgtgtgggtaatctggtcagtaagattgagacttagttaagattccccttggaaattccttaatgtttattagcttctaactagtgttgtaagtccgatgccagaatttggagatttgagttcttcttttcatggcttttattcactgtgactaataagcttcctaataaatccttgccagacttaa

SEQ ID NO: 408362 - DNA, 1490 bp, Homo sapiens
agcggcgctttttacgacgcggcaggcgcggcgcgcttagttgccggagctgaacggcgcggagctggtctgaggcgagccgagccgagcgagcgcggcggtggggccgagaggacgcgcaggtggcggcgttgccatgtcgcacggtcacagccacggcgggggtggctgccgctgcgccgccgaacgggaggagccgcccgagcagcgcggcctggcctacggcctgtacctgcgcatcgacctggagcggctgcaatgccttaacgagagccgcgagggcagcggccgcggcgtcttcaagccgtgggaggagcggaccgaccgctccaagtttgttgaaagtgatgcagatgaagagcttctgtttaatattccatttacgggcaatgtcaagctcaaaggcatcattataatgggagaggatgatgactcacacccctctgagatgagactgtacaagaatattccacagatgtcctttgatgatacagaaagggagccagatcagacctttagtctgaaccgggatcttacaggagaattagagtatgctacaaaaatttctcgtttttcaaatgtctatcatctctcaattcatatttcaaaaaacttcggagcagttatttcctaagggctggccaaggctcccatagaggcgctgtgtcagtgaagatgtacgactacctgttgggaaggacaaagggatgaggctccagagagagttggctgccacagcctctgccaagctttgtctttggggcttgctgcagaaacctggcctacggaagatacgacaccactgggagggttgtgtaggtgccaggggaccatcgtggttctctagggcgctgtggaaattgggtcttgggctgggtggcatctggcagtcatggataacacttgcttttccagttaatgtggccatgtgattccaagtgtcatgttgctttgtggcaagattgttgtgtgacttgtttttttgtttttgtttttgtttttttaaaggaaactatttgtgggctataggaaactttctgatgcctccggattgtgttagtagtagccatcaggagggtctccaactaaaacacttgttcctgcttgctcctttcccctctcattgttcagcattcttgtcaagttgcccagcttggagttgtctgtcacgcacatgtgtcctgtggttatagctagaaggacaggagtctcctgctgatgcgtgatagcttaagcttggggagaaggtcttttccactgcctagctaagcagtctggggagagcatggggatcatttctatgtgtgtgggtaatctggtcagtaagattgagacttagttaagattccccttggaaattccttaatgtttattagcttctaactagtgttgtaagtccgatgccagaatttggagatttgagttcttcttttcatggcttttattcactgtgactaataagcttcctaataaatccttgccagacttaa

SEQ ID NO: 408363 - DNA, 1055 bp, Homo sapiens
tagaaatgaacctgaataaggactaccgcaatgtgtgtggtgtgggaaaggacagttcttttaatggctggctgacccagcctcaattttcttgcagcttcgccgacacgaggtgaccatctgcaattacgaagcatctgccaacccagcagaccatagggtccatcaggttaccccacagacacactttatttcctaagggctggccaaggctcccatagaggcgctgtgtcagtgaagatgtacgactacctgttgggaaggacaaagggatgaggctccagagagagttggctgccacagcctctgccaagctttgtctttggggcttgctgcagaaacctggcctacggaagatacgacaccactgggagggttgtgtaggtgccaggggaccatcgtggttctctagggcgctgtggaaattgggtcttgggctgggtggcatctggcagtcatggataacacttgcttttccagttaatgtggccatgtgattccaagtgtcatgttgctttgtggcaagattgttgtgtgacttgtttttttgtttttgtttttgtttttttaaaggaaactatttgtgggctataggaaactttctgatgcctccggattgtgttagtagtagccatcaggagggtctccaactaaaacacttgttcctgcttgctcctttcccctctcattgttcagcattcttgtcaagttgcccagcttggagttgtctgtcacgcacatgtgtcctgtggttatagctagaaggacaggagtctcctgctgatgcgtgatagcttaagcttggggagaaggtcttttccactgcctagctaagcagtctggggagagcatggggatcatttctatgtgtgtgggtaatctggtcagtaagattgagacttagttaagattccccttggaaattccttaatgtttattagcttctaactagtgttgtaagtccgatgccagaatttggagatttgagttcttcttttcatggcttttattcactgtgactaataagcttcctaataaatccttgccagacttaa

SEQ ID NO: 408364 - DNA, 462 bp, Homo sapiens
ttttattcactgtgactaataagcttcctaataaatccttgccagacttaatgtttgtattttcttttgagttcttgatagccactgatgcaactttcatttcatggggaactgtactgaactttgaaattttttgttgttgttttggactaggtagattataggaagtgccacaattaaatcaagactggagccgggcgcggtggctcacgcctgtaatcccagcactttgggaggccgaggtgggcggatcacgaggtcaggagatcgagaccacggtgaaaccgtctctaccaaaaatacaaaaaattagccgggtgcggtggcgggagcctgtagtcccagctactcaggaggctgaggcaggagaatggcatgaacccgggaagcggagcttgcagtgacctgagattgcaccactgcactccagcctgggtgacagagtgagactccgtctcaaaa

SEQ ID NO: 408365 - DNA, 1628 bp, Homo sapiens
agcggcgctttttacgacgcggcaggcgcggcgcgcttagttgccggagctgaacggcgcggagctggtctgaggcgagccgagccgagcgagcgcggcggtggggccgagaggacgcgcaggtggcggcgttgccatgtcgcacggtcacagccacggcgggggtggctgccgctgcgccgccgaacgggaggagccgcccgagcagcgcggcctggcctacggcctgtacctgcgcatcgacctggagcggctgcaatgccttaacgagagccgcgagggcagcggccgcggcgtcttcaagccgtgggaggagcggaccgaccgctccaagtttgttgaaagtgatgcagatgaagagcttctgtttaatattccatttacgggcaatgtcaagctcaaaggcatcattataatgggagaggatgatgactcacacccctctgagatgagactgtacaagaatattccacagatgtcctttgatgatacagaaagggagccagatcagacctttagtctgaaccgggatcttacaggagaattagagtatgctacaaaaatttctcgtttttcaaatgtctatcatctctcaattcatatttcaaaaaacttcggagcagatacgacaaaggtcttttatattggcctgagaggagagtggactgagcttcgccgacacgaggtgaccatctgcaattacgaagcatctgccaacccagcagaccatagggtccatcaggttaccccacagacacactttatttcctaagggctggccaaggctcccatagaggcgctgtgtcagtgaagatgtacgactacctgttgggaaggacaaagggatgaggctccagagagagttggctgccacagcctctgccaagctttgtctttggggcttgctgcagaaacctggcctacggaagatacgacaccactgggagggttgtgtaggtgccaggggaccatcgtggttctctagggcgctgtggaaattgggtcttgggctgggtggcatctggcagtcatggataacacttgcttttccagttaatgtggccatgtgattccaagtgtcatgttgctttgtggcaagattgttgtgtgacttgtttttttgtttttgtttttgtttttttaaaggaaactatttgtgggctataggaaactttctgatgcctccggattgtgttagtagtagccatcaggagggtctccaactaaaacacttgttcctgcttgctcctttcccctctcattgttcagcattcttgtcaagttgcccagcttggagttgtctgtcacgcacatgtgtcctgtggttatagctagaaggacaggagtctcctgctgatgcgtgatagcttaagcttggggagaaggtcttttccactgcctagctaagcagtctggggagagcatggggatcatttctatgtgtgtgggtaatctggtcagtaagattgagacttagttaagattccccttggaaattccttaatgtttattagcttctaactagtgttgtaagtccgatgccagaatttggagatttgagttcttcttttcatggcttttattcactgtgactaataagcttcctaataaatccttgccagacttaa

SEQ ID NO: 408366 - DNA, 2018 bp, Homo sapiens
agcggcgctttttacgacgcggcaggcgcggcgcgcttagttgccggagctgaacggcgcggagctggtctgaggcgagccgagccgagcgagcgcggcggtggggccgagaggacgcgcaggtggcggcgttgccatgtcgcacggtcacagccacggcgggggtggctgccgctgcgccgccgaacgggaggagccgcccgagcagcgcggcctggcctacggcctgtacctgcgcatcgacctggagcggctgcaatgccttaacgagagccgcgagggcagcggccgcggcgtcttcaagccgtgggaggagcggaccgaccgctccaagtttgttgaaagtgatgcagatgaagagcttctgtttaatattccatttacgggcaatgtcaagctcaaaggcatcattataatgggagaggatgatgactcacacccctctgagatgagactgtacaagaatattccacagatgtcctttgatgatacagaaagggagccagatcagacctttagtctgaaccgggatcttacaggagaattagagtatgctacaaaaatttctcgtttttcaaatgtctatcatctctcaattcatatttcaaaaaacttcggagcagatacgacaaaggtcttttatattggcctgagaggagagtggactgagcttcgccgacacgaggtgaccatctgcaattacgaagcatctgccaacccagcagaccatagggtccatcaggttaccccacagacacactttatttcctaagggctggccaaggctcccatagaggcgctgtgtcagtgaagatgtacgactacctgttgggaaggacaaagggatgaggctccagagagagttggctgccacagcctctgccaagctttgtctttggggcttgctgcagaaacctggcctacggaagatacgacaccactgggagggttgtgtaggtgccaggggaccatcgtggttctctagggcgctgtggaaattgggtcttgggctgggtggcatctggcagtcatggataacacttgcttttccagttaatgtggccatgtgattccaagtgtcatgttgctttgtggcaagattgttgtgtgacttgtttttttgtttttgtttttgtttttttaaaggaaactatttgtgggctataggaaactttctgatgcctccggattgtgttagtagtagccatcaggagggtctccaactaaaacacttgttcctgcttgctcctttcccctctcattgttcagcattcttgtcaagttgcccagcttggagttgtctgtcacgcacatgtgtcctgtggttatagctagaaggacaggagtctcctgctgatgcgtgatagcttaagcttggggagaaggtcttttccactgcctagctaagcagtctggggagagcatggggatcatttctatgtgtgtgggtaatctggtcagtaagattgagacttagttaagattccccttggaaattccttaatgtttattagcttctaactagtgttgtaagtccgatgccagaatttggagatttgagttcttcttttcatggcttttattcactgtgactaataagcttcctaataaatccttgccagacttaaaaaaaaaaaaaaaaacaaaaaaaaacaaaaattgtgtggggcgccgcccgtggcgccctgagaaaagagtttgttagaaaaccctttggttgtgggcggcgcggggggcccacagatgggttaagggagaaaccggtgggcaaaagcgtggtcccactagagggaaaaccccgggggaacagaagacaaaaggggctgtggagatttctctacccaaagatataaaaaaacgcccgggggggagacacaccggaagctgttcgtggaaacaaaactctccaaaaaggcggaagtactggggagaggacaaaaaggggggactaataacagagcgagggggccccaacgagaaagccggaatacaaaatataaggccagaacagtgggtgt

SEQ ID NO: 408367 - DNA, 2010 bp, Homo sapiens
agcggcgctttttacgacgcggcaggcgcggcgcgcttagttgccggagctgaacggcgcggagctggtctgaggcgagccgagccgagcgagcgcggcggtggggccgagaggacgcgcaggtggcggcgttgccatgtcgcacggtcacagccacggcgggggtggctgccgctgcgccgccgaacgggaggagccgcccgagcagcgcggcctggcctacggcctgtacctgcgcatcgacctggagcggctgcaatgccttaacgagagccgcgagggcagcggccgcggcgtcttcaagccgtgggaggagcggaccgaccgctccaagtttgttgaaagtgatgcagatgaagagcttctgtttaatattccgtaagtatctccttggtgcctacctcaggctaaataggctgtacccagttgcctcagatggattcattcactggtgtcaagagcacacatttgcttctagaaatgggataaattactttggtgggtttgaggaggaaagcatcatagctttcttggtgcagactggaaacagatgtatttgtagaacaataactgagaaattgaggtagatttcttagaattgtagaatgctagaggtagacaggatcttagaaattatctagtacaagttgacagatgagtaaactgaagcccatacaggggaagggtcttgcccagggtcacacaactaaacaggtattcaaactcaggtttgacaaccttctcttttgcattctggcagatttacgggcaatgtcaagctcaaaggcatcattataatgggagaggatgatgactcacacccctctgagatgagactgtacaagaatattccacagatgtcctttgatgatacagaaagggagccagatcagacctttagtctgaaccgggatcttacaggagaattagagtatgctacaaaaatttctcgtttttcaaatgtctatcatctctcaattcatatttcaaaaaacttcggagcagatacgacaaaggtcttttatattggcctgagaggagagtggactgagcttcgccgacacgaggtgaccatctgcaattacgaagcatctgccaacccagcagaccatagggtccatcaggttaccccacagacacactttatttcctaagggctggccaaggctcccatagaggcgctgtgtcagtgaagatgtacgactacctgttgggaaggacaaagggatgaggctccagagagagttggctgccacagcctctgccaagctttgtctttggggcttgctgcagaaacctggcctacggaagatacgacaccactgggagggttgtgtaggtgccaggggaccatcgtggttctctagggcgctgtggaaattgggtcttgggctgggtggcatctggcagtcatggataacacttgcttttccagttaatgtggccatgtgattccaagtgtcatgttgctttgtggcaagattgttgtgtgacttgtttttttgtttttgtttttgtttttttaaaggaaactatttgtgggctataggaaactttctgatgcctccggattgtgttagtagtagccatcaggagggtctccaactaaaacacttgttcctgcttgctcctttcccctctcattgttcagcattcttgtcaagttgcccagcttggagttgtctgtcacgcacatgtgtcctgtggttatagctagaaggacaggagtctcctgctgatgcgtgatagcttaagcttggggagaaggtcttttccactgcctagctaagcagtctggggagagcatggggatcatttctatgtgtgtgggtaatctggtcagtaagattgagacttagttaagattccccttggaaattccttaatgtttattagcttctaactagtgttgtaagtccgatgccagaatttggagatttgagttcttcttttcatggcttttattcactgtgactaataagcttcctaataaatccttgccagacttaa

SEQ ID NO: 408368 - DNA, 1519 bp, Homo sapiens
agcggcgctttttacgacgcggcaggcgcggcgcgcttagttgccggagctgaacggcgcggagctggtctgaggcgagccgagccgagcgagcgcggcggtggggccgagaggacgcgcaggtggcggcgttgccatgtcgcacggtcacagccacggcgggggtggctgccgctgcgccgccgaacgggaggagccgcccgagcagcgcggcctggcctacggcctgtacctgcgcatcgacctggagcggctgcaatgccttaacgagagccgcgagggcagcggccgcggcgtcttcaagccgtgggaggagcggaccgaccgctccaagtttgttgaaagtgatgcagatgaagagcttctgtttaatattccatttacgggcaatgtcaagctcaaaggcatcattataatgggagaggatgatgactcacacccctctgagatgagactgtacaagaatattccacagatgtcctttgatgatacagaaagggagccagatcagacctttagtctgaaccgggatcttacaggagaattagagtatgctacaaacttcgccgacacgaggtgaccatctgcaattacgaagcatctgccaacccagcagaccatagggtccatcaggttaccccacagacacactttatttcctaagggctggccaaggctcccatagaggcgctgtgtcagtgaagatgtacgactacctgttgggaaggacaaagggatgaggctccagagagagttggctgccacagcctctgccaagctttgtctttggggcttgctgcagaaacctggcctacggaagatacgacaccactgggagggttgtgtaggtgccaggggaccatcgtggttctctagggcgctgtggaaattgggtcttgggctgggtggcatctggcagtcatggataacacttgcttttccagttaatgtggccatgtgattccaagtgtcatgttgctttgtggcaagattgttgtgtgacttgtttttttgtttttgtttttgtttttttaaaggaaactatttgtgggctataggaaactttctgatgcctccggattgtgttagtagtagccatcaggagggtctccaactaaaacacttgttcctgcttgctcctttcccctctcattgttcagcattcttgtcaagttgcccagcttggagttgtctgtcacgcacatgtgtcctgtggttatagctagaaggacaggagtctcctgctgatgcgtgatagcttaagcttggggagaaggtcttttccactgcctagctaagcagtctggggagagcatggggatcatttctatgtgtgtgggtaatctggtcagtaagattgagacttagttaagattccccttggaaattccttaatgtttattagcttctaactagtgttgtaagtccgatgccagaatttggagatttgagttcttcttttcatggcttttattcactgtgactaataagcttcctaataaatccttgccagacttaa

SEQ ID NO: 408369 - DNA, 1403 bp, Homo sapiens
agcggcgctttttacgacgcggcaggcgcggcgcgcttagttgccggagctgaacggcgcggagctggtctgaggcgagccgagccgagcgagcgcggcggtggggccgagaggacgcgcaggtggcggcgttgccatgtcgcacggtcacagccacggcgggggtggctgccgctgcgccgccgaacgggaggagccgcccgagcagcgcggcctggcctacggcctgtacctgcgcatcgacctggagcggctgcaatgccttaacgagagccgcgagggcagcggccgcggcgtcttcaagccgtgggaggagcggaccgaccgctccaagtttgttgaaagtgatgcagatgaagagcttctgtttaatattccatttacgggcaatgtcaagctcaaaggcatcattataatgggagaggatgatgactcacacccctctgagatgagactgtacaagaatattccacagatgtcctttgatgatacagaaagggagccagatcagacctttagtctgaaccgggatcttacaggagaattagagtatgctacaaaaatttctcgtttttcaaatgtctatcatctctcaattcatatttcaaaaaacttcggagcagttatttcctaagggctggccaaggctcccctctgccaagctttgtctttggggcttgctgcagaaacctggcctacggaagatacgacaccactgggagggttgtgtaggtgccaggggaccatcgtggttctctagggcgctgtggaaattgggtcttgggctgggtggcatctggcagtcatggataacacttgcttttccagttaatgtggccatgtgattccaagtgtcatgttgctttgtggcaagattgttgtgtgacttgtttttttgtttttgtttttgtttttttaaaggaaactatttgtgggctataggaaactttctgatgcctccggattgtgttagtagtagccatcaggagggtctccaactaaaacacttgttcctgcttgctcctttcccctctcattgttcagcattcttgtcaagttgcccagcttggagttgtctgtcacgcacatgtgtcctgtggttatagctagaaggacaggagtctcctgctgatgcgtgatagcttaagcttggggagaaggtcttttccactgcctagctaagcagtctggggagagcatggggatcatttctatgtgtgtgggtaatctggtcagtaagattgagacttagttaagattccccttggaaattccttaatgtttattagcttctaactagtgttgtaagtccgatgccagaatttggagatttgagttcttcttttcatggcttttattcactgtgactaataagcttcctaataaatccttgccagacttaa

SEQ ID NO: 408370 - DNA, 506 bp, Homo sapiens
atgttcacaagcctaatgaagacttctaaagacttctcccccagtcccactaccatgtcattgaatgtatggaactgtagtcaagataactgtatttgcatgaaaatacagttgggtagtttagatttggacttggtttctggtgagccttgattgaatctacaccctatctctgccttttgttgagccacttgacctagccaagtatcagttttgttttttagctgtaaaattgggataaatagagctatcactagtgtttattgaggcggtgcttagcccctgttcataaattcttgatatgggttggtgccaccatctgacacatgggcacaaaggaggagggaccgggaaggctacacagctgccaacagactctatctgacccagctttagtcaggacctcgcttttgtccttcccagcctcagtagaagtccctgcagtgcgaacctcctcacccttgatgtctgattgagttcctcatcccctggccttgatgtctgag

SEQ ID NO: 408371 - DNA, 2824 bp, Homo sapiens
cgccggcgtcgtttgacggctggaggccaccgagaagaaggaggaagcaggggtggcggctgctgcggcggttgcggcgggggccggggtgggcgccgcggtccgggccgggcagtgaggcgcgggcggccgggccggtgggctgggcggcgggcccggcggccgccctcgcacccttgcccgcgcctggcggcccgatgtggctgcagcagcggctcaaggggctgccgggactgctgtcgagcagctgggcccgccgcctcctctgcctgcttggcctcctgctgctgcttctgtggtttggggggtccggcgcgcggcgggcggcgggcggcctgcacctgctgccctggtcccgcggtgagccgggcgccgccgagccgtctgcctgcctggaggcggccacccgcgcctggcgcggcctgcgggagcgcggtgaggtggtaccgctgggtcctggagtgccggccctggtggccaacggcttcctggccctggacgtggctgccaatcggctgtgggtgactcccggggagcgggagcccgccgtggcgccggactttgtgcccttcgtgcagctgcgcccgctgagcgcgctggctgaagctggagaggcggtgctgctgctgcgggaggggcttctgcgccgcgtgcgttgcctgcagctggggtccccaggtcctggccccgtggccgccggccccgggcccgcctccgtctctggccttgccgcggggtccggccgcgactgcgtgctgctgcaagaggactttctggcgcacaggggccgaccccacgtctacctgcagcgcatccagctcaacaaccccacggagcgcgtggccgcgctgcagactgtggggcccactgccggcccagcccccaaggccttcaccagtaccctggagaaggtcggagaccatcagttcctcctctactcaggccggtccccgcctacgcccactgggttggtgcacctggtggtggtggccgccaagaagctggtgaaccgcctccaagtggctcccaagacgcagctggatgagacggtgctgtgggtggtgcacgtctctggccccattaacccccaggtgctcaaaagcaaagcagccaaggagctcaaggcgctgcaggacttggcacggaaggaaatgctggagctcttggacatgccagcggcggagctgcttcaagaccaccagctcctctgggctcagctcttcagcccaggagtggaaatgaagaagatcactgacacccacacgccgtctggcctcaccgtgaacctgacgctctattacatgctctcctgctcgccagccccactgctcagcccctccctgagccacagggagcgagaccagatggagtcgacgctcaactatgaagatcactgcttcagcgggcacgccaccatgcacgccgagaacctgtggccggggcggctgtcctccgtccagcagatcctgcagctctctgacctgtggaggctgaccctccagaagcgtggctgcaaggggctggtgaaggtgggtgccccaggcatcctgcaggggatggtgctcagctttggggggctgcagttcacagagaaccacctccagttccaggccgaccccgacgtgctgcacaacagctatgcattgcatggcatccgctacaagaacgaccatatcaacctggccgtgctggcggatgccgagggcaagccctacctacacgtgtccgtggagtcccgtggccagcctgtcaagatctatgcctgcaaggcaggctgcctggacgagccagtggagctgacctcggcgcccacgggccacaccttctcggtcatggtgacacagcccatcacgccactgctctacatctccaccgacctcacacacctgcaggacctgcggcacacgctgcacctcaaggccatcctggcccatgatgagcacatggcccagcaggaccccgggctgcccttcctcttctggttcagcgtggcctccctaatcaccctcttccacctcttcctcttcaagctcatctacaacgagtactgtgggcctggagccaagcccctcttcaggagtaaggaagatcccagtgtctgagtgaactaacagtcctgctttcagccaccatttgcacaagacacccagcactgaaagtcccgctgccaggagcaagggatcctttggaagcacccgccctttgtgccttgttgggggaaaccggtgacgcagaagtgagtgtggatacaccagagtttgcattggaaggaatgagtgtcacgtggggagggaaggggccagtggaccttttgtaagctttccactcaataaaatgaacctgtatggcaaatacttgaaatggaactcactccttccactttccccctttcttctgtcccaggaaatagatcatcttttgaaaagactcttgtctaggaaaagttgtgtccttttcctaatttaacgtgttctttcttaatgaagttttaatttatttttgttgagattttgctagatggcttttgcatcccctgtagatggtgagtgttggcggtgatgtccgtctcggcgttcggaggccccacggtcccgaggctgggccggggccccccagggtggctgtgctgctgcctgtaggagggtgcgggttgtgctgtcatcctcgggtttgcacgcccttttttaggagcctgtggacatctgtggttttgtactttggggcttcaggggaggtgtttaactttctagtgattgatgattgtcaggttttgaaataccaaagcttttttgttctgtttttaaataaatatctttcaaacttt

SEQ ID NO: 408372 - DNA, 2858 bp, Homo sapiens
cgccggcgtcgtttgacggctggaggccaccgagaagaaggaggaagcaggggtggcggctgctgcggcggttgcggcgggggccggggtgggcgccgcggtccgggccgggcagtgaggcgcgggcggccgggccggtgggctgggcggcgggcccggcggccgccctcgcacccttgcccgcgcctggcggcccgatgtggctgcagcagcggctcaaggggctgccgggactgctgtcgagcagctgggcccgccgcctcctctgcctgcttggcctcctgctgctgcttctgtggtttggggggtccggcgcgcggcgggcggcgggcggcctgcacctgctgccctggtcccgcggtgagccgggcgccgccgagccgtctgcctgcctggaggcggccacccgcgcctggcgcggcctgcgggagcgcggtgaggtggtaccgctgggtcctggagtgccggccctggtggccaacggcttcctggccctggacgtggctgccaatcggctgtgggtgactcccggggagcgggagcccgccgtggcgccggactttgtgcccttcgtgcagctgcgcccgctgagcgcgctggctgaagctggagaggcggtgctgctgctgcgggaggggcttctgcgccgcgtgcgttgcctgcagctggggtccccaggtcctggccccgtggccgccggccccgggcccgcctccgtctctggccttgccgcggggtccggccgcgactgcgtgctgctgcaagaggactttctggcgcacaggggccgaccccacgtctacctgcagcgcatccagctcaacaaccccacggagcgcgtggccgcgctgcagactgtggggcccactgccggcccagcccccaaggccttcaccagtaccctggagaaggtcggagaccatcagttcctcctctactcaggccggtccccgcctacgcccactgggttggtgcacctggtggtggtggccgccaagaagctggtgaaccgcctccaagtggctcccaagacgcagctggatgagacggtgctgtgggtggtgcacgtctctggccccattaacccccaggtgctcaaaagcaaagcagccaaggagctcaaggcgctgcaggacttggcacggaaggaaatgctggagctcttggacatgccagcggcggagctgcttcaagaccaccagctcctctgggctcagctcttcagcccaggagtggaaatgaagaagatcactgacacccacacgccgtctggcctcaccgtgaacctgacgctctattacatgctctcctgctcgccagccccactgctcagcccctccctgagccacagggagcgagaccagatggagtcgacgctcaactatgaagatcactgcttcagcgggcacgccaccatgcacgccgagaacctgtggccggggcggctgtcctccgtccagcagatcctgcagctctctgacctgtggaggctgaccctccagaagcgtggctgcaaggggctggtgaaggtgggtgccccaggcatcctgcaggggatggtgctcagctttggggggctgcagttcacagagaaccacctccagttccaggccgaccccgacgtgctgcacaacagctatgcattgcatggcatccgctacaagaacgaccatatcaacctggccgtgctggcggatgccgagggcaagccctacctacacgtgtccgtggagtcccgtggccagcctgtcaagatctatgcctgcaaggcaggctgcctggacgagccagtggagctgacctcggcgcccacgggccacaccttctcggtcatggtgacacagcccatcacgccactgctctacatctccaccgacctcacacacctgcaggacctgcggcacacgctgcacctcaaggccatcctggcccatgatgagcacatggcccagcaggaccccgggctgcccttcctcttctggttcagcgtggcctccctaatcaccctcttccacctcttcctcttcaagctcatctacaacgagtactgtgggcctggagccaagcccctcttcaggagtaaggaagatcccagtgtctgagtgaactaacagtcctgctttcagccaccatttgcacaagacacccagcactgaaagtcccgctgccaggagcaagggatcctttggaagcacccgccctttgtgccttgttgggggaaaccggtgacgcagaagtgagtgtggatacaccagagtttgcattggaaggaatgagtgtcacgtggggagggaaggggccagtggaccttttgtaagctttccactcaataaaatgaacctgtatggcaaatacttgaaatggaactcactccttccactttccccctttcttctgtcccaggaaatagatcatcttttgaaaagactcttgtctaggaaaagttgtgtccttttcctaatttaacgtgttctttcttaatgaagttttaatttatttttgttgagattttgctagatggcttttgcatcccctgtagatggtgagtgttggcggtgatgtccgtctcggcgttcggaggccccacggtcccgaggctgggccggggccccccagggtggctgtgctgctgcctgtaggagggtgcgggttgtgctgtcatcctcgggtttgcacgcccttttttaggagcctgtggacatctgtggttttgtactttggggcttcaggggaggtgtttaactttctagtgattgatgattgtcaggttttgaaataccaaagcttttttgttctgtttttaaataaatatctttcaaactttaaaaaaaagggtcgtggcgggaggaacagaggac

SEQ ID NO: 408373 - DNA, 3026 bp, Homo sapiens
cgccggcgtcgtttgacggctggaggccaccgagaagaaggaggaagcaggggtggcggctgctgcggcggttgcggcgggggccggggtgggcgccgcggtccgggccgggcagtgaggcgcgggcggccgggccggtgggctgggcggcgggcccggcggccgccctcgcacccttgcccgcgcctggcggcccgatgtggctgcagcagcggctcaaggggctgccgggactgctgtcgagcagctgggcccgccgcctcctctgcctgcttggcctcctgctgctgcttctgtggtttggggggtccggcgcgcggcgggcggcgggcggcctgcacctgctgccctggtcccgcggtgagccgggcgccgccgagccgtctgcctgcctggaggcggccacccgcgcctggcgcggcctgcgggagcgcggtgaggtggtaccgctgggtcctggagtgccggccctggtggccaacggcttcctggccctggacgtggctgccaatcggctgtgggtgactcccggggagcgggagcccgccgtggcgccggactttgtgcccttcgtgcagctgcgcccgctgagcgcgctggctgaagctggagaggcggtgctgctgctgcgggaggggcttctgcgccgcgtgcgttgcctgcagctggggtccccaggtcctggccccgtggccgccggccccgggcccgcctccgtctctggccttgccgcggggtccggccgcgactgcgtgctgctgcaagaggactttctggcgcacaggggccgaccccacgtctacctgcagcgcatccagctcaacaaccccacggagcgcgtggccgcgctgcagactgtggggcccactgccggcccagcccccaaggccttcaccagtaccctggagaaggtcggagaccatcagttcctcctctactcaggccggtccccgcctacgcccactgggttggtgcacctggtggtggtggccgccaagaagctggtgaaccgcctccaagtggctcccaagacgcagctggatgagacggtgctgtgggtggtgcacgtctctggccccattaacccccaggtgctcaaaagcaaagcagccaaggagctcaaggcgctgcaggacttggcacggaaggaaatgctggagctcttggacatgccagcggcggagctgcttcaagaccaccagctcctctgggctcagctcttcagcccaggagtggaaatgaagaagatcactgacacccacacgccgtctggcctcaccgtgaacctgacgctctattacatgctctcctgctcgccagccccactgctcagcccctccctgagccacagggagcgagaccagatggagtcgacgctcaactatgaagatcactgcttcagcgggcacgccaccatgcacgccgagaacctgtggccggggcggctgtcctccgtccagcagatcctgcagctctctgacctgtggaggctgaccctccagaagcgtggctgcaaggggctggtgaaggtgggtgccccaggcatcctgcaggggatggtgctcagctttggggggctgcagttcacagagaaccacctccagttccaggccgaccccgacgtgctgcacaacagctatgcattgcatggcatccgctacaagaacgaccatatcaacctggccgtgctggcggatgccgagggcaagccctacctacacgtgtccgtggagtcccgtggccagcctgtcaagatctatgcctgcaaggcaggctgcctggacgagccagtggagctgacctcggcgcccacgggccacaccttctcggtcatggtgacacagcccatcacgccactgctctacatctccaccgacctcacacacctgcaggacctgcggcacacgctgcacctcaaggccatcctggcccatgatgagcacatggcccagcaggaccccgggctgcccttcctcttctggttcagcgtggcctccctaatcaccctcttccacctcttcctcttcaagctcatctacaacgagtactgtgggcctggagccaagcccctcttcaggagtaaggctcaagctgggccatgccagagtggagccagtgaacactcagctccagaagggcccaggccactgagtccgtggtaattctgcaaggctgggtcagagccagggtgtggtgccactagggttgtctccgtagcctatttctatagctggccactggggttggcagtgaacagtaatcacacttgttttgtgaattgaacaggaagatcccagtgtctgagtgaactaacagtcctgctttcagccaccatttgcacaagacacccagcactgaaagtcccgctgccaggagcaagggatcctttggaagcacccgccctttgtgccttgttgggggaaaccggtgacgcagaagtgagtgtggatacaccagagtttgcattggaaggaatgagtgtcacgtggggagggaaggggccagtggaccttttgtaagctttccactcaataaaatgaacctgtatggcaaatacttgaaatggaactcactccttccactttccccctttcttctgtcccaggaaatagatcatcttttgaaaagactcttgtctaggaaaagttgtgtccttttcctaatttaacgtgttctttcttaatgaagttttaatttatttttgttgagattttgctagatggcttttgcatcccctgtagatggtgagtgttggcggtgatgtccgtctcggcgttcggaggccccacggtcccgaggctgggccggggccccccagggtggctgtgctgctgcctgtaggagggtgcgggttgtgctgtcatcctcgggtttgcacgcccttttttaggagcctgtggacatctgtggttttgtactttggggcttcaggggaggtgtttaactttctagtgattgatgattgtcaggttttgaaataccaaagcttttttgttctgtttttaaataaatatctttcaaacttt

SEQ ID NO: 408374 - DNA, 3146 bp, Homo sapiens
cgccggcgtcgtttgacggctggaggccaccgagaagaaggaggaagcaggggtggcggctgctgcggcggttgcggcgggggccggggtgggcgccgcggtccgggccgggcagtgaggcgcgggcggccgggccggtgggctgggcggcgggcccggcggccgccctcgcacccttgcccgcgcctggcggcccgatgtggctgcagcagcggctcaaggggctgccgggactgctgtcgagcagctgggcccgccgcctcctctgcctgcttggcctcctgctgctgcttctgtggtttggggggtccggcgcgcggcgggcggcgggcggcctgcacctgctgccctggtcccgcggtgagccgggcgccgccgagccgtctgcctgcctggaggcggccacccgcgcctggcgcggcctgcgggagcgcggtgaggtggtaccgctgggtcctggagtgccggccctggtggccaacggcttcctggccctggacgtggctgccaatcggctgtgggtgactcccggggagcgggagcccgccgtggcgccggactttgtgcccttcgtgcagctgcgcccgctgagcgcgctggctgaagctggagaggcggtgctgctgctgcgggaggggcttctgcgccgcgtgcgttgcctgcagctggggtccccaggtcctggccccgtggccgccggccccgggcccgcctccgtctctggccttgccgcggggtccggccgcgactgcgtgctgctgcaagaggactttctggcgcacaggggccgaccccacgtctacctgcagcgcatccagctcaacaaccccacggagcgcgtggccgcgctgcagactgtggggcccactgccggcccagcccccaaggccttcaccagtaccctggagaaggtcggagaccatcagttcctcctctactcaggccggtccccgcctacgcccactgggttggtgcacctggtggtggtggccgccaagaagctggtgaaccgcctccaagtggctcccaagacgcagctggatgagacggtgctgtgggtggtgcacgtctctggccccattaacccccaggtgctcaaaagcaaagcagccaaggagctcaaggcgctgcaggacttggcacggaaggaaatgctggagctcttggacatgccagcggcggagctgcttcaagaccaccagctcctctgggctcagctcttcagcccaggagtggaaatgaagaagatcactgacacccacacgccgtctggcctcaccgtgaacctgacgctctattacatgctctcctgctcgccagccccactgctcagcccctccctgagccacagggagcgagaccagatggagtcgacgctcaactatgaagatcactgcttcagcgggcacgccaccatgcacgccgagaacctgtggccggggcggctgtcctccgtccagcagatcctgcagctctctgacctgtggaggctgaccctccagaagcgtggctgcaaggggctggtgaaggtgggtgccccaggcatcctgcaggggatggtgctcagctttggggggctgcagttcacagagaaccacctccagttccaggccgaccccgacgtgctgcacaacagctatgcattgcatggcatccgctacaagaacgaccatatcaacctggccgtgctggcggatgccgagggcaagccctacctacacgtgtccgtggagtcccgtggccagcctgtcaagatctatgcctgcaaggcaggctgcctggacgagccagtggagctgacctcggcgcccacgggccacaccttctcggtcatggtgacacagcccatcacgccactgctctacatctccaccgacctcacacacctgcaggacctgcggcacacgctgcacctcaaggccatcctggcccatgatgagcacatggcccagcaggaccccgggctgcccttcctcttctggttcagcgtggcctccctaatcaccctcttccacctcttcctcttcaagctcatctacaacgagtactgtgggcctggagccaagcccctcttcaggagtaaggaagatcccagtgtctgagtgaactaacagtcctgctttcagccaccatttgcacaagacacccagcactgaaagtcccgctgccaggagcaagggatcctttggaagcacccgccctttgtgccttgttgggggaaaccggtgacgcagaagtgagtgtggatacaccagagtttgcattggaaggaatgagtgtcacgtggggagggaaggggccagtggaccttttgtaagctttccactcaataaaatgaacctgtatggcaaatacttgaaatggaactcactccttccactttccccctttcttctgtcccaggaaatagatcatcttttgaaaagactcttgtctaggaaaagttgtgtccttttcctaatttaacgtgttctttcttaatgaagttttaatttatttttgttgagattttgctagatggcttttgcatcccctgtagatggtgagtgttggcggtgatgtccgtctcggcgttcggaggccccacggtcccgaggctgggccggggccccccagggtggctgtgctgctgcctgtaggagggtgcgggttgtgctgtcatcctcgggtttgcacgcccttttttaggagcctgtggacatctgtggttttgtactttggggcttcaggggaggtgtttaactttctagtgattgatgattgtcaggttttgaaataccaaagcttttttgttctgtttttaaataaatatctttcaaactttaaaaaaaaaaaaaaaaaaaaaaacccagggatcctagttagcgggggtggacggaaacaaacagggattgtacatggcgagccattcgccattttgcttgggtgtccttaaccacatgttttcttgagtcacagaaggtggttaaatatgggccggcgttctcccttattacggtgaggctcagcttattacgttacggacaaaggcacagggtttaacccttcgctttataattggatctcgcaatctgaaatcatagtactacgacatactgtgcaagtatacactagcagaggagcacagagcacataacatagctagt

SEQ ID NO: 408375 - DNA, 2350 bp, Homo sapiens
cgccggcgtcgtttgacggctggaggccaccgagaagaaggaggaagcaggggtggcggctgctgcggcggttgcggcgggggccggggtgggcgccgcggtccgggccgggcagtgaggcgcgggcggccgggccggtgggctgggcggcgggcccggcggccgccctcgcacccttgcccgcgcctggcggcccgatgtggctgcagcagcggctcaaggggctgccgggactgctgtcgagcagctgggcccgccgcctcctctgcctgcttggcctcctgctgctgcttctgtggtttggggggtccggcgcgcggcgggcggcgggcggcctgcacctgctgccctggtcccgcggtgagccgggcgccgccgagccgtctgcctgcctggaggcggccacccgcgcctggcgcggcctgcgggagcgcggtgaggtggtaccgctgggtcctggagtgccggccctggtggccaacggcttcctggccctggacgtggctgccaatcggctgtgggtgactcccggggagcgggagcccgccgtggcgccggactttgtgcccttcgtgcagctgcgcccgctgagcgcgctggctgaagctggagaggcggtgctgctgctgcgggaggggcttctgcgccgcgtgcgttgcctgcagctggggtccccaggtcctggccccgtggccgccggccccgggcccgcctccgtctctggccttgccgcggggtccggccgcgactgcgtgctgctgcaagaggactttctggcgcacaggggccgaccccacgtctacctgcagcgcatccagctcaacaaccccacggagcgcgtggccgcgctgcagactgtggggcccactgccggcccagcccccaaggccttcaccagtaccctggagaaggtcggagaccatcagttcctcctctactcaggccggtccccgcctacgcccactgggttggtgcacctggtggtggtggccgccaagaagctggtgaaccgcctccaagtggctcccaagacgcagctggatgagacggtgctgtgggtggtgcacgtctctggccccattaacccccaggtgctcaaaagcaaagcagccaaggagctcaaggcgctgcaggacttggcacggaaggaaatgctggagctcttggacatgccagcggcggagctgcttcaagaccaccagctcctctgggctcagctcttcagcccaggagtggaaatgaagaagatcactgacacccacacgccgtctggcctcaccgtgaacctgacgctctattacatgctctcctgctcgccagccccactgctcagcccctccctgagccacagggagcgagaccagatggagtcgacgctcaactatgaagatcactgcttcagcgggcacgccaccatgcacgccgagaacctgtggccggggcggctgtcctccgtccagcagatcctgcagctctctgacctgtggaggctgaccctccagaagcgtggctgcaaggggctggtgaaggtgggtgccccaggcatcctgcaggggatggtgctcagctttggggggctgcagttcacagagaaccacctccagttccaggccgaccccgacgtgctgcacaacagctatgcattgcatggcatccgctacaagaacgaccatatcaacctggccgtgctggcggatgccgagggcaagccctacctacacgtgtccgtggagtcccgtggccagcctgtcaagatctatgcctgcaaggcaggctgcctggacgagccagtggagctgacctcggcgcccacgggccacaccttctcggtcatggtgacacagcccatcacgccactgctctacatctccaccgacctcacacacctgcaggacctgcggcacacgctgcacctcaaggccatcctggcccatgatgagcacatggcccagcaggaccccgggctgcccttcctcttctggttcagcgtggcctccctaatcaccctcttccacctcttcctcttcaagctcatctacaacgagtactgtgggcctggagccaagcccctcttcaggagtaaggaagatcccagtgtctgagtgaactaacagtcctgctttcagccaccatttgcacaagacacccagcactgaaagtcccgctgccaggagcaagggatcctttggaagcacccgccctttgtgccttgttgggggaaaccggtgacgcagaagtgagtgtggatacaccagagtttgcattggaaggaatgagtgtcacgtggggagggaaggggccagtggaccttttgtaagctttccactcaataaaatgaacctgtatggca

SEQ ID NO: 408376 - DNA, 1307 bp, Homo sapiens
tgcctgcggcttctagtttctggcccaagaccaggacttggaaaaggaagcagaacttgacctgaaagagcagaagagtgggagacagggctgagttcctcaagttcgaagaaaaatcaaaagtcagatcaaaaaggactgcacagaggccttccttgtgagccgcctctgaactagctgcactaggacaggtgccaaatgtgcatcgtgtgggttttgccgtctgtttggcaggcggctgcttttccctgctgcttggtggcttctctgccctcgctcttgagtgcaccttcggttcctcccacagttgggcaaatgagccaaactaccttcatggggtactgaccgatctctccttgacttaggctcaagctgggccatgccagagtggagccagtgaacactcagctccagaagggcccaggccactgagtccgtggtaattctgcaaggctgggtcagagccagggtgtggtgccactagggttgtctccgtagcctatttctatagctggccactggggttggcagtgaacagtaatcacacttgttttgtgaattgaacaggaagatcccagtgtctgagtgaactaacagtcctgctttcagccaccatttgcacaagacacccagcactgaaagtcccgctgccaggagcaagggatcctttggaagcacccgccctttgtgccttgttgggggaaaccggtgacgcagaagtgagtgtggatacaccagagtttgcattggaaggaatgagtgtcacgtggggagggaaggggccagtggaccttttgtaagctttccactcaataaaatgaacctgtatggcaaatacttgaaatggaactcactccttccactttccccctttcttctgtcccaggaaatagatcatcttttgaaaagactcttgtctaggaaaagttgtgtccttttcctaatttaacgtgttctttcttaatgaagttttaatttatttttgttgagattttgctagatggcttttgcatcccctgtagatggtgagtgttggcggtgatgtccgtctcggcgttcggaggccccacggtcccgaggctgggccggggccccccagggtggctgtgctgctgcctgtaggagggtgcgggttgtgctgtcatcctcgggtttgcacgcccttttttaggagcctgtggacatctgtggttttgtactttggggcttcaggggaggtgtttaactttctagtgattgatgattgtcaggttttgaaataccaaagcttttttgttctgtttttaaataaatatctttcaaacttt

SEQ ID NO: 408377 - DNA, 2552 bp, Homo sapiens
cgccggcgtcgtttgacggctggaggccaccgagaagaaggaggaagcaggggtggcggctgctgcggcggttgcggcgggggccggggtgggcgccgcggtccgggccgggcagtgaggcgcgggcggccgggccggtgggctgggcggcgggcccggcggccgccctcgcacccttgcccgcgcctggcggcccgatgtggctgcagcagcggctcaaggggctgccgggactgctgtcgagcagctgggcccgccgcctcctctgcctgcttggcctcctgctgctgcttctgtggtttggggggtccggcgcgcggcgggcggcgggcggcctgcacctgctgccctggtcccgcggtgagccgggcgccgccgagccgtctgcctgcctggaggcggccacccgcgcctggcgcggcctgcgggagcgcggtgaggtggtaccgctgggtcctggagtgccggccctggtggccaacggcttcctggccctggacgtggctgccaatcggctgtgggtgactcccggggagcgggagcccgccgtggcgccggactttgtgcccttcgtgcagctgcgcccgctgagcgcgctggctgaagctggagaggcggtgctgctgctgcgggaggggcttctgcgccgcgtgcgttgcctgcagctggggtccccaggtcctggccccgtggccgccggccccgggcccgcctccgtctctggccttgccgcggggtccggccgcgactgcgtgctgctgcaagaggactttctggcgcacaggggccgaccccacgtctacctgcagcgcatccagctcaacaaccccacggagcgcgtggccgcgctgcagactgtggggcccactgccggcccagcccccaaggccttcaccagtaccctggagaaggtcggagaccatcagttcctcctctactcaggccggtccccgcctacgcccactgggttggtgcacctggtggtggtggccgccaagaagctggtgaaccgcctccaagtggctcccaagacgcagctggatgagacggtgctgtgggtggtgcacgtctctggccccattaacccccaggtgctcaaaagcaaagcagccaaggagctcaaggcgctgcaggacttggcacggaaggaaatgctggagctcttggacatgccagcggcggagctgcttcaagaccaccagctcctctgggctcagctcttcagcccaggagtggaaatgaagaagatcactgacacccacacgccgtctggcctcaccgtgaacctgacgctctattacatgctctcctgctcgccagccccactgctcagcccctccctgagccacagggagcgagaccagatggagtcgacgctcaactatgaagatcactgcttcagcgggcacgccaccatgcacgccgagaacctgtggccggggcggctgtcctccgtccagcagatcctgcagctctctgacctgtggaggctgaccctccagaagcgtggctgcaaggggctggtgaaggtgggtgccccaggcatcctgcaggggatggtgctcagctttggggggctgcagttcacagagaaccacctccagttccaggccgaccccgacgtgctgcacaacagctatgcattgcatggcatccgctacaagaacgaccatatcaacctggccgtgctggcggatgccgagggcaagccctacctacacgtgtccgtggagtcccgtggccagcctgtcaagatctatgcctgcaaggcaggctgcctggacgagccagtggagctgacctcggcgcccacgggccacaccttctcggtcatggtgacacagcccatcacgccactgctctacatctccaccgacctcacacacctgcaggacctgcggcacacgctgcacctcaaggccatcctggcccatgatgagcacatggcccagcaggaccccgggctgcccttcctcttctggttcagcgtggcctccctaatcaccctcttccacctcttcctcttcaagctcatctacaacgagtactgtgggcctggagccaagcccctcttcaggagtaaggctcaagctgggccatgccagagtggagccagtgaacactcagctccagaagggcccaggccactgagtccgtggtaattctgcaaggctgggtcagagccagggtgtggtgccactagggttgtctccgtagcctatttctatagctggccactggggttggcagtgaacagtaatcacacttgttttgtgaattgaacaggaagatcccagtgtctgagtgaactaacagtcctgctttcagccaccatttgcacaagacacccagcactgaaagtcccgctgccaggagcaagggatcctttggaagcacccgccctttgtgccttgttgggggaaaccggtgacgcagaagtgagtgtggatacaccagagtttgcattggaaggaatgagtgtcacgtggggagggaaggggccagtggaccttttgtaagctttccactcaataaaatgaacctgtatggca

SEQ ID NO: 408378 - DNA, 2708 bp, Homo sapiens
cgccggcgtcgtttgacggctggaggccaccgagaagaaggaggaagcaggggtggcggctgctgcggcggttgcggcgggggccggggtgggcgccgcggtccgggccgggcagtgaggcgcgggcggccgggccggtgggctgggcggcgggcccggcggccgccctcgcacccttgcccgcgcctggcggcccgatgtggctgcagcagcggctcaaggggctgccgggactgctgtcgagcagctgggcccgccgcctcctctgcctgcttggcctcctgctgctgcttctgtggtttggggggtccggcgcgcggcgggcggcgggcggcctgcacctgctgccctggtcccgcggtgagccgggcgccgccgagccgtctgcctgcctggaggcggccacccgcgcctggcgcggcctgcgggagcgcggtgaggtggtaccgctgggtcctggagtgccggccctggtggccaacggcttcctggccctggacgtggctgccaatcggctgtgggtgactcccggggagcgggagcccgccgtggcgccggactttgtgcccttcgtgcagctgcgcccgctgagcgcgctggctgaagctggagaggcggtgctgctgctgcgggaggggcttctgcgccgcgtgcgttgcctgcagctggggtccccaggtcctggccccgtggccgccggccccgggcccgcctccgtctctggccttgccgcggggtccggccgcgactgcgtgctgctgcaagaggactttctggcgcacaggggccgaccccacgtctacctgcagcgcatccagctcaacaaccccacggagcgcgtggccgcgctgcagactgtggggcccactgccggcccagcccccaaggccttcaccagtaccctggagaaggtcggagaccatcagttcctcctctactcaggccggtccccgcctacgcccactgggttggtgcacctggtggtggtggccgccaagaagctggtgaaccgcctccaagtggctcccaagacgcagctggatgagacggtgctgtgggtggtgcacgtctctggccccattaacccccaggtgctcaaaagcaaagcagccaaggagctcaaggcgctgcaggacttggcacggaaggaaatgctggagctcttggacatgccagcggcggagctgcttcaagaccaccagctcctctgggctcagctcttcagcccaggagtggaaatgaagaagatcactgacacccacacgccgtctggcctcaccgtgaacctgacgctctattacatgctctcctgctcgccagccccactgctcagcccctccctgagccacagggagcgagaccagatggagtcgacgctcaactatgaagatcactgcttcagcgggcacgccaccatgcacgccgagaacctgtggccggggcggctgtcctccgtccagcagatcctgcagctctctgacctgtggaggctgaccctccagaagcgtggctgcaaggggctggtgaaggtgggtgccccaggcatcctgcaggggatggtgctcagctttggggggctgcagttcacagagaaccacctccagttccaggccgaccccgacgtgctgcacaacagctatgcattgcatggcatccgctacaagaacgaccatatcaacctggccgtgctggcggatgccgagggcaagccctacctacacgtgtccgtggagtcccgtggccagcctgtcaagatctatgcctgcaaggcaggctgcctggacgagccagtggagctgacctcggcgcccacgggccacaccttctcggtcatggtgacacagcccatcacgccactgctctacatctccaccgacctcacacacctgcaggacctgcggcacacgctgcacctcaaggccatcctggcccatgatgagcacatggcccagcaggaccccgggctgcccttcctcttctggttcagcgtggcctccctaatcaccctcttccacctcttcctcttcaagctcatctacaacgagtactgtgggcctggagccaagcccctcttcaggagtaaggtaggaagccgccatctggtcgaaacccgaggccttggccttgctctcagccctgtgtctcggaaggggctagcctggcgagggggggtgaggcctgggcaggaatgggtgtcctgatgccctcagcccttgacaccagagagcgcgcgcaagtgttttgagaggagacgacgaggaagggaaagctggaaatccaggtgtgaattgatggtcttctggctttccagggcagccctcccctcctcccgcatcataaatctcagcatttaaaaataactgcaagctgggtgtggtggcttgtgcctgtagtcccagctacttgggaggctgagatgggagaatcccttgagcccaggagtttgaggctgcagtgaactatgattgtgtcattgcactctagctggggcaacagagcaagaccggctcaaaagcaaaacaaaagcaataagtaaaacaaacaaaagggggcggcaaaatcccagggggcaagagacgaccattgggcaaaggccaagaaggcggaaaagaacacagcgcgcaacgcgagggcaagacgaccgggagcccagcggggccggcaccgcaacccgcaaataaggaggaacatccgacagaggtacaaac

SEQ ID NO: 408379 - DNA, 2532 bp, Homo sapiens
cgccggcgtcgtttgacggctggaggccaccgagaagaaggaggaagcaggggtggcggctgctgcggcggttgcggcgggggccggggtgggcgccgcggtccgggccgccacccgcgcctggcgcggcctgcgggagcgcggtgaggtggtaccgctgggtcctggagtgccggccctggtggccaacggcttcctggccctggacgtggctgccaatcggctgtgggtgactcccggggagcgggagcccgccgtggcgccggactttgtgcccttcgtgcagctgcgcccgctgagcgcgctggctgaagctggagaggcggtgctgctgctgcgggaggggcttctgcgccgcgtgcgttgcctgcagctggggtccccaggtcctggccccgtggccgccggccccgggcccgcctccgtctctggccttgccgcggggtccggccgcgactgcgtgctgctgcaagaggactttctggcgcacaggggccgaccccacgtctacctgcagcgcatccagctcaacaaccccacggagcgcgtggccgcgctgcagactgtggggcccactgccggcccagcccccaaggccttcaccagtaccctggagaaggtcggagaccatcagttcctcctctactcaggccggtccccgcctacgcccactgggttggtgcacctggtggtggtggccgccaagaagctggtgaaccgcctccaagtggctcccaagacgcagctggatgagacggtgctgtgggtggtgcacgtctctggccccattaacccccaggtgctcaaaagcaaagcagccaaggagctcaaggcgctgcaggacttggcacggaaggaaatgctggagctcttggacatgccagcggcggagctgcttcaagaccaccagctcctctgggctcagctcttcagcccaggagtggaaatgaagaagatcactgacacccacacgccgtctggcctcaccgtgaacctgacgctctattacatgctctcctgctcgccagccccactgctcagcccctccctgagccacagggagcgagaccagatggagtcgacgctcaactatgaagatcactgcttcagcgggcacgccaccatgcacgccgagaacctgtggccggggcggctgtcctccgtccagcagatcctgcagctctctgacctgtggaggctgaccctccagaagcgtggctgcaaggggctggtgaaggtgggtgccccaggcatcctgcaggggatggtgctcagctttggggggctgcagttcacagagaaccacctccagttccaggccgaccccgacgtgctgcacaacagctatgcattgcatggcatccgctacaagaacgaccatatcaacctggccgtgctggcggatgccgagggcaagccctacctacacgtgtccgtggagtcccgtggccagcctgtcaagatctatgcctgcaaggcaggctgcctggacgagccagtggagctgacctcggcgcccacgggccacaccttctcggtcatggtgacacagcccatcacgccactgctctacatctccaccgacctcacacacctgcaggacctgcggcacacgctgcacctcaaggccatcctggcccatgatgagcacatggcccagcaggaccccgggctgcccttcctcttctggttcagcgtggcctccctaatcaccctcttccacctcttcctcttcaagctcatctacaacgagtactgtgggcctggagccaagcccctcttcaggagtaaggaagatcccagtgtctgagtgaactaacagtcctgctttcagccaccatttgcacaagacacccagcactgaaagtcccgctgccaggagcaagggatcctttggaagcacccgccctttgtgccttgttgggggaaaccggtgacgcagaagtgagtgtggatacaccagagtttgcattggaaggaatgagtgtcacgtggggagggaaggggccagtggaccttttgtaagctttccactcaataaaatgaacctgtatggcaaatacttgaaatggaactcactccttccactttccccctttcttctgtcccaggaaatagatcatcttttgaaaagactcttgtctaggaaaagttgtgtccttttcctaatttaacgtgttctttcttaatgaagttttaatttatttttgttgagattttgctagatggcttttgcatcccctgtagatggtgagtgttggcggtgatgtccgtctcggcgttcggaggccccacggtcccgaggctgggccggggccccccagggtggctgtgctgctgcctgtaggagggtgcgggttgtgctgtcatcctcgggtttgcacgcccttttttaggagcctgtggacatctgtggttttgtactttggggcttcaggggaggtgtttaactttctagtgattgatgattgtcaggttttgaaataccaaagcttttttgttctgtttttaaataaatatctttcaaacttt

SEQ ID NO: 408380 - DNA, 2749 bp, Homo sapiens
cgccggcgtcgtttgacggctggaggccaccgagaagaaggaggaagcaggggtggcggctgctgcggcggttgcggcgggggccggggtgggcgccgcggtccgggccgggcagtgaggcgcgggcggccgggccggtgggctgggcggcgggcccggcggccgccctcgcacccttgcccgcgcctggcggcccgatgtggctgcagcagcggctcaaggggctgccgggactgctgtcgagcagctgggcccgccgcctcctctgcctgcttggcctcctgctgctgcttctgtggtttggggggtccggcgcgcggcgggcggcgggcggcctgcacctgctgccctggtcccgcggtgagccgggcgccgccgagccgtctgcctgcctggaggcggccacccgcgcctggcgcggcctgcgggagcgcggtgaggtggtaccgctgggtcctggagtgccggccctggtggccaacggcttcctggccctggacgtggctgccaatcggctgtgggtgactcccggggagcgggagcccgccgtggcgccggactttgtgcccttcgtgcagctgcgcccgctgagcgcgctggctgaagctggagaggcggtgctgctgctgcgggaggggcttctgcgccgcgtgcgttgcctgcagctggggtccccaggtcctggccccgtggccgccggccccgggcccgcctccgtctctggccttgccgcggggtccggccgcgactgcgtgctgctgcaagaggactttctggcgcacaggggccgaccccacgtctacctgcagcgcatccagctcaacaaccccacggagcgcgtggccgcgctgcagactgtggggcccactgccggcccagcccccaaggccttcaccagtaccctggagaaggtcggagaccatcagttcctcctctactcaggccggtccccgcctacgcccactgggttggtgcacctggtggtggtggccgccaagaagctggtgaaccgcctccaagtggctcccaagacgcagctggatgagacggtgctgtgggtggtgcacgtctctggccccattaacccccaggtgctcaaaagcaaagcagccaaggagctcaaggcgctgcaggacttggcacggaaggaaatgctggagctcttggacatgccagcggcggagctgcttcaagaccaccagctcctctgggctcagctcttcagcccaggagtggaaatgaagaagatcactgacacccacacgccgtctggcctcaccgtgaacctgacgctctattacatgctctcctgctcgccagccccactgctcagcccctccctgagccacagggagcgagaccagatggagtcgacgctcaactatgaagatcactgcttcagcgggcacgccaccatgcacgccgagaacctgtggccggggcggctgtcctccgtccagcagatcctgcagctctctgacctgtggaggctgaccctccagaagcgtggctgcaaggggctggtgaagttccaggccgaccccgacgtgctgcacaacagctatgcattgcatggcatccgctacaagaacgaccatatcaacctggccgtgctggcggatgccgagggcaagccctacctacacgtgtccgtggagtcccgtggccagcctgtcaagatctatgcctgcaaggcaggctgcctggacgagccagtggagctgacctcggcgcccacgggccacaccttctcggtcatggtgacacagcccatcacgccactgctctacatctccaccgacctcacacacctgcaggacctgcggcacacgctgcacctcaaggccatcctggcccatgatgagcacatggcccagcaggaccccgggctgcccttcctcttctggttcagcgtggcctccctaatcaccctcttccacctcttcctcttcaagctcatctacaacgagtactgtgggcctggagccaagcccctcttcaggagtaaggaagatcccagtgtctgagtgaactaacagtcctgctttcagccaccatttgcacaagacacccagcactgaaagtcccgctgccaggagcaagggatcctttggaagcacccgccctttgtgccttgttgggggaaaccggtgacgcagaagtgagtgtggatacaccagagtttgcattggaaggaatgagtgtcacgtggggagggaaggggccagtggaccttttgtaagctttccactcaataaaatgaacctgtatggcaaatacttgaaatggaactcactccttccactttccccctttcttctgtcccaggaaatagatcatcttttgaaaagactcttgtctaggaaaagttgtgtccttttcctaatttaacgtgttctttcttaatgaagttttaatttatttttgttgagattttgctagatggcttttgcatcccctgtagatggtgagtgttggcggtgatgtccgtctcggcgttcggaggccccacggtcccgaggctgggccggggccccccagggtggctgtgctgctgcctgtaggagggtgcgggttgtgctgtcatcctcgggtttgcacgcccttttttaggagcctgtggacatctgtggttttgtactttggggcttcaggggaggtgtttaactttctagtgattgatgattgtcaggttttgaaataccaaagcttttttgttctgtttttaaataaatatctttcaaacttt

SEQ ID NO: 408381 - DNA, 2551 bp, Homo sapiens
cgccggcgtcgtttgacggctggaggccaccgagaagaaggaggaagcaggggtggcggctgctgcggcggttgcggcgggggccggggtgggcgccgcggtccgggccgggcagtgaggcgcgggcggccgggccggtgggctgggcggcgggcccggcggccgccctcgcacccttgcccgcgcctggcggcccgatgtggctgcagcagcggctcaaggggctgccgggactgctgtcgagcagctgggcccgccgcctcctctgcctgcttggcctcctgctgctgcttctgtggtttggggggtccggcgcgcggcgggcggcgggcggcctgcacctgctgccctggtcccgcggtgagccgggcgccgccgagccgtctgcctgcctggaggcggccacccgcgcctggcgcggcctgcgggagcgcggtgaggtggtaccgctgggtcctggagtgccggccctggtggccaacggcttcctggccctggacgtggctgccaatcggctgtgggtgactcccggggagcgggagcccgccgtggcgccggactttgtgcccttcgtgcagctgcgcccgctgagcgcgctggctgaagctggagaggcggtgctgctgctgcgggaggggcttctgcgccgcgtgcgttgcctgcagctggggtccccaggtcctggccccgtggccgccggccccgggcccgcctccgtctctggccttgccgcggggtccggccgcgactgcgtgctgctgcaagaggactttctggcgcacaggggccgaccccacgtctacctgcagcgcatccagctcaacaaccccacggagcgcgtggccgcgctgcagactgtggggcccactgccggcccagcccccaaggccttcaccagtaccctggagaaggtcggagaccatcagttcctcctctactcaggccggtccccgcctacgcccactgggttggtgcacctggtggtggtggccgccaagaagctggtgaaccgcctccaagtggctcccaagacgcagctggatgagacggtgctgtgggtggtgcacgtctctggccccattaacccccaggtgctcaaaagcaaagcagccaaggagctcaaggcgctgcaggacttggcacggaaggaaatgctggagctcttggacatgccagcggcggagctgcttcaagaccaccagctcctctgggctcagctcttcagcccaggagtggaaatgaagaagatcactgacacccacacgccgtctggcctcaccgtgaacctgacgctctattacatgctctcctgctcgccagccccactgctcagcccctccctgagccacagggagcgagaccagatggagtcgacgctcaactatgaagatcactgcttcagcgggcacgccaccatgcacgccgagaacctgtggccggggcggctgtcctccgtccagcagatcctgcagctctctgacctgtggaggctgaccctccagaagcgtggctgcaaggggctggtgaaggtgggtgccccaggcatcctgcaggggatggtgctcagctttggggggctgcagttcacagagaaccacctccagttccaggccgaccccgacgtgctgcacaacagctatgcattgcatggcatccgctacaagaacgaccatatcaacctggccgtgctggcggatgccgagggcaagccctacctacacgtgtccgtggagtcccgtggccagcctgtcaagatctatgcctgcaaggcaggctgcctggacgagccagtggagctgacctcggcgcccacgggccacaccttctcggtcatggtgacacagcccatcacgccactgctctacatctccaccgacctcacacacctgcaggacctgcggcacacgctgcacctcaaggccatcctggcccatgatgagcacatggcccagcaggaccccgggctgcccttcctcttctggttcagcgtggcctccctaatcaccctcttccacctcttcctcttcaagctcatctacaacgagtactgtgggcctggagccaagcccctcttcaggagtaaggtaggaagccgccatctggtcgaaacccgaggccttggccttgctctcagccctgtgtctcggaaggggctagcctggcgagggggggtgaggcctgggcaggaatgggtgtcctgatgccctcagcccttgacaccagagagcgcgcgcaagtgttttgagaggagacgacgaggaagggaaagctggaaatccaggtgtgaattgatggtcttctggctttccagggcagccctcccctcctcccgcatcataaatctcagcatttaaaaataactgcaagctgggtgtggtggcttgtgcctgtagtcccagctacttgggaggctgagatgggagaatcccttgagcccaggagtttgaggctgcagtgaactatgattgtgtcattgcactctagctggggcaacagagcaagaccctgtctcaaaaaagcaaaaaacaaaaaagcaaataaaagtaaaaaa

SEQ ID NO: 408382 - DNA, 2424 bp, Homo sapiens
cgccggcgtcgtttgacggctggaggccaccgagaagaaggaggaagcaggggtggcggctgctgcggcggttgcggcgggggccggggtgggcgccgcggtccgggccgggcagtgaggcgcgggcggccgggccggtgggctgggcggcgggcccggcggccgccctcgcacccttgcccgcgcctggcggcccgatgtggctgcagcagcggctcaaggggctgccgggactgctgtcgagcagctgggcccgccgcctcctctgcctgcttggcctcctgctgctgcttctgtggtttggggggtccggcgcgcggcgggcggcgggcggcctgcacctgctgccctggtcccgcggtgagccgggcgccgccgagccgtctgcctgcctggaggcggccacccgcgcctggcgcggcctgcgggagcgcggtgaggtggtaccgctgggtcctggagtgccggccctggtggccaacggcttcctggccctggacgtggctgccaatcggctgtgggtgactcccggggagcgggagcccgccgtggcgccggactttgtgcccttcgtgcagctgcgcccgctgagcgcgctggctgaagctggagaggcggtgctgctgctgcgggaggggcttctgcgccgcgtgcgttgcctgcagctggggtccccaggtcctggccccgtggccgccggccccgggcccgcctccgtctctggccttgccgcggggtccggccgcgactgcgtgctgctgcaagaggactttctggcgcacaggggccgaccccacgtctacctgcagcgcatccagctcaacaaccccacggagcgcgtggccgcgctgcagactgtggggcccactgccggcccagcccccaaggccttcaccagtaccctggagaaggtcggagaccatcagttcctcctctactcaggccggtccccgcctacgcccactgggttggtgcacctggtggtggtggccgccaagaagctggtgaaccgcctccaagtggctcccaagacgcagctggatgagacggtgctgtgggtggtgcacgtctctggccccattaacccccaggtgctcaaaagcaaagcagccaaggagctcaaggcgctgcaggacttggcacggaaggaaatgctggagctcttggacatgccagcggcggagctgcttcaagaccaccagctcctctgggctcagctcttcagcccaggagtggaaatgaagaagatcactgacacccacacgccgtctggcctcaccgtgaacctgacgctctattacatgctctcctgctcgccagccccactgctcagcccctccctgagccacagggagcgagaccagatggagtcgacgctcaactatgaagatcactgcttcagcgggcacgccaccatgcacgccgagaacctgtggccggggcggctgtcctccgtccagcagatcctgcagctctctgacctgtggaggctgaccctccagaagcgtggctgcaaggggctggtgaaggtgggtgccccaggcatcctgcaggggatggtgctcagctttggggggctgcagttcacagagaaccacctccagttccaggccgaccccgacgtgctgcacaacagctatgcattgcatggcatccgctacaagaacgaccatatcaacctggccgtgctggcggatgccgagggcaagccctacctacacgtgtccgtggagtcccgtggccagcctgtcaagatctatgcctgcaaggcaggctgcctggacgagccagtggagctgacctcggcgcccacgggccacaccttctcggtcatggtgacacagcccatcacgccactgctctacatctccaccgacctcacacacctgcaggacctgcggcacacgctgcacctcaaggccatcctggcccatgatgagcacatggcccagcaggaccccgggctgcccttcctcttctggttcagcgtggcctccctaatcaccctcttccacctcttcctcttcaagctcatctacaacgagtactgtgggcctggagccaagcccctcttcaggagtaaggctcaagctgggccatgccagagtggagccagtgaacactcagctccagaagggcccaggccactgagtccgtggaagatcccagtgtctgagtgaactaacagtcctgctttcagccaccatttgcacaagacacccagcactgaaagtcccgctgccaggagcaagggatcctttggaagcacccgccctttgtgccttgttgggggaaaccggtgacgcagaagtgagtgtggatacaccagagtttgcattggaaggaatgagtgtcacgtggggagggaaggggccagtggaccttttgtaagctttccactcaataaaatgaacctgtatggca

SEQ ID NO: 408383 - DNA, 1607 bp, Homo sapiens
cgccggcgtcgtttgacggctggaggccaccgagaagaaggaggaagcaggggtggcggctgctgcggcggttgcggcgggggccggggtgggcgccgcggtccgggccgggcagtgaggcgcgggcggccgggccggtgggctgggcggcgggcccggcggccgccctcgcacccttgcccgcgcctggcggcccgatgtggctgcagcagcggctcaaggggctgccgggactgctgtcgagcagctgggcccgccgcctcctctgcctgcttggcctcctgctgctgcttctgtggtttggggggtccggcgcgcggcgggcggcgggcggcctgcacctgctgccctggtcccgcggtgagccgggcgccgccgagccgtctgcctgcctggaggcggccacccgcgcctggcgcggcctgcgggagcgcggtgaggtggtaccgctgggtcctggagtgccggccctggtggccaacggcttcctggccctggacgtggctgccaatcggctgtgggtgactcccggggagcgggagcccgccgtggcgccggactttgtgcccttcgtgcagctgcgcccgctgagcgcgctggctgaagctggagaggcggtgctgctgctgcgggaggggcttctgcgccgcgtgcgttgcctgcagctggggtccccaggtcctggccccgtggccgccggccccgggcccgcctccgtctctggccttgccgcggggtccggccgcgactgcgtgctgctgcaagaggactttctggcgcacaggggccgaccccacgtctacctgcagcgcatccagctcaacaaccccacggagcgcgtggccgcgctgcagactgtggggcccactgccggcccagcccccaaggccttcaccagtaccctggagaaggtcggagaccatcagttcctcctctactcaggccggtccccgcctacgcccactgggttggtgcacctggtggtggtggccgccaagaagctggtgaaccgcctccaagtggctcccaagacgcagctggatgagacggtgctgtgggtggtgcacgtctctggccccattaacccccaggtgctcaaaagcaaagcagccaaggagctcaaggcgctgcaggacttggcacggaaggaaatgctggagctcttggacatgccagcggcggagctgcttcaagaccaccagctcctctgggctcagctcttcagcccagctcttctggttcagcgtggcctccctaatcaccctcttccacctcttcctcttcaagctcatctacaacgagtactgtgggcctggagccaagcccctcttcaggagtaaggaagatcccagtgtctgagtgaactaacagtcctgctttcagccaccatttgcacaagacacccagcactgaaagtcccgctgccaggagcaagggatcctttggaagcacccgccctttgtgccttgttgggggaaaccggtgacgcagaagtgagtgtggatacaccagagtttgcattggaaggaatgagtgtcacgtggggagggaaggggccagtggaccttttgtaagctttccactcaataaaatgaacctgtatggca

SEQ ID NO: 408384 - DNA, 483 bp, Homo sapiens
agtaaaataaaataaaataactcctctaggcagaggctggatgggaggcagggtggagtcatatttgttttcctgtttccaaatccctggggaccagctcacctgtgtcccagagccttcagggtataccagggcattctgggatctcatttaaatcctggcaactcccctgctggggaggggtgaataaactcatcctctatcctgggacaccgaaatggttaggaagatcccacagctgtgaggggtgaagaaaggtgggagggctgtttcctgagcacccctctgaaggtgtgctgggtttgcttgtacattcccaactaacgttgttttgtgctgtgtcagcccctgttctaaatgctggggactcagcagtgaccagaatgatccacccctgctcttacaaatcttataaatcagtggagagatagaccattatcaggaaaataaaattaaaaccatgatcatttaaaatagattgca

SEQ ID NO: 408385 - DNA, 448 bp, Homo sapiens
gccgagtatggcgcacacctatattcccagctactcaggaggctgaagcacgagaattgcttgaagctgggaggtggaggttgcagtgagctaagatcaccccactgcactccagcctgggtgacagagtgaggttccatctctaaataaataaataaataaaataaaaatttcagcccaatatattaggaaccccattttaaatgcaattgtaaacacaattgattttatatcaactttaaatatgaaagctacactcaagtaaaccaaacagcatattacctatgaatctttacatgttcatttaaaaatttcagcccaatatattaggaaccccatttaaaacgccattgtagtaaatgacaagttagtagatttctgtgtgttcttttttttaatagaagaactaatctatgtaatgcattcctgaatctaaaatacccttagt

SEQ ID NO: 408386 - DNA, 554 bp, Homo sapiens
gctcggtacctcggtggaattctggactgcaagccgtgcgtggtggcacatgcctgtaatcccagccaccggggaggctgaagtgggagaatagcttgaacccaggttggggaggttgcagtgagtcgagaccacgccattgcactccagcctgggcaacaaagaatgaaactccatctgaaaaaaaaaacccagaaattatttctaacccaaaacaattgaaaacaggtactcaaacaagcatttttacacgcgtgttcgtagcaccatttccacatagcctgagttgtaaataatagcaatgaagcttttgctttaatgagaaaggaagtttgccataaggtttgttctggggtgtcttgctgaagccctcctgtgttcttgccctggggttcagggactggagggccctctgtggggggcatgagtcacttcattctctgtctctgcaccccagctgtcctctcctagagagaggcaatttctctttcccgaggttagtagagttttttaatatctgagagaggcttatgcatgataatgaacacctatag

SEQ ID NO: 408387 - DNA, 388 bp, Homo sapiens
tatatatatatatgaaacaagttagacaggtttcctcccaagttggtagattcagttcggttgtttaaaactcaacagtagagaattgtgctttcaaccaaaatcaacttctagacacatgggtattgtttaaactttattttccatgcatataaggagtgaagtactctgccaggtagttgaaaacagtatccatttcaaagtcataagtaatgagatgagattttttatattttctctgtgtccctgcaagttattcatcccttgatatttaatttagttaatacatgcctcttattttactttttcttataatattaagccaacttcacatcctggaattgtgaaattgctgtagcaaggataggatgatatgatcgagaagttt

SEQ ID NO: 408388 - DNA, 316 bp, Homo sapiens
tgcagctgcagatggcctgtttgcttaagttgaattaaatgtgttaaaaaacgctcagtaacacatgtatgtcgccttgccctagtagccaagggcagttctgaaggaggacatcctatgctttaaatatgtacctgttcattcatggatttcagtcacattttatttaaaggaaacttcttcctatagttaaaaaaaactgtttgcaaaccaccatcttaaaaagtctagaggaaaggctattgtcctggcttgggttgtgggtattttgagctttgtaagggttttggaattaacatggatgatggtttactag

SEQ ID NO: 408389 - DNA, 184 bp, Homo sapiens
gttcgctggtcttcggaggatgggtgcgtggcaggccttccgctgtgggagccggacaaccgtggaggctccagcgccgcgggcaagaggtggcgtttcctccactcctgcctcagcgccccctgcactcccggaggtgccatcctcctccggcgggcaggatggagagtcagacagtctgcgc

SEQ ID NO: 408390 - DNA, 1241 bp, Homo sapiens
cttttacccattggcgtgagtatttttcctcagcttccctctttctccgtattctgctcctcctcagtcccatcctccacgctttggaagctactgccttactgcccggagcgccgtcgtccccgaacctcccctgcttctccctttccttctgttccggtttctggtcgtaactcaagagcaaaccaccgtactgcaaaggaaccagatattgtgctcgcggttccaaaccgggcatgggcaccgaatgcttctcgataaatccccttatggtctctgagcattaaagaaagcaagggaggaaaacatgcgcccaagctcgttcgcaggaacatgttcgcgtgtctgcgcctgtgtgcgcagccagttttctggctgaggatcgctcgccaactacagacatcacccgcccaggacccggtgccacactcacccagaagacgaaactccacaggagcgagaagaggagtccatttctccgtcggctcggcacggcacggggatgcaggcccctgattcagtacgttctgtgaaagtggagcgagaagccaagacgtggatcgagaagccccgtggggcgggtctcagggtggcccaaaagacccctgttcacgccactaccagcctaactttaggaactgtcgtccacctggcttttattatactgccttaaacatattcacttttttgagactctagaaatttcacaagttttggggtagagcacactgggctttgggtgtgtttctcatgagggcactgacgctgaatggtgcagtgagaaaggacggtagaaaccactgcctttgcttttaccattgaagaaactgaggtcctgtgactttcccgaggtcatcggaatctgccttgcacaggagacttaaaatagttgccagcagataaaagaatgagcaaaaccacatctactccaatttgttaagtctgaaagaaagtaattgaggggggattcctctttggggaaatatttatttcctgcattgaaaatagtttaatgttagtaaacatataaaaagtattttaaattcaagttattctttatttcttatgttacataaggtactgaagttagccaaggttgcttttgtgttataatgatgcagctgctgccaaccagaagtacatttacggtctgtcagtaaagaaaacaaaaactgcctgttggtaaaaatctattagaaaatatttgtcagtaaatttgtcacaatattccagcagaagtt

SEQ ID NO: 408391 - DNA, 1077 bp, Homo sapiens
cttttacccattggcgtgagtatttttcctcagcttccctctttctccgtattctgctcctcctcagtcccatcctccacgctttggaagctactgccttactgcccggagcgccgtcgtccccgaacctcccctgcttctccctttccttctgttccggtttctggtcgtaactcaagagcaaaccaccgtactgcaaaggaaccagatattgtgctcgcggttccaaaccgggcatgggcaccgaatgcttctcgataaatccccttatggtctctgagcattaaagaaagcaagggaggaaaacatgcgcccaagctcgttcgcaggaacatgttcgcgtgtctgcgcctgtgtgcgcagccagttttctggctgaggatcgctcgccaactacagacatcacccgtggggcgggtctcagggtggcccaaaagacccctgttcacgccactaccagcctaactttaggaactgtcgtccacctggcttttattatactgccttaaacatattcacttttttgagactctagaaatttcacaagttttggggtagagcacactgggctttgggtgtgtttctcatgagggcactgacgctgaatggtgcagtgagaaaggacggtagaaaccactgcctttgcttttaccattgaagaaactgaggtcctgtgactttcccgaggtcatcggaatctgccttgcacaggagacttaaaatagttgccagcagataaaagaatgagcaaaaccacatctactccaatttgttaagtctgaaagaaagtaattgaggggggattcctctttggggaaatatttatttcctgcattgaaaatagtttaatgttagtaaacatataaaaagtattttaaattcaagttattctttatttcttatgttacataaggtactgaagttagccaaggttgcttttgtgttataatgatgcagctgctgccaaccagaagtacatttacggtctgtcagtaaagaaaacaaaaactgcctgttggtaaaaatctattagaaaatatttgtcagtaaatttgtcacaatattccagcagaagtt

SEQ ID NO: 408392 - DNA, 1188 bp, Homo sapiens
cttttacccattggcgtgagtatttttcctcagcttccctctttctccgtattctgctcctcctcagtcccatcctccacgctttggaagctactgccttactgcccggagcgccgtcgtccccgaacctcccctgcttctccctttccttctgttccggtttctggtcgtaactcaagagcaaaccaccgtactgcaaaggaaccagatattgtgctcgcggttccaaaccgggcatgggcaccgaatgcttctcgataaatccccttatggtctctgagcattaaagaaagcaagggaggaaaacatgcgcccaagctcgttcgcaggaacatgttcgcgtgtctgcgcctgtgtgcgcagccagttttctggctgaggatcgctcgccaactacagacatcacccgcccaggacccggtgccacactcacccagaagacgaaactccacaggagcgagaagaggagtccatttctccgtcggctcggcacggcacggggatgcaggcccctgattcagtacgttctgtgaaagtggagcgagaagccaagacgtggatcgagaagccccgtggggcgggtctcagggtggcccaaaagacccctgttcacgccactaccagcctaactttaggaactgtcgtccacctggcttttattatactgccttaaacatattcacttttttgagactctagaaatttcacaagttttggggtagagcacactgggctttgggtgtgtttctcatgagggcactgacgctgaatggtgcagtgagaaaggacggtagaaaccactgcctttgcttttaccattgaagaaactgaggtcctgtgactttcccgaggtcatcggaatctgccttgcacaggagacttaaaatagttgccagcagataaaagaatgagcaaaaccacatctactccaatttgttaagtctgaaagaaagtaattgaggggggattcctctttggggaaatatttatttcctgcattgaaaatagtttaatgttagtaaacatataaaaattagccaaggttgcttttgtgttataatgatgcagctgctgccaaccagaagtacatttacggtctgtcagtaaagaaaacaaaaactgcctgttggtaaaaatctattagaaaatatttgtcagtaaatttgtcacaatattccagcagaagtt

SEQ ID NO: 408393 - DNA, 971 bp, Homo sapiens
gtcaggtggaggctttagaccaagttaagcagggtttttaaaacatggtgttaatgtacataatgcagccattctcaaaagtatgacatggggagacccctggaggttttctgagacccttttaaggagtctgccgagtcaaaactatttttgtgatactagtaaaacatttgcttttttcattctgtctctcacaagtgtagagtggaattttccagaggttacatgatgtgtgatatcacaacagattgaatgtagaagcttgtatgaaaatttcatacaaatatattatttgtgttataatgtgcttattgttattttgaaatcaattgttaaatacttttttttttttttttacagtttctcagtttttatttgtattttgggtagatattcgttgatacaacccacatttgggggaatgagtaatctttaaaagtgtaaaagggaccaaaaagtgtgagaatgtttgatgtagagaaactccaagctcattccctggactttggctatagatgctttcttcagggatgggtcttctgggcctgtgtcctgcaggatgcccagtaggaagcacagcctctttgatcttatgggggtgggctcatttgctgttttggagctcaggtgcaaagccgagttacttgatattccctggtcatggcaaagcctctctccacttttcttcccttctattgtcacttccattctttttccatagtccatagaaatcatttttacgtgacagtgatgagctgaccagaagctatagaagctatagtacttcctatatcctaatgggttttaaaaacactggctggggcatactcaccctttctgaacaaaggctgctaggtgaccctgctgttgccgctctgtatattcacttggttagcccacagattggtttggacctaattccctttccttctttaactgcccaaagggcttttctatttaaaaaaaaaaaa

SEQ ID NO: 408394 - DNA, 303 bp, Homo sapiens
caaaaaggaataaagaataagaaatgtgtgggtaaacagatgggcactcactgaatccaataataagagtaaggcaaaaataacagataaatcatgagacagtaatgtaagataacatcttaagattctgtgtttttcaagggaataatgacagcagattttgagaagagaatgtatatgttgtagtttcttgagtaaccactaataggacaggggaaaaagtaatttaattccaaaaataaataaaggcagacaaattgcatgaggaaattatagtaagaagaagaaaagtagaaactaaaa

SEQ ID NO: 408395 - DNA, 187 bp, Homo sapiens
acagagccggcagggatgaacatgtctggcgttctttgcaggagccagatgtttacctatgttagtgggagaatagtggagctcagatgcaagttctcatctgccagactccaaagcccttgccttttctcgatgcgtctatttttttgtaaatgttttagttcagaggtacatgtgcaggtttgtt

SEQ ID NO: 408396 - DNA, 298 bp, Homo sapiens
ttattttttatatggctttaaattattttctgagggtactacataaagaaattgagttgaaaagatttatttaactgccctgaagaaattttgcaaaaaagacagttccattttcacattaattagtatttgaggtttgtttattctcttggtgagagtaccttttttggggagggagtgtggatgttaatgttagaacataagcttaaagtatattcatagattattacaggggttgataatcacttcctatttatttcaacagctaaacattcatggctaactaataattccaaaa

SEQ ID NO: 408397 - DNA, 4308 bp, Homo sapiens
  misc_feature (2544)..(2544): n is a, c, g, or t
  misc_feature (3165)..(3165): n is a, c, g, or t
  misc_feature (3339)..(3339): n is a, c, g, or t
  misc_feature (3756)..(3756): n is a, c, g, or t
cagacaggatattcactgctgtggcaaggcctgtagagagtttcgaagttaggaggactcaagacggtccctccctggacttttctgaaggggctcaaaagatgacacgcgccagagctggaaggcgtcgccaattggtccaacttttccctcctccctttttgcggatgagaaaaactgaggcccaggtttgggatttccagagcccgggatttcccggcaacgccgacaaccacattcccccggctattctgacccgccccggttccgggacgctccctgggagccgccgccgagggcctgctgggactcccggggaccccgccgtcggggcagcccccacgcccggcgccgcccgccggaacggcgccgctgttgcgcacttgcaggggagccggcgactgagggcgaggcagggagggagcaagcggggctgggagggctgctggcgcgggctcgccgcgctgtgtatggtctatcgcaggcagctgacctttgaggaggaaatcgctgctctccgctccttcctgtagtaacagccgccgctgccgccgccgccaggaaccccggccgggagcgagagccgcggggcgcagagccggcccggctgccggacggtgcggccccaccaggtgaacggccatggcgggctggatccaggcccagcagctgcagggagacgcgctgcgccagatgcaggtgctgtacggccagcacttccccatcgaggtccggcactacttggcccagtggattgagagccagccatgggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccagaaaacatatgaccgctgccccctggagctggtccgctgcatccggcacattctgtacaatgaacagaggctggtccgagaagccaacaattgcagctctccggctgggatcctggttgacgccatgtcccagaagcaccttcagatcaaccagacatttgaggagctgcgactggtcacgcaggacacagagaatgagctgaagaaactgcagcagactcaggagtacttcatcatccagtaccaggagagcctgaggatccaagctcagtttgcccagctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacattcatcattgagaagcagcctcctcaggtcctgaagacccagaccaagtttgcagccaccgtacgcctgctggtgggcgggaagctgaacgtgcacatgaatcccccccaggtgaaggccaccatcatcagtgagcagcaggccaagtctctgcttaaaaatgagaacacccgcaacgagtgcagtggtgagatcctgaacaactgctgcgtgatggagtaccaccaagccacgggcaccctcagtgcccacttcaggaacatgtcactgaagaggatcaagcgtgctgaccggcggggtgcagagtccgtgacagaggagaagttcacagtcctgtttgagtctcagttcagtgttggcagcaatgagcttgtgttccaggtgaagactctgtccctacctgtggttgtcatcgtccacggcagccaggaccacaatgccacggctactgtgctgtgggacaatgcctttgctgagccgggcagggtgccatttgccgtgcctgacaaagtgctgtggccgcagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtccgtgtcctggtcccagttcaacagggagaacttgccgggctggaactacaccttctggcagtggtttgacggggtgatggaggtgttgaagaagcaccacaagccccactggaatgatggggccatcctaggttttgtgaataagcaacaggcccacgacctgctcatcaacaagcccgacgggaccttcttgttgcgctttagtgactcagaaatcgggggcatcaccatcgcctggaagtttgantccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctggctaaagctgttgatggatatgtgaaaccacagatcaagcaagtggtccctgagtttgtgaatgcatctgcagatgctgggggcagcagcgccacgtacatggaccaggccccctccccagctgtgtgcccccaggctccctataacatgtacccacagaaccctgaccatgtactcgatcaggatggagaattcgacctggatgagaccatggatgtggccaggcacgtggaggaactcttacgccgaccaatggacagtcttgactcccgcctctcgccccctgccggtcttttcacctctgccagaggctccctctcatgaatgtttgaatcccacgcttctctttggaaacaatatgcaatgtgaagcggtcgtgttgtgagtttagtaaggctgtgtacactgacacctttgcaggcatgcatgtgcttgtgtgtgtgtgtgtgtgtgtgtccttgngcatgagctacgcctgcctcccctgtgccagtcctgggatgtggctgcagcagcggtggccggcctcttttcagatcatggcatccaagagtgcgccgagtctgtctctgtcatggtagagaccgagcctctgtcactgcaggcactcaatgcagccagacctattcctcctgngcccctcatctgctcagcagctatttgaatgagatgattcagaaggggaggggagacaggtaacgtctgtaagctgaagtttcactccggagtgagaagctttgccctcctaagagagagagacagagagacagagagagagaaagagagagtgtgtgggtctatgtaaatgcatctgtcctcatgtgttgatgtaaccgattcatctctcagaagggaggctggggttcattttcgagtagtattttatactttagtgaacgtggactccagactctctgtgaaccctatgagagcgcgtctgggcccggccatgtccttagcacaggggggccgccggtttgagtgagggtttctgagctgctctgaattagtccttgcttggctgcttggccttgggcttcattcaagctctangatgctgttgcccacgtttcccgggatatatattctctcccctccgttgggccccagccttctttgcttgcctctctgtttgtaaccttgtcgacaaagaggtagaaaagattgggtctaggatatggtgggtggacaggggccccgggacttggagggttggtcctcttgcctcctggaaaaaacaaaaacaaaaaactgcagtgaaagacaagctgcaaatcagccatgtgctgcgtgcctgtggaatctggagtgaggggtaaaagctgatctggtttgactccgctggaggtggggcctggagcaggccttgcgctgttgcgtaactggctgtgttctggtgaggccttgctcccaaccccacacgctcctccctctgaggcgtgtaggactcgcagtcaggggcagctgaccatggaagattgagagcccaaggtttaaacttcttctctgaagggaggtggggatgagaagaggggtttttttgtactttgtacaaagaccacacatttgtgtaaacagtgttttggaataaaatatttttttcat

SEQ ID NO: 408398 - DNA, 970 bp, Homo sapiens
cagacaggatattcactgctgtggcaaggcctgtagagagtttcgaagttaggaggactcaagacggtccctccctggacttttctgaaggggctcaaaagatgacacgcgccagagctggaaggcgtcgccaattggtccaacttttccctcctccctttttgcggatgagaaaaactgaggcccaggtttgggatttccagagcccgggatttcccggcaacgccgacaaccacattcccccggctattctgacccgccccggttccgggacgctccctgggagccgccgccgagggcctgctgggactcccggggaccccgccgtcggggcagcccccacgcccggcgccgcccgccggaacggcgccgctgttgcgcacttgcaggggagccggcgactgagggcgaggcagggagggagcaagcggggctgggagggctgctggcgcgggctcgccgcgctgtgtatggtctatcgcaggcagctgacctttgaggaggaaatcgctgctctccgctccttcctgtagtaacagccgccgctgccgccgccgccaggaaccccggccgggagcgagagccgcggggcgcagagccggcccggctgccggacggtgcggccccaccaggtgaacggccatggcgggctggatccaggcccagcagctgcagggagacgcgctgcgccagatgcaggtgctgtacggccagcacttccccatcgaggtccggcactacttggcccagtggattgagagccagccatgggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccagaaaacatatgaccgctggcctacagacatgccgtggatcctct

SEQ ID NO: 408399 - DNA, 3803 bp, Homo sapiens
  misc_feature (2039)..(2039): n is a, c, g, or t
  misc_feature (2660)..(2660): n is a, c, g, or t
  misc_feature (2834)..(2834): n is a, c, g, or t
  misc_feature (3251)..(3251): n is a, c, g, or t
ggacgcgtgggtcgacccacgcgtccggtaacagccgccgctgccgccgccgccaggaaccccggccgggagcgagagccgcggggcgcagagccggcccggctgccggacggtgcggccccaccaggtgaacggccatggcgggctggatccaggcccagcagctgcagggagacgcgctgcgccagatgcaggtgctgtacggccagcacttccccatcgaggtccggcactacttggcccagtggattgagagccagccatgggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccagaaaacatatgaccgctgccccctggagctggtccgctgcatccggcacattctgtacaatgaacagaggctggtccgagaagccaacaattgcagctctccggctgggatcctggttgacgccatgtcccagaagcaccttcagatcaaccagacatttgaggagctgcgactggtcacgcaggacacagagaatgagctgaagaaactgcagcagactcaggagtacttcatcatccagtaccaggagagcctgaggatccaagctcagtttgcccagctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacattcatcattgagaagcagcctcctcaggtcctgaagacccagaccaagtttgcagccaccgtacgcctgctggtgggcgggaagctgaacgtgcacatgaatcccccccaggtgaaggccaccatcatcagtgagcagcaggccaagtctctgcttaaaaatgagaacacccgcaacgagtgcagtggtgagatcctgaacaactgctgcgtgatggagtaccaccaagccacgggcaccctcagtgcccacttcaggaacatgtcactgaagaggatcaagcgtgctgaccggcggggtgcagagtccgtgacagaggagaagttcacagtcctgtttgagtctcagttcagtgttggcagcaatgagcttgtgttccaggtgaagactctgtccctacctgtggttgtcatcgtccacggcagccaggaccacaatgccacggctactgtgctgtgggacaatgcctttgctgagccgggcagggtgccatttgccgtgcctgacaaagtgctgtggccgcagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtccgtgtcctggtcccagttcaacagggagaacttgccgggctggaactacaccttctggcagtggtttgacggggtgatggaggtgttgaagaagcaccacaagccccactggaatgatggggccatcctaggttttgtgaataagcaacaggcccacgacctgctcatcaacaagcccgacgggaccttcttgttgcgctttagtgactcagaaatcgggggcatcaccatcgcctggaagtttgantccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctggctaaagctgttgatggatatgtgaaaccacagatcaagcaagtggtccctgagtttgtgaatgcatctgcagatgctgggggcagcagcgccacgtacatggaccaggccccctccccagctgtgtgcccccaggctccctataacatgtacccacagaaccctgaccatgtactcgatcaggatggagaattcgacctggatgagaccatggatgtggccaggcacgtggaggaactcttacgccgaccaatggacagtcttgactcccgcctctcgccccctgccggtcttttcacctctgccagaggctccctctcatgaatgtttgaatcccacgcttctctttggaaacaatatgcaatgtgaagcggtcgtgttgtgagtttagtaaggctgtgtacactgacacctttgcaggcatgcatgtgcttgtgtgtgtgtgtgtgtgtgtgtccttgngcatgagctacgcctgcctcccctgtgccagtcctgggatgtggctgcagcagcggtggccggcctcttttcagatcatggcatccaagagtgcgccgagtctgtctctgtcatggtagagaccgagcctctgtcactgcaggcactcaatgcagccagacctattcctcctgngcccctcatctgctcagcagctatttgaatgagatgattcagaaggggaggggagacaggtaacgtctgtaagctgaagtttcactccggagtgagaagctttgccctcctaagagagagagacagagagacagagagagagaaagagagagtgtgtgggtctatgtaaatgcatctgtcctcatgtgttgatgtaaccgattcatctctcagaagggaggctggggttcattttcgagtagtattttatactttagtgaacgtggactccagactctctgtgaaccctatgagagcgcgtctgggcccggccatgtccttagcacaggggggccgccggtttgagtgagggtttctgagctgctctgaattagtccttgcttggctgcttggccttgggcttcattcaagctctangatgctgttgcccacgtttcccgggatatatattctctcccctccgttgggccccagccttctttgcttgcctctctgtttgtaaccttgtcgacaaagaggtagaaaagattgggtctaggatatggtgggtggacaggggccccgggacttggagggttggtcctcttgcctcctggaaaaaacaaaaacaaaaaactgcagtgaaagacaagctgcaaatcagccatgtgctgcgtgcctgtggaatctggagtgaggggtaaaagctgatctggtttgactccgctggaggtggggcctggagcaggccttgcgctgttgcgtaactggctgtgttctggtgaggccttgctcccaaccccacacgctcctccctctgaggcgtgtaggactcgcagtcaggggcagctgaccatggaagattgagagcccaaggtttaaacttcttctctgaagggaggtggggatgagaagaggggtttttttgtactttgtacaaagaccacacatttgtgtaaacagtgttttggaataaaatatttttttcat

SEQ ID NO: 408400 - DNA, 2430 bp, Homo sapiens
aaactattactgtgctagtgtacgagtgcccttgtggtggttggttttaaaagtcggccgagggttagtcgtcgccgtctgaggtgttccctggctttgtctcgccgtcgttgccgccccgtccctgccttcgtgccccccgccttggcccctgcccagccgctctccctgtcctcctccccttaaccacccccacggtttctgccgtcggggcccgggggccgggcggatgatgccgtcggagagcggagctgagcgcagggaccgggcggctgctcaggtggggacggctgcggccacggcggtggccacggcagccccggcaggcggcggccccgacccggaggccttatcggccttccccggacggcacctgagtgggctgagctggccacaggtgaagcgactggacgctcttctgagcgagccgattcccattcacgggcgcggcaacttccccacgctgagcgtgcagccccggcagatcgtgcaggtggtccgcagcaccctggaggagcagggactacatgtgcacagtgtgcggctgcatggttcagctgccagccacgtgctgcaccctgagagtggcctgggctacaaggatctggacctggtgttccgggtggacctgcgcagtgaggcatccttccagctgaccaaggcagtggtgctggcctgcctactagacttcctgccggccggtgtgagccgggccaagatcacgccactgacactcaaggaggcatacgtgcagaagctggtgaaagtgtgcacagactcggaccgctggagcctcatctcactgtccaacaagagcggcaagaacgtggagctcaagtttgtggactcggtgagacgccagtttgaattcagcatagactccttccagatcatcctggactccctgttgctctttggccagtgctcgtccactcccatgtctgaggccttccacccaacggtcacaggcgaaagcctgtacggggacttcaccgaggccctggagcacctgcggcaccgtgtcatcgccacgcgcagtcccgaggagatccgaggtggtggcctcctcaagtactgccacctcctggtgcggggcttccggccccggcccagcaccgatgtgcgcgccctgcagcgctacatgtgctcccgcttcttcatcgactttccagacctggtggagcagcggcgcaccctagagcgctacctggaggcccacttcggtggggcagatgcagcccgccgttacgcctgcctggtgacactgcaccgggtggtcaacgagagcaccgtgtgcctcatgaaccacgagcgccgccagacgctggacctcattgccgcactggcgctgcaggcactggctgagcagggcccagctgccactgccgccctggcctggcgccctccaggcactgacggggttgtgccagccactgtcaattactacgtgacccccgtgcaacctctcctggctcacgcctatcccacctggctgccttgtaactgactcagaccctggccagaagggaagggactgggcctcacggggtggggtggggcctccaagagtgtgtggaggacatgaccagaggcgcagaatgtgccaggaggcccagcactgcagggttgggcctttgattgaacagaccagactttcccgagcacgaggcccctgtgggcttaatgccagcctggggctctcagcaggaggaccctttggttattgcatcacacttttggaccagcatgccggtggggtgcaggcgccatttgtcttggaagtcaatttccttcaggagacaaagcaagtttggggtggtagccttaatgcccagcaccttggattgattcccatggtctaagagggtctttttgactaaggccagcctgtggtgatcccagcagctttggagggcctgcagcccacacactgactgatacatggtatgttacagggacttgtcactttggatcaggctgggccactacagggcctgatgggccaacttgggtaatcactgggaggagggaaactgaggcccgaggcagatacctgggtttggggagggctgggtttagcccggttctctgaactacatacccccagctgtgaagccttcctcttgaggggttgaggtgggcagtatacaggagccaagcagcccagggtgggtcgcagcccaggccccttccagggtgccactcctttcccccttgtgttgcaaggagccctcctgcctgggagcttgttctttggaaggtgctgagcctgaatttgccacagtcaagtcaacgttcccaccccactggcttggttacagggctctcacatggggtaggggagccatactcccacccccttgcgtattcccctgggtttgttgatattttgcactcttaacacctgccaataaagacggtctacactga

SEQ ID NO: 408401 - DNA, 406 bp, Homo sapiens
agaaaggaagtgactaacccatatgcaaatggattagagcaggggtccctaacccctgggctgtggacctccacacagtaggaggcaagtggcagcagagcaagcattactgcctgagctccacctgctgtgagatcagcagcagcattagattctcataggagctcgaactcttcattttcatccctaaaccaccctccctaccccccaccccgtcggtggaaaaattgtcttccacgaaactggcctctggtgccaaaaaggttggagaacactggagtagaggaggaatagatggaggccagcttaggaagctattagagtaacctatgcatgactgctgagggtctaagctatattgtaaaagcaaaaggatagaaaatggataaaaagtgatagatatcag

SEQ ID NO: 408402 - DNA, 286 bp, Homo sapiens
cattttcctgggcagcctcggcgagagagagtcgtggaaggtgagttaagcctccggattatactctgccaagcagggactaaaaattcgtatccaacagaattgctaagacagctgaagactgcgattcacgccttcatcccttaaataatgacagctcacaggtattgatcgtgacctaagtaccaggccctgtccagagctttctaaacatgtgaactcccaaagtcagcatcacaaccctgagggcggtgctgcgattattcccgttgtacagaggaggaaa

SEQ ID NO: 408403 - DNA, 299 bp, Homo sapiens
attttctctctactttatgttccatatccttaatatttacttaattacaaaactccaggctctgaaaacataaaatttaaacaagatatagtaccttaaggaggaagacaacatgatcaaattatccactaaatgtcactagtcaataaataataaatatcaaggatctaaggaaaattaagctgtaaattatagcaattaaaaccacggaattaggaatccctaggttccaatcaaaagtgtaatgtgagatgttggccaaatcgtttaacatttctgcttccatattggttgacatt

SEQ ID NO: 408404 - DNA, 1676 bp, Homo sapiens
aaaggcctgggtgttgaatcggcacgaggcacggtccgtctgcagtcggcagcctcgccggcagctcgctcggcccccgcttggcccggcccgcaggtaggagccgccgagggacgcggcgcccggttcccggccccgcctgcgccgcgcgctccccgctcccgccgcccgcttcgagggttctctccccttgccaccatgagcgagtcatttgactgtgcaaaatgcaacgagtccctgtatggacgcaagtacatccagacagacagcggcccctactgtgtgccctgctatgacaatacctttgccaacacctgtgctgagtgccagcagcttatcgggcatgactcgagggagctgttctatgaagaccgccatttccacgagggctgcttccgctgctgccgctgccagcgctcactagccgatgaacccttcacctgccaggacagtgagctgctctgcaatgactgctactgcagtgcgttttcctcgcagtgctccgcttgtggggagactgtcatgcctgggtcccggaagctggaatatggaggccagacatggcatgagcactgcttcctgtgcagtggctgtgaacagccactgggctcccgttcttttgtgcccgacaagggtgctcactactgcgtgccctgctatgagaacaagtttgctcctcgctgcgcccgctgcagcaagacgctgacacagggtggagtgacataccgtgatcagccgtggcatcgagaatgtctggtctgtaccggatgccagacgcccctggcagggcagcagttcacctcccgggatgaagatccctactgtgtggcctgttttggagaactctttgcacctaagtgcagcagctgcaagcgccccatcgtaggactcggtggaggcaagtatgtgtcctttgaagaccgacactggcaccacaactgcttctcctgcgcccgctgctctacctccctggtgggccagggcttcgtaccggatggagaccaagtgctctgccagggctgtagccaggcagggccctaagccagggctcctggacccaggctttcccataccacgggcccaggactgtggctccttttctaaaccacctctgggactcagctccccccgccaaaaaaaatgggtctccttctgggctccaggattgtctccccactccagcatccccaaactggtactccctgacccaggcccccaatcctgggctcttacagagcctccatgagtcaagccccctccccacacctggactccagaattcaccctctcccctgcagtctgggttcccagactgagtcctctccccaaatcagggctctagacccgagccctccaaacctggactctgggacttaggcccccttaaatctagacttctctttataggtttcaggtctcctatgggtgcctgggaagtccttgaaagtggactgttctcaggcttgacctgccccaccccatccccgcggttgaggctgtgggggcagcagatcaggagcccactgataaggggccctagggtacagggtgctgcccagcaggtcgccaccgagtgtcttctcattttatttcagctccattttgcccatagatgggcagaggggtgagattggctcatcccccttccagattctgcaataaagcggtgtgaggaa

SEQ ID NO: 408405 - DNA, 1799 bp, Homo sapiens
  misc_feature (106)..(106): n is a, c, g, or t
gggaggagggggcgggccgatggcggcgaaaggaggtgggtgcggggtctggcccccgcggcgggctggggggccggggtgcggggtccgggcggggcgggcccgngctcacttcctcggggaggggttggggccgcgctcccactcgcccacacggtccgtctgcagtcggcagcctcgccggcagctcgctcggcccccgcttggcccggcccgcaggtaggagccgccgagggacgcggcgcccggttcccggccccgcctgcgccgcgcgctccccgctcccgccgcccgcttcgagggttctctccccttgccaccatgagcgagtcatttgactgtgcaaaatgcaacgagtccctgtatggacgcaagtacatccagacagacagcggcccctactgtgtgccctgctatgacaatacctttgccaacacctgtgctgagtgccagcagcttatcgggcatgactcgagggagctgttctatgaagaccgccatttccacgagggctgcttccgctgctgccgctgccagcgctcactagccgatgaacccttcacctgccaggacagtgagctgctctgcaatgactgctactgcagtgcgttttcctcgcagtgctccgcttgtggggagactgtcatgcctgggtcccggaagctggaatatggaggccagacatggcatgagcactgcttcctgtgcagtggctgtgaacagccactgggctcccgttcttttgtgcccgacaagggtgctcactactgcgtgccctgctatgagaacaagtttgctcctcgctgcgcccgctgcagcaagacgctgacacagggtggagtgacataccgtgatcagccgtggcatcgagaatgtctggtctgtaccggatgccagacgcccctggcagggcagcagttcacctcccgggatgaagatccctactgtgtggcctgttttggagaactctttgcacctaagtgcagcagctgcaagcgccccatcgtaggactcggtggaggcaagtatgtgtcctttgaagaccgacactggcaccacaactgcttctcctgcgcccgctgctctacctccctggtgggccagggcttcgtaccggatggagaccaagtgctctgccagggctgtagccaggcagggccctaagccagggctcctggacccaggctttcccataccacgggcccaggactgtggctccttttctaaaccacctctgggactcagctccccccgccaaaaaaaatgggtctccttctgggctccaggattgtctccccactccagcatccccaaactggtactccctgacccaggcccccaatcctgggctcttacagagcctccatgagtcaagccccctccccacacctggactccagaattcaccctctcccctgcagtctgggttcccagactgagtcctctccccaaatcagggctctagacccgagccctccaaacctggactctgggacttaggcccccttaaatctagacttctctttataggtttcaggtctcctatgggtgcctgggaagtccttgaaagtggactgttctcaggcttgacctgccccaccccatccccgcggttgaggctgtgggggcagcagatcaggagcccactgataaggggccctagggtacagggtgctgcccagcaggtcgccaccgagtgtcttctcattttatttcagctccattttgcccatagatgggcagaggggtgagattggctcatcccccttccagattctgcaataaagcggtgtgaggaa

SEQ ID NO: 408406 - DNA, 2129 bp, Homo sapiens
aaaggcctgggtgttgaatcggcacgaggcacggtccgtctgcagtcggcagcctcgccggcagctcgctcggcccccgcttggcccggcccgcaggtaggagccgccgagggacgcggcgcccggttcccggccccgcctgcgccgcgcgctccccgctcccgccgcccgcttcgagggttctctccccttgccaccatgagcgagtcatttgactgtgcaaaatgcaacgagtccctgtatggacgcaagtacatccagacagacagcggcccctactgtgtgccctgctatgacaatacctttgccaacacctgtgctgagtgccagcagcttatcgggcatgactcgagggagctgttctatgaagaccgccatttccacgagggctgcttccgctgctgccgctgccagcgctcactagccgatgaacccttcacctgccaggacagtgagctgctctgcaatgactgctactgcagtgcgttttcctcgcagtgctccgcttgtggggagactgtcatgcctgggtcccggaagctggaatatggaggccagacatggcatgagcactgcttcctgtgcagtggctgtgaacagccactgggctcccgttcttttgtgcccgacaagggtgctcactactgcgtgccctgctatgagaacaagtttgctcctcgctgcgcccgctgcagcaagacgctgacacagggtggagtgacataccgtgatcagccgtggcatcgagaatgtctggtctgtaccggatgccagacgcccctggcagggcagcagttcacctcccgggatgaagatccctactgtgtggcctgttttggagaactctttgcacctaagtgcagcagctgcaagcgccccatcgtaggactcggtggaggcaagtatgtgtcctttgaagaccgacactggcaccacaactgcttctcctgcgcccgctgctctacctccctggtgggccagggcttcgtaccggatggagaccaagtgctctgccagggctgtagccaggcagggccctaagccagggctcctggacccaggctttcccataccacgggcccaggactgtggctccttttctaaaccacctctgggactcagctccccccgccaaaaaaaatgggtctccttctgggctccaggattgtctccccactccagcatccccaaactggtactccctgacccaggcccccaatcctgggctcttacagagcctccatgagtcaagccccctccccacacctggactccagaattcaccctctcccctgcagtctgggttcccagactgagtcctctccccaaatcagggctctagacccgagccctccaaacctggactctgggacttaggcccccttaaatctagacttctctttataggtttcaggtctcctatgggtgcctgggaagtccttgaaagtggactgttctcaggcttgacctgccccaccccatccccgcggttgaggctgtgggggcagcagatcaggagcccactgataaggggccctagggtacagggtgctgcccagcaggtcgccaccgagtgtcttctcattttatttcagctccattttgcccatagatgggcagaggggtgagattggctcatcccccttccagattctgcaataaagcggtgtgaggaaaaaaaaaaaaaaaaaaaaaaaaaaaaggcaaagagacaaacaaaaccaagagccgatgatagaaacgaacacaagaacaagaccaaaaagaaagaaagacgcgaacacaacaagacaagtcccaccgagcagacgacgacgcacaaactgtacaactcaacacaaggccaacgaacaggaaagacaaggagagcaacaaccgacaagtagggaggaggccaaagcactaaatcagcagagagtaccgcgggcacccaacacaaagaatagacagatgtaggacagagaaggacgagacgaagaagagaagaagaaaggcagcacacgacgcgagagcagccagagagaagaacacaatccaagaagcacaaaaaccgcaacaaagaaaacaaacaaagggagaaagaggaaaaccgacaaagaagtgaggcaagaaacgcgaaagaacaaaaa

SEQ ID NO: 408407 - DNA, 1749 bp, Homo sapiens
  misc_feature (106)..(106): n is a, c, g, or t
gggaggagggggcgggccgatggcggcgaaaggaggtgggtgcggggtctggcccccgcggcgggctggggggccggggtgcggggtccgggcggggcgggcccgngctcacttcctcggggaggggttggggccgcgctcccactcgcccacacggtccgtctgcagtcggcagcctcgccggcagctcgctcggcccccgcttggcccggcccgcaggtaggagccgccgagggacgcggcgcccggttcccggccccgcctgcgccgcgcgctccccgctcccgccgcccgcttcgagggttctctccccttgccaccatgagcgagtcatttgactgtgcaaaatgcaacgagtccctgtatggacgcaagtacatccagacagacagcggcccctactgtgtgccctgctatgacaatacctttgccaacacctgtgctgagtgccagcagcttatcgggcatgactcgagggagctgttctatgaagaccgccatttccacgagggctgcttccgctgctgccctgctctgcaatgactgctactgcagtgcgttttcctcgcagtgctccgcttgtggggagactgtcatgcctgggtcccggaagctggaatatggaggccagacatggcatgagcactgcttcctgtgcagtggctgtgaacagccactgggctcccgttcttttgtgcccgacaagggtgctcactactgcgtgccctgctatgagaacaagtttgctcctcgctgcgcccgctgcagcaagacgctgacacagggtggagtgacataccgtgatcagccgtggcatcgagaatgtctggtctgtaccggatgccagacgcccctggcagggcagcagttcacctcccgggatgaagatccctactgtgtggcctgttttggagaactctttgcacctaagtgcagcagctgcaagcgccccatcgtaggactcggtggaggcaagtatgtgtcctttgaagaccgacactggcaccacaactgcttctcctgcgcccgctgctctacctccctggtgggccagggcttcgtaccggatggagaccaagtgctctgccagggctgtagccaggcagggccctaagccagggctcctggacccaggctttcccataccacgggcccaggactgtggctccttttctaaaccacctctgggactcagctccccccgccaaaaaaaatgggtctccttctgggctccaggattgtctccccactccagcatccccaaactggtactccctgacccaggcccccaatcctgggctcttacagagcctccatgagtcaagccccctccccacacctggactccagaattcaccctctcccctgcagtctgggttcccagactgagtcctctccccaaatcagggctctagacccgagccctccaaacctggactctgggacttaggcccccttaaatctagacttctctttataggtttcaggtctcctatgggtgcctgggaagtccttgaaagtggactgttctcaggcttgacctgccccaccccatccccgcggttgaggctgtgggggcagcagatcaggagcccactgataaggggccctagggtacagggtgctgcccagcaggtcgccaccgagtgtcttctcattttatttcagctccattttgcccatagatgggcagaggggtgagattggctcatcccccttccagattctgcaataaagcggtgtgaggaa

SEQ ID NO: 408408 - DNA, 1629 bp, Homo sapiens
  misc_feature (106)..(106): n is a, c, g, or t
gggaggagggggcgggccgatggcggcgaaaggaggtgggtgcggggtctggcccccgcggcgggctggggggccggggtgcggggtccgggcggggcgggcccgngctcacttcctcggggaggggttggggccgcgctcccactcgcccacacggtccgtctgcagtcggcagcctcgccggcagctcgctcggcccccgcttggcccggcccgcaggtaggagccgccgagggacgcggcgcccggttcccggccccgcctgcgccgcgcgctccccgctcccgccgcccgcttcgagggttctctccccttgccaccatgagcgagtcatttgactgtgcaaaatgcaacgagtccctgtatggacgcaagtacatccagacagacagcggcccctactgtgtgccctgctatgacaatacctttgccaacacctgtgctgagtgccagcagcttatcgggcatgactcgagggagctgttctatgaagaccgccatttccacgagggctgcttccgctgctgccgctgccagcgctcactagccgatgaacccttcacctgccaggacagtgagctgctctgcaatgactgctactgcagtgcgttttcctcgcagtgctccgcttgtggggagactgtcatgcctgacgctgacacagggtggagtgacataccgtgatcagccgtggcatcgagaatgtctggtctgtaccggatgccagacgcccctggcagggcagcagttcacctcccgggatgaagatccctactgtgtggcctgttttggagaactctttgcacctaagtgcagcagctgcaagcgccccatcgtaggactcggtggaggcaagtatgtgtcctttgaagaccgacactggcaccacaactgcttctcctgcgcccgctgctctacctccctggtgggccagggcttcgtaccggatggagaccaagtgctctgccagggctgtagccaggcagggccctaagccagggctcctggacccaggctttcccataccacgggcccaggactgtggctccttttctaaaccacctctgggactcagctccccccgccaaaaaaaatgggtctccttctgggctccaggattgtctccccactccagcatccccaaactggtactccctgacccaggcccccaatcctgggctcttacagagcctccatgagtcaagccccctccccacacctggactccagaattcaccctctcccctgcagtctgggttcccagactgagtcctctccccaaatcagggctctagacccgagccctccaaacctggactctgggacttaggcccccttaaatctagacttctctttataggtttcaggtctcctatgggtgcctgggaagtccttgaaagtggactgttctcaggcttgacctgccccaccccatccccgcggttgaggctgtgggggcagcagatcaggagcccactgataaggggccctagggtacagggtgctgcccagcaggtcgccaccgagtgtcttctcattttatttcagctccattttgcccatagatgggcagaggggtgagattggctcatcccccttccagattctgcaataaagcggtgtgaggaa

SEQ ID NO: 408409 - DNA, 1305 bp, Homo sapiens
  misc_feature (25)..(25): n is a, c, g, or t
ggttacaatcccaaggacaaggacnatggcgggccccctttaccttggttgtttggcccccgtgggcgttaatttgaacccaaaagttaaccccttcgttttgggcccaacacctgtgctgagtgccagcagcttatcgggcatgactcgagggagctgttctatgaagaccgccatttccacgagggctgcttccgctgctgccgctgccagcgctcactagccgatgaacccttcacctgccaggacagtgagctgctctgcaatgactgctactgcagtgcgttttcctcgcagtgctccgcttgtggggagactgtcatgcctgacgctgacacagggtggagtgacataccgtgatcagccgtggcatcgagaatgtctggtctgtaccggatgccagacgcccctggcagggcagcagttcacctcccgggatgaagatccctactgtgtggcctgttttggagaactctttgcacctaagtgcagcagctgcaagcgccccatcgtaggactcggtggaggcaagtatgtgtcctttgaagaccgacactggcaccacaactgcttctcctgcgcccgctgctctacctccctggtgggccagggcttcgtaccggatggagaccaagtgctctgccagggctgtagccaggcagggccctaagccagggctcctggacccaggctttcccataccacgggcccaggactgtggctccttttctaaaccacctctgggactcagctccccccgccaaaaaaaatgggtctccttctgggctccaggattgtctccccactccagcatccccaaactggtactccctgacccaggcccccaatcctgggctcttacagagcctccatgagtcaagccccctccccacacctggactccagaattcaccctctcccctgcagtctgggttcccagactgagtcctctccccaaatcagggctctagacccgagccctccaaacctggactctgggacttaggcccccttaaatctagacttctctttataggtttcaggtctcctatgggtgcctgggaagtccttgaaagtggactgttctcaggcttgacctgccccaccccatccccgcggttgaggctgtgggggcagcagatcaggagcccactgataaggggccctagggtacagggtgctgcccagcaggtcgccaccgagtgtcttctcattttatttcagctccattttgcccatagatgggcagaggggtgagattggctcatcccccttccagattctgcaataaagcggtgtgaggaa

SEQ ID NO: 408410 - DNA, 1285 bp, Homo sapiens
aaaggcctgggtgttgaatcggcacgaggcacggtccgtctgcagtcggcagcctcgccggcagctcgctcggcccccgcttggcccggcccgcaggtaggagccgccgagggacgcggcgcccggttcccggccccgcctgcgccgcgcgctccccgctcccgccgcccgcttcgagggttctctccccttgccaccatgagcgagtcatttgactgtgcaaaatgcaacgagtccctgtatggacgcaagtacatccagacagacagcggcccctactgtgtgccctgctatgacaatacctttgccaacacctgtgctgagtgccagcagcttatcgggcatgactcgagggagctgttctatgaagaccgccatttccacgagggctgcttccgctgctgccgctgccagcgctcactagccgatgaacccttcacctgccaggacagtgagctgctctgcaatgactgctactgcagtgcgttttcctcgcagtgctccgcttgtggggagactgtcatgcctgggtcccggaagctggaatatggaggccagacatggcatgagcactgcttcctgtgcagtggctgtgaacagccactgggctcccgttcttttgtgcccgacaagggtgctcactactgcgtgccctgctatgagaacaagtttgctcctcgctgcgcccgctgcagcaagacgctgacacagggtggagtgacataccgtgatcagccgtggcatcgagaatgtctggtctgtaccggatgccagacgcccctggcagggcagcagttcacctcccgggatgaagatccctactgtgtggcctgttttggagaactctttgcacctaagtgcagcagctgcaagcgccccatcgtaggactcggtggaggcaagtatgtgtcctttgaagaccgacactggcaccacaactgcttctcctgcgcccgctgctctacctccctggtgggccagggcttcgtaccggatggagaccaagtgctctgccagggctgtagccaggcagggccctaagccagggctcctggacccaggctttcccataccacgggcccaggactgtggctccttttctaaaccacctctgggactcagctccccccgccaaaaaaggatccgaattccctcccggtgggttcccaagggggcctcccaaagggtgacacggccaacggagggggggcacaaaaacaaagccacggcggagcgagggggcgggccccccccggggggggacacaacgaaggggggagtaaca

SEQ ID NO: 408411 - DNA, 1326 bp, Homo sapiens
  misc_feature (106)..(106): n is a, c, g, or t
gggaggagggggcgggccgatggcggcgaaaggaggtgggtgcggggtctggcccccgcggcgggctggggggccggggtgcggggtccgggcggggcgggcccgngctcacttcctcggggaggggttggggccgcgctcccactcgcccacacggtccgtctgcagtcggcagcctcgccggcagctcgctcggcccccgcttggcccggcccgcagggttctctccccttgccaccatgagcgagtcatttgactgtgcaaaatgcaacgagtccctgtatggacgcaagtacatccagacagacagcggcccctactgtgtgccctgctatgacaatacctttgccaacacctgtgctgagtgccagcagcttatcgggcatgactcgagggagctgttctatgaagaccgccatttccacgagggctgcttccgctgctgccgctgccagcgctcactagccgatgaacccttcacctgccaggacagtgagctgctctgcaatgactgctactgcagtgcgttttcctcgcagtgctccgcttgtggggagactgtcatgcctgggtcccggaagctggaatatggaggccagacatggcatgagcactgcttcctgtgcagtggctgtgaacagccactgggctcccgttcttttgtgcccgacaagggtgctcactactgcgtgccctgctatgagaacaagtttgctcctcgctgcgcccgctgcagcaagacgctgacacagggtggagtgacataccgtgatcagccgtggcatcgagaatgtctggtctgtaccggatgccagacgcccctggcagggcagcagttcacctcccgggatgaagatccctactgtgtggcctgttttggagaactctttgcacctaagtgcagcagctgcaagcgccccatcgtaggactcggtggaggcaagtatgtgtcctttgaagaccgacactggcaccacaactgcttctcctgcgcccgctgctctacctccctggtgggccagggcttcgtaccggatggagaccaagtgctctgccagggctgtagccaggcagggccctaagccagggctcctggacccaggctttcccataccacgggcccaggactgtggctccttttctaaaccacctctgggactcagctccccccgccaaaaaaggatccgaattccctcccggtgggttcccaagggggcctcccaaagggtgacacggccaacggagggggggcacaaaaacaaagccacggcggagcgagggggcgggccccccccggggggggacacaacgaaggggggagtaaca

SEQ ID NO: 408412 - DNA, 926 bp, Homo sapiens
ccgcttgaaggttgggagagcttgggttctctccccttgccaccatgagcgagtcatttgactgtgcaaaatgcaacgagtccctgtatggacgcaagtacatccagacagacagcggcccctactgtgtgccctgctatgacaatacctttgccaacacctgtgctgagtgccagcagcttatcgggcatgactcgagggagctgttctatgaagaccgccatttccacgagggctgcttccgctgctgccgctgccagcgctcactagccgatgaacccttcacctgccaggacagtgagctgctctgcaatgactgctactgcagtgcgttttcctcgcagtgctccgcttgtggggagactgtcatgcctggtatgtgttcaggggctcatcttgtgtgagaactggcatctgcgtagggtctttgcatgtgtctgtctgatacatggagacttggtctgtgtaaagacctgcatacacagcatgtttctggaaatttagtatatacgggatctgtttgcctggtatactcctgggggctactatgtacaggcagattgacacatgtgatacatacttgggggcttagcatgtgtgaatatctgcatgtttagtacaggtaggaactagaggtgtgctgagactgtcatgcttgttgcattgggtcttaatgtatgcagaagcagataaacagagggcttaacatgtgtggggacctgcatgcctaatagaaatgctgggactcagcacctatggagaatggtgtgccgaggagatgcgagggcttagcatgtaccgaacctgtcatgcccagggcattagaactttgtgtgggcagatacttacttgcctggtacatgtggggtcccatgtgagtgctaaaatcatcacatctgttatatgagggcttagctcttagtgag

SEQ ID NO: 408413 - DNA, 1717 bp, Homo sapiens
  misc_feature (106)..(106): n is a, c, g, or t
gggaggagggggcgggccgatggcggcgaaaggaggtgggtgcggggtctggcccccgcggcgggctggggggccggggtgcggggtccgggcggggcgggcccgngctcacttcctcggggaggggttggggccgcgctcccactcgcccacacggtccgtctgcagtcggcagcctcgccggcagctcgctcggcccccgcttggcccggcccgcagggttctctccccttgccaccatgagcgagtcatttgactgtgcaaaatgcaacgagtccctgtatggacgcaagtacatccagacagacagcggcccctactgtgtgccctgctatgacaatacctttgccaacacctgtgctgagtgccagcagcttatcgggcatgactcgagggagctgttctatgaagaccgccatttccacgagggctgcttccgctgctgccgctgccagcgctcactagccgatgaacccttcacctgccaggacagtgagctgctctgcaatgactgctactgcagtgcgttttcctcgcagtgctccgcttgtggggagactgtcatgcctgggtcccggaagctggaatatggaggccagacatggcatgagcactgcttcctgtgcagtggctgtgaacagccactgggctcccgttcttttgtgcccgacaagggtgctcactactgcgtgccctgctatgagaacaagtttgctcctcgctgcgcccgctgcagcaagacgctgacacagggtggagtgacataccgtgatcagccgtggcatcgagaatgtctggtctgtaccggatgccagacgcccctggcagggcagcagttcacctcccgggatgaagatccctactgtgtggcctgttttggagaactctttgcacctaagtgcagcagctgcaagcgccccatcgtaggactcggtggaggcaagtatgtgtcctttgaagaccgacactggcaccacaactgcttctcctgcgcccgctgctctacctccctggtgggccagggcttcgtaccggatggagaccaagtgctctgccagggctgtagccaggcagggccctaagccagggctcctggacccaggctttcccataccacgggcccaggactgtggctccttttctaaaccacctctgggactcagctccccccgccaaaaaaaatgggtctccttctgggctccaggattgtctccccactccagcatccccaaactggtactccctgacccaggcccccaatcctgggctcttacagagcctccatgagtcaagccccctccccacacctggactccagaattcaccctctcccctgcagtctgggttcccagactgagtcctctccccaaatcagggctctagacccgagccctccaaacctggactctgggacttaggcccccttaaatctagacttctctttataggtttcaggtctcctatgggtgcctgggaagtccttgaaagtggactgttctcaggcttgacctgccccaccccatccccgcggttgaggctgtgggggcagcagatcaggagcccactgataaggggccctagggtacagggtgctgcccagcaggtcgccaccgagtgtcttctcattttatttcagctccattttgcccatagatgggcagaggggtgagattggctcatcccccttccagattctgcaataaagcggtgtgaggaa

SEQ ID NO: 408414 - DNA, 1500 bp, Homo sapiens
aaaggcctgggtgttgaatcggcacgaggcacggtccgtctgcagtcggcagcctcgccggcagctcgctcggcccccgcttggcccggcccgcaggtaggagccgccgagggacgcggcgcccggttcccggccccgcctgcgccgcgcgctccccgctcccgccgcccgcttcgaggagctgttctatgaagaccgccatttccacgagggctgcttccgctgctgccgctgccagcgctcactagccgatgaacccttcacctgccaggacagtgagctgctctgcaatgactgctactgcagtgcgttttcctcgcagtgctccgcttgtggggagactgtcatgcctgggtcccggaagctggaatatggaggccagacatggcatgagcactgcttcctgtgcagtggctgtgaacagccactgggctcccgttcttttgtgcccgacaagggtgctcactactgcgtgccctgctatgagaacaagtttgctcctcgctgcgcccgctgcagcaagacgctgacacagggtggagtgacataccgtgatcagccgtggcatcgagaatgtctggtctgtaccggatgccagacgcccctggcagggcagcagttcacctcccgggatgaagatccctactgtgtggcctgttttggagaactctttgcacctaagtgcagcagctgcaagcgccccatcgtaggactcggtggaggcaagtatgtgtcctttgaagaccgacactggcaccacaactgcttctcctgcgcccgctgctctacctccctggtgggccagggcttcgtaccggatggagaccaagtgctctgccagggctgtagccaggcagggccctaagccagggctcctggacccaggctttcccataccacgggcccaggactgtggctccttttctaaaccacctctgggactcagctccccccgccaaaaaaaatgggtctccttctgggctccaggattgtctccccactccagcatccccaaactggtactccctgacccaggcccccaatcctgggctcttacagagcctccatgagtcaagccccctccccacacctggactccagaattcaccctctcccctgcagtctgggttcccagactgagtcctctccccaaatcagggctctagacccgagccctccaaacctggactctgggacttaggcccccttaaatctagacttctctttataggtttcaggtctcctatgggtgcctgggaagtccttgaaagtggactgttctcaggcttgacctgccccaccccatccccgcggttgaggctgtgggggcagcagatcaggagcccactgataaggggccctagggtacagggtgctgcccagcaggtcgccaccgagtgtcttctcattttatttcagctccattttgcccatagatgggcagaggggtgagattggctcatcccccttccagattctgcaataaagcggtgtgaggaa

SEQ ID NO: 408415 - DNA, 1269 bp, Homo sapiens
catgtgcacggacaccaccctgctcacgctgagagaggagtggagactcctggggaagttacagagggtggccctcaggagcatgggacacaacctctaaatgggacccctgttccccacagggtcccggaagctggaatatggaggccagacatggcatgagcactgcttcctgtgcagtggctgtgaacagccactgggctcccgttcttttgtgcccgacaagggtgctcactactgcgtgccctgctatgagaacaagtttgctcctcgctgcgcccgctgcagcaagacgctgacacagggtggagtgacataccgtgatcagccgtggcatcgagaatgtctggtctgtaccggatgccagacgcccctggcagggcagcagttcacctcccgggatgaagatccctactgtgtggcctgttttggagaactctttgcacctaagtgcagcagctgcaagcgccccatcgtaggactcggtggaggcaagtatgtgtcctttgaagaccgacactggcaccacaactgcttctcctgcgcccgctgctctacctccctggtgggccagggcttcgtaccggatggagaccaagtgctctgccagggctgtagccaggcagggccctaagccagggctcctggacccaggctttcccataccacgggcccaggactgtggctccttttctaaaccacctctgggactcagctccccccgccaaaaaaaatgggtctccttctgggctccaggattgtctccccactccagcatccccaaactggtactccctgacccaggcccccaatcctgggctcttacagagcctccatgagtcaagccccctccccacacctggactccagaattcaccctctcccctgcagtctgggttcccagactgagtcctctccccaaatcagggctctagacccgagccctccaaacctggactctgggacttaggcccccttaaatctagacttctctttataggtttcaggtctcctatgggtgcctgggaagtccttgaaagtggactgttctcaggcttgacctgccccaccccatccccgcggttgaggctgtgggggcagcagatcaggagcccactgataaggggccctagggtacagggtgctgcccagcaggtcgccaccgagtgtcttctcattttatttcagctccattttgcccatagatgggcagaggggtgagattggctcatcccccttccagattctgcaataaagcggtgtgaggaa

SEQ ID NO: 408416 - DNA, 1785 bp, Homo sapiens
aaaggcctgggtgttgaatcggcacgaggcacggtccgtctgcagtcggcagcctcgccggcagctcgctcggcccccgcttggcccggcccgcaggtaggagccgccgagggacgcggcgcccggttcccggccccgcctgcgccgcgcgctccccgctcccgccgcccgcttcgagggttctctccccttgccaccatgagcgagtcatttgactgtgcaaaatgcaacgagtccctgtatggacgcaagtacatccagacagacagcggcccctactgtgtgccctgctatgacaatacctttgccaacacctgtgctgagtgccagcagcttatcgggcatgactcgagggagctgttctatgaagaccgccatttccacgagggctgcttccgctgctgccgctgccagcgctcactagccgatgaacccttcacctgccaggacagtgagctgctctgcaatgactgctactgcagtgcgttttcctcgcagtgctccgcttgtggggagactgtcatgcctgggtcccggaagctggaatatggaggccagacatggcatgagcactgcttcctgtgcagtggctgtgaacagccactgggctcccgttcttttgtgcccgacaagggtgctcactactgcgtgccctgctatgagaacaagtttgctcctcgctgcgcccgctgcagcaagacgctgacacagggtggagtgacataccgtgatcagccgtggcatcgagaatgtctggtctgtaccggatgccagcgctcactagccgatgaacccttcacctgccaggacagtgagctgctctgcaatgactgctactgcagtgcgttttcctcgcagtgctccgcttgtggggagactgtcatgcctgggtcccggaagctggaatatggaggccagacatggcatgagcactgcttcctgttttggagaactctttgcacctaagtgcagcagctgcaagcgccccatcgtaggactcggtggaggcaagtatgtgtcctttgaagaccgacactggcaccacaactgcttctcctgcgcccgctgctctacctccctggtgggccagggcttcgtaccggatggagaccaagtgctctgccagggctgtagccaggcagggccctaagccagggctcctggacccaggctttcccataccacgggcccaggactgtggctccttttctaaaccacctctgggactcagctccccccgccaaaaaaaatgggtctccttctgggctccaggattgtctccccactccagcatccccaaactggtactccctgacccaggcccccaatcctgggctcttacagagcctccatgagtcaagccccctccccacacctggactccagaattcaccctctcccctgcagtctgggttcccagactgagtcctctccccaaatcagggctctagacccgagccctccaaacctggactctgggacttaggcccccttaaatctagacttctctttataggtttcaggtctcctatgggtgcctgggaagtccttgaaagtggactgttctcaggcttgacctgccccaccccatccccgcggttgaggctgtgggggcagcagatcaggagcccactgataaggggccctagggtacagggtgctgcccagcaggtcgccaccgagtgtcttctcattttatttcagctccattttgcccatagatgggcagaggggtgagattggctcatcccccttccagattctgcaataaagcggtgtgaggaa

SEQ ID NO: 408417 - DNA, 1272 bp, Homo sapiens
aaaggcctgggtgttgaatcggcacgaggcacggtccgtctgcagtcggcagcctcgccggcagctcgctcggcccccgcttggcccggcccgcaggtaggagccgccgagggacgcggcgcccggttcccggccccgcctgcgccgcgcgctccccgctcccgccgcccgcttcgagggttctctccccttgccaccatgagcgagtcatttgactgtgcaaaatgcaacgagtccctgtatggacgcaagtacatccagacagacagcggcccctactgtgtgccctgctatgacaatacctttgccaacacctgtgctgagtgccagcagcttatcgggcatgactcgagggagctgttctatgaagaccgccatttccacgagggctgcttccgctgctgccgctgccagcgctcactagccgatgaacccttcacctgccaggacagtgagctgctctgcaatgactgctactgcagtgcgttttcctcgcagtgctccgcttgtggggagactgtcatgcctgggtcccggaagctggaatatggaggccagacatggcatgagcactgcttcctgtgcagtggctgtgaacagccactgggctcccgttcttttgtgcccgacaagggtgctcactactgcgtgccctgctatgagaacaagtttgctcctcgctgcgcccgctgcagcaagacgctgacacagggtggagtgacataccgtgatcagccgtggcatcgagaatgtctggtctgtaccggatgccagacgcccctggcagggcagcagttcacctcccgggatgaagatccctactgtgtggcctgttttggagaactctttgcacctaagtgcagcagctgcaagcgccccatcgtaggactcggtggaggcaagtatgtgtcctttgaagaccgacactggcaccacaactgcttctcctgcgcccgctgctctacctccctggtgggccagggcttcgtaccggatggagaccaagtgctctgccagggctgtagccaggcagggccctaagccagggctcctggacccaggctttcccataccacgggcccaggactgtggctccttttctaaaccacctctgggactcagctccccccgcctagggtacagggtgctgcccagcaggtcgccaccgagtgtcttctcattttatttcagctccattttgcccatagatgggcagaggggtgagattggctcatcccccttccagattctgcaataaagcggtgtgaggaa

SEQ ID NO: 408418 - DNA, 1177 bp, Homo sapiens
agtgcgtcatctagagagcgccggaagcggtccgagaatgaagagtgtgatctaccatgcattgtctcagaaagaggcgaatgactccgatgtccaggtcagttcttggcagggagtccaggagcaacagaggtgatggcaaagatggctcagtagcttctgagcccccagcactgattgagatgtcctttcccacatcatactcctcatttttctggcagacatctaaggctggatcaaagtctgtagttctcattacctgttcccacgtgccagcctccttttctgttgtgccaaagtcaagtttggtaaaatgaggctttccttaaccttttatcatttcccactgtgttggggacaccaggctgtgcccacgtggtgggcagcatcattcaaccttgtcactgtgccctctgcacttctgcagaaggtgtgcaatcacatatcataagtgaaatttacagattatatctgaatgcctcggcctgctttgtcagttttgcaaaagttcctcttgtggctcataatgagagcattaccttgaaagcaagattttgaaagaccagtatacctttattttgcttctccatgaaagatgagccactcaggtatttaagagaatcagatcattgtcctattatagtcacaatgacgagagtgaattaatttttagttagcatctacaggtgcaaagctgaagcagagttcccaccatcatactgtgagctccctcgaaggctatatgtaccctatcttcccatccccattgctctcccacagaaggaaggctgcgttactaatgacagatcagcatcagtctgtcagcctcagtcttagcatttagcacctggctagtgcaaaaagagctcaggaaacagcccagccaggagacaggccctcaggagagagaactgcccaggtctgtggcaggcatgagggcagtggcattgccaccaaatgaggaatccgttattggaactccaacctgagaggtagtgagcttggagggtttctttgtttgtttgtttgtttgtttgtttgtttgagaattgcacacaattacgacagtcatttttcccagaagtcctctctaagagcctgtgctcattcatggtaagttgacgccctgctctcagtgacacccttcagagagagcgagcctggggcctgagatgct

SEQ ID NO: 408419 - DNA, 584 bp, Homo sapiens
  misc_feature (12)..(12): n is a, c, g, or t
ttgagctcggtnccagttcgacggagactctcatcattgtcctattatagtcacaatgacgagagtgaattaatttttagttagcatctacaggtgcaaagctgaagcagagttcccaccatcatactgtgagctccctcgaaggctatatgtaccctatcttcccatccccattgctctcccacagaaggaaggctgcgttactaatgacagatcagcatcagtctgtcagcctcagtcttagcatttagcacctggctagtgcaaaaagagctcaggaaacagcccagccaggagacaggccctcaggagagagaactgcccaggtctgtggcaggcatgagggcagtggcattgccaccaaatgaggaatccgttattggaactccaacctgagaggtagtgagcttggagggtttctttgtttgtttgtttgtttgtttgtttgtttgagaattgcacacaattacgacagtcatttttcccagaagtcctctctaagagcctgtgctcattcatggtaagttgacgccctgctctcagtgacacccttcagagagagcgagcctggggcctgagatgct

SEQ ID NO: 408420 - DNA, 2579 bp, Homo sapiens
agtgcgtcatctagagagcgccggaagcggtccgagaatgaagagtgtgatctaccatgcattgtctcagaaagaggcgaatgactccgatgtccagccttcaggagcacagcgggccgaggccttcgtgagggccttcctgaagcgcagcacgccccgcatgagcccgcaggcccgcgaggaccagctgcagcgcaaggcggtggtcctggagtacttcacccgccacaagcgcaaggagaagaagaagaaagccaaaggcctctctgccaggcaaaggagggagctgcggctctttgacattaaaccagagcagcagagatacagccttttcctccctctccatgaactctggaaacagtacatcagggacctgtgcagtgggctcaagccagacacgcagccacagatgattcaggccaagctcttaaaggcagatcttcacggggctattatttcagtgacaaaatccaaatgcccctcttatgtgggtattacaggaatccttctacaggaaacaaagcacattttcaaaattatcaccaaagaagaccgcctgaaagttatccccaagctaaactgcgtgttcactgtggaaaccgatggctttatttcctacatttacgggagcaaattccagcttcggtcaagtgaacggtctgcgaagaagttcaaagcgaagggaacgattgacctgtgaattctttgccgtctaaggcagttgtttatgacagctgaaaactggacactccctaaatgtccacctttcagtgaagagatagttaagccaattccatttatagaccacctccagccagtgacgctccgagttgaggatgttgaacaacatgggaaggtcgcagcgtactaagtgaagaagtcagaggacagaggaatttctctttctaggagattttcattttgtgtgactcccatggggaggaacagactggcaggaagcacaccggggttaacactggttgacttgaataggattattcgatttttaaaaatacttttccatgttttctgagtgctctatgataaatcagttgcatctgtgataatacaatacatatgtggacataaacagggatcaaataaaggaggtattgctgcagtccagccaggttgaaagggaaggggggtccccaaaggtccattggatggcaggtgtctacagaggcacgcctttgggtggaactctgacccacctaaggtttactttgctatttcaggaaggttgaagaggattgaagggtgagttgctaagtgacttagggtttattcacttcaggaatcatagctggggtggaccccaggagcagagtactgcatgcagctgtgcccatgcatggttgccccagcgtagtgagatgggacctgccgcagcatgcccactcctgagctgccaggctgagccatggaggactgaaaggaggtcgcccggcatcacctcccgaggtgagacctgctgcaaaagccaagccagcagcattgacgccctttgatatcttcgccatttttgctgctgaaagacttggcttttcagtctgaccctggccctctgtgaccatgtgtctgtaaagccagtgggtcaggcccttccatgcagggccagaggaaaagcgggcccagggctgcagtgagagcggggcaggggaccagcctaccagatgggttggaaacatggctcagaaggaccaactaccccttccctttgaggagcaagtctctgccgatcagcaaggcaaggccaggagccctcctggcgaaaggcaggccacaaatctgttctcccccaggagaagtagcagtgccagggctttgcgtttctggtaacttccacccaaaccacaccagagagaaacaccgtagtggagaagggaagtgggagcgctgactgctgtgtgccaggagagtagaaaggcccaggtctgtgccaccacccctccccaaagctcagtgcacccagagtctcacagggaccaacacggtgcctcggtcctgcttccatccatgcaagtgtcctccgctcaccagggtgttctgaggcagctcaagtgctctcccccaagcagcacgcagtcaccgctgccagtgatgaacacacgcacgggctaggcacatggagcccaagcacactgccacctcggacacgggccccggcccagcgactgccttgtggtgtggccgtcctcatctgccacaggaagacagacttcgagggacctcttgcctaaggcctcgctgactcaagggtagaattgagatttggacctaataggctccagaactgtgctttgagctacagggtggctgcaggatgagacggatgcagttcaaagtgcaggatgtgctgcctttattacctgctttcccgctgagcaaatccctgtcttgagtgggaagtggcatctattcccccagccatctgaaaatgctgtgttcataaccaaataggtgctgtagcttcctagccatcccgctcttacccgcccctctgcaatgtaaaaggcgtccactgttgtgtaaatacacagttgctttccagaaaagttgtaggtaccaaaaaccat

SEQ ID NO: 408421 - DNA, 2073 bp, Homo sapiens
agtgcgtcatctagagagcgccggaagcggtccgagaatgaagagtgtgatctaccatgcattgtctcagaaagaggcgaatgactccgatgtccagccttcaggagcacagcgggccgaggccttcgtgagggccttcctgaagcgcagcacgccccgcatgagcccgcaggcccgcgaggaccagctgcagcgcaaggcggtggtcctggagtacttcacccgccacaagcgcaaggagaagaagaagaaagccaaaggcctctctgccaggcaaaggagggagctgcggctctttgacattaaaccagagcagcagagatacagccttttcctccctctccatgaactctggaaacagtacatcagggacctgtgcagtgggctcaagccagacacgcagccacagatgattcaggccaagctcttaaaggcagatcttcacggggctattatttcagtgacaaaatccaaatgcccctcttatgtgggtattacaggaatccttctacaggaaacaaagcacattttcaaaattatcaccaaagaagaccgcctgaaagttatccccaagctaaactgcgtgttcactgtggaaaccgatggctttatttcctacatttacgggagcaaattccagcttcggtcaagtgaacggtctgcgaagaagttcaaagcgaagggaacgattgacctgtgaattctttgccgtctaaggcagttgtttatgacagctgaaaactggacactccctaaatgtccacctttcagtgaagagatagttaagccaattccatttatagaccacctccagccagtgacgctccgagttgaggatgttgaacaacatgggaaggtcgcagcgtactaagtgaagaagtcagaggacagaggaatttctctttctaggagattttcattttgtgtgactcccatggggaggaacagactggcaggaagcacaccggggttaacactggttgacttgaataggattattcgatttttaaaaatacttttccatgttttctgagtgctctatgataaatcagttgcatctgtgataatacaatacatatgtggacataaacagggatcaaataaaggaggtattgctgcagtccagccaggttgaaagggaaggggggtccccaaaggtccattggatggcaggtgtctacagaggcacgcctttgggtggaactctgacccacctaaggtttactttgctatttcaggaaggttgaagaggattgaagggtgagttgctaagtgacttagggtttattcacttcaggaatcatagctggggtggaccccaggagcagagtactgcatgcagctgtgcccatgcatggttgccccagcgtagtgagatgggacctgccgcagcatgcccactcctgagctgccaggctgagccatggaggactgaaaggaggtcgcccggcatcacctcccgaggtgagacctgctgcaaaagccaagccagcagcattgacgccctttgatatcttcgccatttttgctgctgaaagacttggcttttcagtctgaccctggccctctgtgaccatgtgtctgtaaagccagtgggtcaggcccttccatgcagggccagaggaaaagcgggcccagggctgcagtgagagcggggcaggggaccagcgactgccttgtggtgtggccgtcctcatctgccacaggaagacagacttcgagggacctcttgcctaaggcctcgctgactcaagggtagaattgagatttggacctaataggctccagaactgtgctttgagctacagggtggctgcaggatgagacggatgcagttcaaagtgcaggatgtgctgcctttattacctgctttcccgctgagcaaatccctgtcttgagtgggaagtggcatctattcccccagccatctgaaaatgctgtgttcataaccaaataggtgctgtagcttcctagccatcccgctcttacccgcccctctgcaatgtaaaaggcgtccactgttgtgtaaatacacagttgctttccagaaaagttgtaggtaccaaaaaccat

SEQ ID NO: 408422 - DNA, 1626 bp, Homo sapiens
agtgcgtcatctagagagcgccggaagcggtccgagaatgaagagtgtgatctaccatgcattgtctcagaaagaggcgaatgactccgatgtccagccttcaggagcacagcgggccgaggccttcgtgagggccttcctgaagcgcagcacgccccgcatgagcccgcaggcccgcgaggaccagctgcagcgcaaggcggtggtcctggagtacttcacccgccacaagcgcaaggagaagaagaagaaagccaaaggcctctctgccaggcaaaggagggagctgcggctctttgacattaaaccagagcagcagagatacagccttttcctccctctccatgaactctggaaacagtacatcagggacctgtgcagtgggctcaagccagacacgcagccacagatgattcaggccaagctcttaaaggcagatcttcacggggctattatttcagtgacaaaatccaaatgcccctcttatgtgggtattacaggaatccttctacaggaaacaaagcacattttcaaaattatcaccaaagaagaccgcctgaaagttatccccaagctaaactgcgtgttcactgtggaaaccgatggctttatttcctacatttacgggagcaaattccagcttcggtcaagtgaacggtctgcgaagaagttcaaagcgaagggaacgattgacctgtgaattctttgccgtctaaggcagttgtttatgacagctgaaaactggacactccctaaatgtccacctttcagtgaagagatagttaagccaattccatttatagaccacctccagccagtgacgctccgagttgaggatgttgaacaacatgggaaggtcgcagcgtactaagtgaagaagtcagaggacagaggaatttctctttctaggagattttcattttgtgtgactcccatggggaggaacagactggcaggaagcacaccggggttaacactggttgacttgaataggattattcgatttttaaaaatacttttccatgttttctgagtgctctatgataaatcagttgcatctgtgataatacaatacatatgtggacataaacagggatcaaataaaggaggtattgaaaaaaaaaaacaaaaaaaaaaaaaaaacaaaaataacaacataacaaaacacaaaaaaaaaaaaaaaaaagggggggcgccccaaaaatatctcccccgggggggccccattttcggcaccccccatttttcagtcaaagcaagggagcccccacaaaaggagaggccggcataaataagcaagaacagaaggacgagcgcgcagcgcattaaaaacaaaaccctctgctgaagagcaaaaacactaactggattactgggtagatcaacttttgagaagaagacgacccacacacaattagtggagggcggggaataaataatatgtgtgagagcaaacaccctcacctccagcgacgatttaatagaccccccgaaagggggaaaacatacaaacgacctcacggtgagagataattggtgacacacaacacacagcaatattgattcttcgggcgagagacaagtctccccacagaacgttagtttgcgcaaaaatatatcaggggc

SEQ ID NO: 408423 - DNA, 1137 bp, Homo sapiens
agtgcgtcatctagagagcgccggaagcggtccgagaatgaagagtgtgatctaccatgcattgtctcagaaagaggcgaatgactccgatgtccagccttcaggagcacagcgggccgaggccttcgtgagggccttcctgaagcgcagcacgccccgcatgagcccgcaggcccgcgaggaccagctgcagcgcaaggcggtggtcctggagtacttcacccgccacaagcgcaaggagaagaagaagaaagccaaaggcctctctgccaggcaaaggagggagctgcggctctttgacattaaaccagagcagcagagatacagccttttcctccctctccatgaactctggaaacagtacatcagggacctgtgcagtgggctcaagccagacacgcagccacagatgattcaggccaagctcttaaaggcagatcttcacggggctattatttcagtgacaaaatccaaatgcccctcttatgtgggtattacaggaatccttctacaggaaacaaagcacattttcaaaattatcaccaaagaagaccgcctgaaagttatccccaagctaaactgcgtgttcactgtggaaaccgatggctttatttcctacatttacgggagcaaattccagcttcggtcaagtgaacggtctgcgaagaagttcaaagcgaagggaacgattgacctgtgaattctttgccgtctaaggcagttgtttatgacagctgaaaactggacactccctaaatgtccacctttcagtgaagagatagttaagccaattccatttatagaccacctccagccagtgacgctccgagttgaggatgttgaacaacatgggaaggtcgcagcgtactaagtgaagaagtcagaggacagaggaatttctctttctaggagattttcattttgtgtgactcccatggggaggaacagactggcaggaagcacaccggggttaacactggttgacttgaataggattattcgatttttaaaaatacttttccatgttttctgagtgctctatgataaatcagttgcatctgtgataatacaatacatatgtggacataaacagggatcaaataaaggaggtattgtatggggaggttattggcatgc

SEQ ID NO: 408424 - DNA, 2965 bp, Homo sapiens
tttgcttggagatcaacggccaaatagcctcccacgctccagaagacgcttaaagtatgccatgctgttcccggccccactcaggagatcagctgggcctcaggtggagaaggggctgctgcctcccagggtttgcctcccgggtggagcccaggttgggtttgagcttaaggtcctcatttctctaacctaaggctttgtggtaacggattccccacaggatatcaagactggagataatggcccagaagaacgctgttggggtccttgcccctgctccccgcttcttctccccaccacttgcttgcccaccttccagaccagcctgctgcctcacatgaggacctgcgtgacaaccagcaacccctgctttactgggggcttactaggttcaatttcacgtaacagaaaacctcaaaataacagtagcttcaacaagactcacgtttatttctctctcatgaaaagaagtccaggtggacaccgccctgggctggtgtggtcctaccaatgaggaaactgaggttagagaggtgtaggttcttggtctcggttatcagctcaattgctcatcgtcggatttgcacatagttcctaatgatcccaggttgcagttgttggcatcaagtcaagctctgtgctatttggacattgtcatcccaagctcatgttgtctaactttttccctgtttctgactttgctgcagatacagccttttcctccctctccatgaactctggaaacagtacatcagggacctgtgcagtgggctcaagccagacacgcagccacagatgattcaggccaagctcttaaaggcagatcttcacggggctattatttcagtgacaaaatccaaatgcccctcttatgtgggtattacaggaatccttctacaggaaacaaagcacattttcaaaattatcaccaaagaagaccgcctgaaagttatccccaagctaaactgcgtgttcactgtggaaaccgatggctttatttcctacatttacgggagcaaattccagcttcggtcaagtgaacggtctgcgaagaagttcaaagcgaagggaacgattgacctgtgaattctttgccgtctaaggcagttgtttatgacagctgaaaactggacactccctaaatgtccacctttcagtgaagagatagttaagccaattccatttatagaccacctccagccagtgacgctccgagttgaggatgttgaacaacatgggaaggtcgcagcgtactaagtgaagaagtcagaggacagaggaatttctctttctaggagattttcattttgtgtgactcccatggggaggaacagactggcaggaagcacaccggggttaacactggttgacttgaataggattattcgatttttaaaaatacttttccatgttttctgagtgctctatgataaatcagttgcatctgtgataatacaatacatatgtggacataaacagggatcaaataaaggaggtattgctgcagtccagccaggttgaaagggaaggggggtccccaaaggtccattggatggcaggtgtctacagaggcacgcctttgggtggaactctgacccacctaaggtttactttgctatttcaggaaggttgaagaggattgaagggtgagttgctaagtgacttagggtttattcacttcaggaatcatagctggggtggaccccaggagcagagtactgcatgcagctgtgcccatgcatggttgccccagcgtagtgagatgggacctgccgcagcatgcccactcctgagctgccaggctgagccatggaggactgaaaggaggtcgcccggcatcacctcccgaggtgagacctgctgcaaaagccaagccagcagcattgacgccctttgatatcttcgccatttttgctgctgaaagacttggcttttcagtctgaccctggccctctgtgaccatgtgtctgtaaagccagtgggtcaggcccttccatgcagggccagaggaaaagcgggcccagggctgcagtgagagcggggcaggggaccagcctaccagatgggttggaaacatggctcagaaggaccaactaccccttccctttgaggagcaagtctctgccgatcagcaaggcaaggccaggagccctcctggcgaaaggcaggccacaaatctgttctcccccaggagaagtagcagtgccagggctttgcgtttctggtaacttccacccaaaccacaccagagagaaacaccgtagtggagaagggaagtgggagcgctgactgctgtgtgccaggagagtagaaaggcccaggtctgtgccaccacccctccccaaagctcagtgcacccagagtctcacagggaccaacacggtgcctcggtcctgcttccatccatgcaagtgtcctccgctcaccagggtgttctgaggcagctcaagtgctctcccccaagcagcacgcagtcaccgctgccagtgatgaacacacgcacgggctaggcacatggagcccaagcacactgccacctcggacacgggccccggcccagcgactgccttgtggtgtggccgtcctcatctgccacaggaagacagacttcgagggacctcttgcctaaggcctcgctgactcaagggtagaattgagatttggacctaataggctccagaactgtgctttgagctacagggtggctgcaggatgagacggatgcagttcaaagtgcaggatgtgctgcctttattacctgctttcccgctgagcaaatccctgtcttgagtgggaagtggcatctattcccccagccatctgaaaatgctgtgttcataaccaaataggtgctgtagcttcctagccatcccgctcttacccgcccctctgcaatgtaaaaggcgtccactgttgtgtaaatacacagttgctttccagaaaagttgtaggtaccaaaaaccat

SEQ ID NO: 408425 - DNA, 2525 bp, Homo sapiens
agtgcgtcatctagagagcgccggaagcggtccgagaatgaagagtgtgatctaccatgcattgtctcagaaagaggcgaatgactccgatgtccagccttcaggagcacagcgggccgaggccttcgtgagggccttcctgaagcgcagcacgccccgcatgagcccgcaggcccgcgaggaccagctgcagcgcaaggcggtggtcctggagtacttcacccgccacaagcgcaaggagaagaagaagaaagccaaaggcctctctgccaggcaaaggagggagctgcggctctttgacattaaaccagagcagcagagatacagccttttcctccctctccatgaactctggaaacagtacatcagggacctgtgcagtgggctcaagccagacacgcagccacagatgattcaggccaagctcttaaaggcagatcttcacggggctattatttcagtgacaaaatccaaatgcccctcttatgtgggtattacaggaatccttctacaggaaacaaagcacattttcttcactgtggaaaccgatggctttatttcctacatttacgggagcaaattccagcttcggtcaagtgaacggtctgcgaagaagttcaaagcgaagggaacgattgacctgtgaattctttgccgtctaaggcagttgtttatgacagctgaaaactggacactccctaaatgtccacctttcagtgaagagatagttaagccaattccatttatagaccacctccagccagtgacgctccgagttgaggatgttgaacaacatgggaaggtcgcagcgtactaagtgaagaagtcagaggacagaggaatttctctttctaggagattttcattttgtgtgactcccatggggaggaacagactggcaggaagcacaccggggttaacactggttgacttgaataggattattcgatttttaaaaatacttttccatgttttctgagtgctctatgataaatcagttgcatctgtgataatacaatacatatgtggacataaacagggatcaaataaaggaggtattgctgcagtccagccaggttgaaagggaaggggggtccccaaaggtccattggatggcaggtgtctacagaggcacgcctttgggtggaactctgacccacctaaggtttactttgctatttcaggaaggttgaagaggattgaagggtgagttgctaagtgacttagggtttattcacttcaggaatcatagctggggtggaccccaggagcagagtactgcatgcagctgtgcccatgcatggttgccccagcgtagtgagatgggacctgccgcagcatgcccactcctgagctgccaggctgagccatggaggactgaaaggaggtcgcccggcatcacctcccgaggtgagacctgctgcaaaagccaagccagcagcattgacgccctttgatatcttcgccatttttgctgctgaaagacttggcttttcagtctgaccctggccctctgtgaccatgtgtctgtaaagccagtgggtcaggcccttccatgcagggccagaggaaaagcgggcccagggctgcagtgagagcggggcaggggaccagcctaccagatgggttggaaacatggctcagaaggaccaactaccccttccctttgaggagcaagtctctgccgatcagcaaggcaaggccaggagccctcctggcgaaaggcaggccacaaatctgttctcccccaggagaagtagcagtgccagggctttgcgtttctggtaacttccacccaaaccacaccagagagaaacaccgtagtggagaagggaagtgggagcgctgactgctgtgtgccaggagagtagaaaggcccaggtctgtgccaccacccctccccaaagctcagtgcacccagagtctcacagggaccaacacggtgcctcggtcctgcttccatccatgcaagtgtcctccgctcaccagggtgttctgaggcagctcaagtgctctcccccaagcagcacgcagtcaccgctgccagtgatgaacacacgcacgggctaggcacatggagcccaagcacactgccacctcggacacgggccccggcccagcgactgccttgtggtgtggccgtcctcatctgccacaggaagacagacttcgagggacctcttgcctaaggcctcgctgactcaagggtagaattgagatttggacctaataggctccagaactgtgctttgagctacagggtggctgcaggatgagacggatgcagttcaaagtgcaggatgtgctgcctttattacctgctttcccgctgagcaaatccctgtcttgagtgggaagtggcatctattcccccagccatctgaaaatgctgtgttcataaccaaataggtgctgtagcttcctagccatcccgctcttacccgcccctctgcaatgtaaaaggcgtccactgttgtgtaaatacacagttgctttccagaaaagttgtaggtaccaaaaaccat

SEQ ID NO: 408426 - DNA, 1115 bp, Homo sapiens
agtgcgtcatctagagagcgccggaagcggtccgagaatgaagagtgtgatctaccatgcattgtctcagaaagaggcgaatgactccgatgtccagccttcaggagcacagcgggccgaggccttcgtgagggccttcctgaagcgcagcacgccccgcatgagcccgcaggcccgcgaggaccagctgcagcgcaaggcggtggtcctggagtacttcacccgccacaagcgcaaggagaagaagaagaaagccaaaggcctctctgccaggcaaaggagggagctgcggctctttgacattaaaccagagcagcagagatacagccttttcctccctctccatgaactctggaaacagtacatcagggacctgtgcagtgggctcaagccagacacgcagccacagatgattcaggccaagctcttaaaggcagatcttcacggggctattatttcagtgacaaaatccaaatgcccctcttatgtgggtattacaggaatccttctacaggaaacaaagcacattttcaaaattatcaccaaagaagaccgcctgaaagttatccccaagctaaactgcgtgttcactgtggaaaccgatggctttatttcctacatttacgggagcaaattccagcttcggtcaagtgaacggtctgcgaagaagttcaaagcgaagggaacgattgacctgtgaattctttgccgtctaaggcagttgtttatgacagctgaaaactggacactccctaaatgtccacctttcagtgaagagatagttaagccaattccatttatagaccacctccagccagtgacgctccgagttgaggatgttgaacaacatgggaaggtcgcagcgtactaagtgaagaagtcagaggacagaggaatttctctttctaggagattttcattttgtgtgactcccatggggaggaacagactggcaggaagcacaccggggttaacactggttgacttgaataggattattcgatttttaaaaatacttttccatgttttctgagtgctctatgataaatcagttgcatctgtgataatacaatacatatgtggacataaacagggatcaaataaaggaggtattg

SEQ ID NO: 408427 - DNA, 1057 bp, Homo sapiens
agtgcgtcatctagagagcgccggaagcggtccgagaatgaagagtgtgatctaccatgcattgtctcagaaagaggcgaatgactccgatgtccagccttcaggagcacagcgggccgaggccttcgtgagggccttcctgaagcgcagcacgccccgcatgagcccgcaggcccgcgaggaccagctgcagcgcaaggcggtggtcctggagtacttcacccgccacaagcgcaaggagaagaagaagaaagccaaaggcctctctgccaggcaaaggagggagctgcggctctttgacattaaaccagagcagcagagatacagccttttcctccctctccatgaactctggaaacagtacatcagggacctgtgcagtgggctcaagccagacacgcagccacagatgattcaggccaagctcttaaaggcagatcttcacggggctattatttcagtgacaaaatccaaatgcccctcttatgtgggtattacaggaatccttctacaggaaacaaagcacattttcaaaattatcaccaaagaagaccgcctgaaagttatccccaagctaaactgcgtgttcactgtggaaaccgatggctttatttcctacatttacgggagcaaattccagcttcggtcaagtgaacggtctgcgaagaagttcaaagcgaagggaacgattgacctgtgaattctttgccgtctaaggcagttgtttatgacagctgaaaactggacactccctaaatgtccacctttcagtgaagagatagttaagccaattccatttatagaccacctccagccagtgacgctccgagttgaggatgttgaacaacatgggaaggtcgcagcgtactaagtgaagaagtcagaggacagaggaatttctctttctaggagattttcattttgtgtgactcccatggggaggaacagactggcaggaagcacaccggggttaacactggttgacttgaataggattattcgatttttaaaaatacttttccatgttttctgagtgctctatgataaatcagttgca

SEQ ID NO: 408428 - DNA, 2340 bp, Homo sapiens
cccacgcgtccgcggtccgagaatgaagagtgtgatctaccatgcattgtctcagaaagaggcgaatgactccgatgtccagatacagccttttcctccctctccatgaactctggaaacagtacatcagggacctgtgcagtgggctcaagccagacacgcagccacagatgattcaggccaagctcttaaaggcagatcttcacggggctattatttcagtgacaaaatccaaatgcccctcttatgtgggtattacaggaatccttctacaggaaacaaagcacattttcaaaattatcaccaaagaagaccgcctgaaagttatccccaagctaaactgcgtgttcactgtggaaaccgatggctttatttcctacatttacgggagcaaattccagcttcggtcaagtgaacggtctgcgaagaagttcaaagcgaagggaacgattgacctgtgaattctttgccgtctaaggcagttgtttatgacagctgaaaactggacactccctaaatgtccacctttcagtgaagagatagttaagccaattccatttatagaccacctccagccagtgacgctccgagttgaggatgttgaacaacatgggaaggtcgcagcgtactaagtgaagaagtcagaggacagaggaatttctctttctaggagattttcattttgtgtgactcccatggggaggaacagactggcaggaagcacaccggggttaacactggttgacttgaataggattattcgatttttaaaaatacttttccatgttttctgagtgctctatgataaatcagttgcatctgtgataatacaatacatatgtggacataaacagggatcaaataaaggaggtattgctgcagtccagccaggttgaaagggaaggggggtccccaaaggtccattggatggcaggtgtctacagaggcacgcctttgggtggaactctgacccacctaaggtttactttgctatttcaggaaggttgaagaggattgaagggtgagttgctaagtgacttagggtttattcacttcaggaatcatagctggggtggaccccaggagcagagtactgcatgcagctgtgcccatgcatggttgccccagcgtagtgagatgggacctgccgcagcatgcccactcctgagctgccaggctgagccatggaggactgaaaggaggtcgcccggcatcacctcccgaggtgagacctgctgcaaaagccaagccagcagcattgacgccctttgatatcttcgccatttttgctgctgaaagacttggcttttcagtctgaccctggccctctgtgaccatgtgtctgtaaagccagtgggtcaggcccttccatgcagggccagaggaaaagcgggcccagggctgcagtgagagcggggcaggggaccagcctaccagatgggttggaaacatggctcagaaggaccaactaccccttccctttgaggagcaagtctctgccgatcagcaaggcaaggccaggagccctcctggcgaaaggcaggccacaaatctgttctcccccaggagaagtagcagtgccagggctttgcgtttctggtaacttccacccaaaccacaccagagagaaacaccgtagtggagaagggaagtgggagcgctgactgctgtgtgccaggagagtagaaaggcccaggtctgtgccaccacccctccccaaagctcagtgcacccagagtctcacagggaccaacacggtgcctcggtcctgcttccatccatgcaagtgtcctccgctcaccagggtgttctgaggcagctcaagtgctctcccccaagcagcacgcagtcaccgctgccagtgatgaacacacgcacgggctaggcacatggagcccaagcacactgccacctcggacacgggccccggcccagcgactgccttgtggtgtggccgtcctcatctgccacaggaagacagacttcgagggacctcttgcctaaggcctcgctgactcaagggtagaattgagatttggacctaataggctccagaactgtgctttgagctacagggtggctgcaggatgagacggatgcagttcaaagtgcaggatgtgctgcctttattacctgctttcccgctgagcaaatccctgtcttgagtgggaagtggcatctattcccccagccatctgaaaatgctgtgttcataaccaaataggtgctgtagcttcctagccatcccgctcttacccgcccctctgcaatgtaaaaggcgtccactgttgtgtaaatacacagttgctttccagaaaagttgtaggtaccaaaaaccat

SEQ ID NO: 408429 - DNA, 531 bp, Homo sapiens
  misc_feature (22)..(22): n is a, c, g, or t
acgcggaccggcgcgtgaccgntcgagagcgcagaggtcggctgcgagaagacgacagaaggggagacagccctgagatcacctaaaaagctgctaccaagacagccacgaagatcctaccaaaatgaagcgcttcctcttcctcctactcaccatcagcctcctggttatggtacagatacaaactggactctcaggacaaaacgacaccagccaaaccagcagcccctcagcatccagcagcatgagcggaggcattttccttttcttcgtggccaatgccataatccacctcttctgcttcagttgaggtgacacgtctcagccttagccctgtgccccctgaaacagctgccaccatcactcgcaagagaatcccctccatctttgggaggggttgatgccagacatcaccaggttgtagaagttgacaggcagtgccatgggggcaacagccaaaataggggggtaatgatgtaggggccaagcagtgcccagctgggggtcaataaagttacccttgtacttgca

SEQ ID NO: 408430 - DNA, 646 bp, Homo sapiens
  misc_feature (540)..(541): n is a, c, g, or t
  misc_feature (545)..(546): n is a, c, g, or t
  misc_feature (556)..(556): n is a, c, g, or t
  misc_feature (562)..(564): n is a, c, g, or t
  misc_feature (567)..(567): n is a, c, g, or t
  misc_feature (572)..(572): n is a, c, g, or t
  misc_feature (578)..(578): n is a, c, g, or t
  misc_feature (580)..(580): n is a, c, g, or t
  misc_feature (585)..(585): n is a, c, g, or t
  misc_feature (591)..(591): n is a, c, g, or t
  misc_feature (615)..(615): n is a, c, g, or t
cccgcctcctctgcctcctggttcaaaagcagctaaaccaaaagaagcctccagacagcacagccctgagatcacctaaaaagctgctaccaagacagccacgaagatcctaccaaaatgaagcgcttcctcttcctcctactcaccatcagcctcctggttatggtacagatacaaactggactctcaggacaaaacgacaccagccaaaccagcagcccctcagcatccagcagcatgagcggaggcattttccttttcttcgtggccaatgccataatccacctcttctgcttcagttgaggtgacacgtctcagccttagccctgtgccccctgaaacagctgccaccatcactcgcaagagaatcccctccatctttgggaggggttgatgccagacatcaccaggttgtagaagttgacaggcagtgccatgggggcaacagccaaaataggggggtaatgatgtaggggccaagcagtgcccagctgggggtcaataaagttacccttgtacttgcaaaaaaaaaaaaacaannttanncttgcggccnaaattnnngcncactngccaantngcccntatagngaggatatacaataccattgccancggtttaacacgtgcataaatgggaaacccg

SEQ ID NO: 408431 - DNA, 813 bp, Homo sapiens
cagtatatatttcttagtaaatatcacttaagattaaatttttcagaaagaaaattatagcttttttcccaaaatatttttaagatttaatctttttgtagtatgctacagatttaattatattaactcttttttaagacattgaccatgacttaacattttgccttctaacaccttttaaatctatgtactttaatagttaagagaaaataagtttgcagatttttaataatctgtttgtaaaaggctatctctaagcctagtatgtgggtaattttacaggtgtgttttttgataactttaatataaaataaactcattttatttgtggcaaaaaaaaaaaaaaagacagccctgagatcacctaaaaagctgctaccaagacagccacgaagatcctaccaaaatgaagcgcttcctcttcctcctactcaccatcagcctcctggttatggtacagatacaaactggactctcaggacaaaacgacaccagccaaaccagcagcccctcagcatccagcagcatgagcggaggcattttccttttcttcgtggccaatgccataatccacctcttctgcttcagttgaggtgacacgtctcagccttagccctgtgccccctgaaacagctgccaccatcactcgcaagagaatcccctccatctttgggaggggttgatgccagacatcaccaggttgtagaagttgacaggcagtgccatgggggcaacagccaaaataggggggtaatgatgtaggggccaagcagtgcccagctgggggtcaataaagttacccttgtacttgca

SEQ ID NO: 408432 - DNA, 892 bp, Homo sapiens
  misc_feature (22)..(22): n is a, c, g, or t
acgcggaccggcgcgtgaccgntcgagagcgcagaggtcggctgcgagaagacgacagaaggggagacagccctgagatcacctaaaaagctgctaccaagacagccacgaagatcctaccaaaatgaagcgcttcctcttcctcctactcaccatcagcctcctggttatggtacagatacaaactggactctcaggacaaaacgacaccagccaaaccagcagcccctcagcatccagcagcatgagcggaggcattttccttttcttcgtggccaatgccataatccacctcttctgcttcagttgaggtgacacgtctcagccttagccctgtgccccctgaaacagctgccaccatcactcgcaagagaatcccctccatctttgggaggggttgatgccagacatcaccaggttgtagaagttgacaggcagtgccatgggggcaacagccaaaataggggggtaatgatgtaggggccaagcagtgcccagctgggggtcaataaagttacccttgtacttgcaaaaaaaaaaaaaaaacaaaaaaaaaaaaaaaaaaaaaaaaagaaaaaaaaaaaaaaaaaaaaaaaaaaaaaaaaaaggggggcgccccaaaaaaaaacacccccagggggcccccaaactaacaccgcgaaccccatagatgctctgggaacacaaggggggcccccccaatagaggtaacgcgatccaaaattaacaagacgccagaggccaccgaggagacccgaacgaatataaacacgagagcaggcaggcgagaacagggggagaccaacaagcgcgcggcaccgacgtatgaggaacaatgtaggagacaaagagaaaaaccaccaaaataagacgggggggagaagcaaacaag

SEQ ID NO: 408433 - DNA, 524 bp, Homo sapiens
cccgcctcctctgcctcctggttcaaaagcagctaaaccaaaagaagcctccagacagcacagccctgagatcacctaaaaagctgctaccaagacagccacgaagatcctaccaaaatgaagcgcttcctcttcctcctactcaccatcagcctcctggttatggtacagatacaaactggactctcaggacaaaacgacaccagccaaaccagcagcccctcagcatccagcagcatgagcggaggcattttccttttcttcgtggccaatgccataatccacctcttctgcttcagttgaggtgacacgtctcagccttagccctgtgccccctgaaacagctgccaccatcactcgcaagagaatcccctccatctttgggaggggttgatgccagacatcaccaggttgtagaagttgacaggcagtgccatgggggcaacagccaaaataggggggtaatgatgtaggggccaagcagtgcccagctgggggtcaataaagttacccttgtacttgca

SEQ ID NO: 408434 - DNA, 998 bp, Homo sapiens
  misc_feature (22)..(22): n is a, c, g, or t
  misc_feature (573)..(578): n is a, c, g, or t
  misc_feature (582)..(582): n is a, c, g, or t
  misc_feature (584)..(584): n is a, c, g, or t
  misc_feature (586)..(586): n is a, c, g, or t
  misc_feature (589)..(589): n is a, c, g, or t
  misc_feature (591)..(591): n is a, c, g, or t
  misc_feature (628)..(628): n is a, c, g, or t
  misc_feature (639)..(639): n is a, c, g, or t
  misc_feature (646)..(647): n is a, c, g, or t
  misc_feature (649)..(650): n is a, c, g, or t
  misc_feature (662)..(663): n is a, c, g, or t
  misc_feature (665)..(665): n is a, c, g, or t
  misc_feature (667)..(671): n is a, c, g, or t
  misc_feature (673)..(676): n is a, c, g, or t
  misc_feature (679)..(680): n is a, c, g, or t
  misc_feature (707)..(707): n is a, c, g, or t
  misc_feature (714)..(714): n is a, c, g, or t
  misc_feature (723)..(724): n is a, c, g, or t
  misc_feature (740)..(740): n is a, c, g, or t
  misc_feature (763)..(763): n is a, c, g, or t
  misc_feature (768)..(768): n is a, c, g, or t
  misc_feature (786)..(786): n is a, c, g, or t
  misc_feature (804)..(806): n is a, c, g, or t
  misc_feature (808)..(808): n is a, c, g, or t
  misc_feature (812)..(812): n is a, c, g, or t
  misc_feature (814)..(814): n is a, c, g, or t
  misc_feature (816)..(817): n is a, c, g, or t
  misc_feature (819)..(819): n is a, c, g, or t
  misc_feature (826)..(827): n is a, c, g, or t
  misc_feature (829)..(829): n is a, c, g, or t
  misc_feature (839)..(839): n is a, c, g, or t
  misc_feature (855)..(856): n is a, c, g, or t
  misc_feature (862)..(862): n is a, c, g, or t
  misc_feature (869)..(869): n is a, c, g, or t
  misc_feature (871)..(871): n is a, c, g, or t
  misc_feature (874)..(874): n is a, c, g, or t
  misc_feature (877)..(877): n is a, c, g, or t
  misc_feature (883)..(885): n is a, c, g, or t
  misc_feature (889)..(891): n is a, c, g, or t
  misc_feature (893)..(894): n is a, c, g, or t
  misc_feature (896)..(896): n is a, c, g, or t
  misc_feature (920)..(921): n is a, c, g, or t
  misc_feature (925)..(926): n is a, c, g, or t
  misc_feature (931)..(934): n is a, c, g, or t
  misc_feature (937)..(938): n is a, c, g, or t
  misc_feature (986)..(986): n is a, c, g, or t
acgcggaccggcgcgtgaccgntcgagagcgcagaggtcggctgcgagaagacgacagaaggggagacagccctgagatcacctaaaaagctgctaccaagacagccacgaagatcctaccaaaatgaagcgcttcctcttcctcctactcaccatcagcctcctggttatggtacagatacaaactggactctcaggacaaaacgacaccagccaaaccagcagcccctcagcatccagcagcatgagcggaggcattttccttttcttcgtggccaatgccataatccacctcttctgcttcagttgaggtgacacgtctcagccttagccctgtgccccctgaaacagctgccaccatcactcgcaagagaatcccctccatctttgggaggggttgatgccagacatcaccaggttgtagaagttgacaggcagtgccatgggggcaacagccaaaataggggggtaatgatgtaggggccaagcagtgcccagctgggggtcaataaagttacccttgtacttgcaaaaaaaaaaaaaaaacaaaaaaaaaaaaaaagcggaaaaaannnnnntaanananatntnttttttttttttttttttttttttttttttttttttnttttttttttnttttttnntnntttttttttggnngngnnnnntnnnnttnntttttttttttttttttgggggggggnttttttngggggggtnnttttttttttttttgnggggggggggggggggggggggnttttnggggttggggtgtggggntttttttttttttttgtnnntnggtntntnngnggttttnntntttttttttntggttttttttttttnnggggtnggttttntnggntanttggtnnnttgnnntnntnttttttggtttttttttttttttnngggnntttgnnnnttnntgttttttttttttttttttttgtttttttttttttgtgtgttttttngatttttttttt

SEQ ID NO: 408435 - DNA, 854 bp, Homo sapiens
cccgcctcctctgcctcctggttcaaaagcagctaaaccaaaagaagcctccagacagcacagccctgagatcacctaaaaagctgctaccaagacagccacgaagatcctaccaaaatgaagcgcttcctcttcctcctactcaccatcagcctcctggttatggtacagatacaaactggactctcaggacaaaacgacaccagccaaaccagcagcccctcagcatccagcagcatgagcggaggcattttccttttcttcgtggccaatgccataatccacctcttctgcttcagttgaggtgacacgtctcagccttagccctgtgccccctgaaacagctgccaccatcactcgcaagagaatcccctccatctttgggaggggttgatgccagacatcaccaggttgtagaagttgacaggcagtgccatgggggcaacagccaaaataggggggtaatgatgtaggggccaagcagtgcccagctgggggtcaataaagttacccttgtacttgcaaaaaaaaaaagaaaaaaaaaaaaaaaaaaaaaaaaaaaaaaaaaaggggggcgccccaaaaaaaaacacccccagggggcccccaaactaacaccgcgaaccccatagatgctctgggaacacaaggggggcccccccaatagaggtaacgcgatccaaaattaacaagacgccagaggccaccgaggagacccgaacgaatataaacacgagagcaggcaggcgagaacagggggagaccaacaagcgcgcggcaccgacgtatgaggaacaatgtaggagacaaagagaaaaaccaccaaaataagacgggggggagaagcaaacaag

SEQ ID NO: 408436 - DNA, 524 bp, Homo sapiens
attgcaggcagcctgatctcttatcttttttttaagtttagagtctatttaatatccgattaaggaagaaaacaagctacgttctgcatgtttaataacatgccagaataacttgataacatgatttaagccctatttttaacaagataattttcatccattaaaaatggttgtgtattttaaccatggaatactactcagccataaaaaggaatgaaataatggcatttgcagcaaactggatggaattggaggtcattattctaagtgaaggaacttgggaatggaaaaccaaacatcattctcacttataagtggcagccaagctttgaggacacaaaggcataagaatgataatggactctggggacttggggggaaggatgggagtcgggtgaggggtaaaagaatacacattgggtgcagtgtacactgcttgggtgataggcgcaccaaaatctcagaaataaccactaaagaactcacccatgtaaccagacaccacctgttcccccaatactatt

SEQ ID NO: 408437 - DNA, 1045 bp, Homo sapiens
  misc_feature (95)..(96): n is a, c, g, or t
  misc_feature (701)..(701): n is a, c, g, or t
gcactcgccggcgaggctgcacggcgccggtttcattgctaaaatccgacggacttgttgcagaactcgttttttttgtcgggaaagggcttccnngtgtaactttacagcagttatcgtagataagacttgcaaattacagatgtggacggtgagggaacgggaatttcactgaaagcgcctgagaaccagtaagagacctgcaacagctttgtgctccactggcgaatgcttcctcccctaatacacattatgtgtgcttggagacacaaggagtaagatacagcccctcaagggactcgtcatagggagaggacacagctttgggaataaaggggccacaaaggaggagagaggagtttgctgaaacttcccaagctcccattccagcagttcctgaagggtttcccctctcttctaggctggacaatggaggaggcttgaaacagtagctggcaagtggtagaagagatggagcagagaagcaagaagaagcagactcctcactccttcaccagggtggatttgctggtttgaagcagacctgagttgggagaggagagaggcgagaagttttaattggatgaaatatttctttagactggtctatacttttttctttatatctaaaattcactggaagagctatgaaatctgtccaagatttcgttcagttcaggaaaaaccaaaaccaaaaccanaaccaccaggtaatacacatgtgactcagacgccaccaaagaagtatgtgtccaagacctcaagttgaaagctgtggactgcggagggactctctggtgaagttgttgcaagcatgattaattcattggggcagcaatggcagccaagccagtggtggtatcctgtgtccaggagtggtattggtgattcagtttgcagcctctgaggtacaaggataaggaaaatggtgaccagatcagttttgctgcctcagattagacataatttcaagctgtatatctctaatcctcctaataattctatgacctacatgatatcctttaaataaatgacttatcattta

SEQ ID NO: 408438 - DNA, 656 bp, Homo sapiens
  misc_feature (95)..(96): n is a, c, g, or t
gcactcgccggcgaggctgcacggcgccggtttcattgctaaaatccgacggacttgttgcagaactcgttttttttgtcgggaaagggcttccnngtgtaactttacagcagttatcgtagataagacttgcaaattacagatgtggacggtgagggaacgggaatttcactgaaagcgcctgagaaccagtaagagacctgcaacagctttgtgctccactggcgaatgcttcctcccctaatacacattatgtgtgcttggagacacaaggagtaagatacagcccctcaagggactcgtcatagggagaggacacagctttgggaataaaggggccacaaaggaggagagaggagtttgctgaaacttcccaagctcccattccagcagttcctgaaggattcatttctctctgaggatctcatgaggtggcttagcagctagaatctcttccttaacagtgggaagaacaactcctggaaatttaggtcgactttgactggatttaaaagaaagctgtacaattccacttctgtatatacaaccaaaggaaatgagatgtgcatacccatgttcaatgaagcattattcacaatagccaaaatgtggaaccaatccttaaacaaaaggaaaacagaaaatctgctcaaggt

SEQ ID NO: 408439 - DNA, 1027 bp, Homo sapiens
  misc_feature (95)..(96): n is a, c, g, or t
  misc_feature (683)..(683): n is a, c, g, or t
gcactcgccggcgaggctgcacggcgccggtttcattgctaaaatccgacggacttgttgcagaactcgttttttttgtcgggaaagggcttccnngtgtaactttacagcagttatcgtagataagacttgcaaattacagatgtggacggtgagggaacgggaatttcactgaaagcgcctgagaaccagtaagagacctgcaacagctttgtgctccactggcgaatgcttcctcccctaatacacattatgtgtgcttggagacacaaggagtaagatacagcccctcaagggactcgtcatagggagaggacacagctttgggaataaaggggccacaaaggaggagagaggagtttgctgaaacttcccaagctcccattccagcagttcctgaagggctggacaatggaggaggcttgaaacagtagctggcaagtggtagaagagatggagcagagaagcaagaagaagcagactcctcactccttcaccagggtggatttgctggtttgaagcagacctgagttgggagaggagagaggcgagaagttttaattggatgaaatatttctttagactggtctatacttttttctttatatctaaaattcactggaagagctatgaaatctgtccaagatttcgttcagttcaggaaaaaccaaaaccaaaaccanaaccaccaggtaatacacatgtgactcagacgccaccaaagaagtatgtgtccaagacctcaagttgaaagctgtggactgcggagggactctctggtgaagttgttgcaagcatgattaattcattggggcagcaatggcagccaagccagtggtggtatcctgtgtccaggagtggtattggtgattcagtttgcagcctctgaggtacaaggataaggaaaatggtgaccagatcagttttgctgcctcagattagacataatttcaagctgtatatctctaatcctcctaataattctatgacctacatgatatcctttaaataaatgacttatcattta

SEQ ID NO: 408440 - DNA, 732 bp, Homo sapiens
ttaggtaaaactgatgttgccccagggggatagctccctcatcttggatctaggggagcttataacatcttttaaaaggcgaaaattcaagttatctgtggactgtcagaacattttgcataagtcatccccagatgttctacatttcaactccatcaaatattaaattgatgtttatgggctaacctggaaaccgaaaaacagtttgtttcactacaagaataagaaaatatgtccaaattcctgtcagctgacttataaagggacttttagaacacaacccaatgcatgaggtactccttaagccctgacaaccatcttgaagatggaatcatgaatatggccaaattttctacggggctttgaagaaaaggggataaagaacgacaggcctgaggaccagttgagcaaagagaaaaagaaaattcttttctccttctgtgaggtgtgcaacatccagctgaactctgcagcccaggctcaggtgcattccaacggcaaatcccaccgcaaacgagtgaagcagctgagtgatgggcagcccccaccacccgcccaggccagccccagcagcaacagcagcacaggtaaaatacatgagctgtttgtcacctctcgaaatatttgttacacccactgacatacacactggcacacacacatacacacatatgcacaatttgtatatgggtccagagacttcctgtatccccacaatgtgtgaacacttct

SEQ ID NO: 408441 - DNA, 447 bp, Homo sapiens
gtgaggtgtgcaacatccagctgaactctgcagcccaggctcaggtgcattccaacggcaaatcccaccgcaaacgagtgaagcagctgagtgatgggcagcccccaccacccgcccaggccagccccagcagcaacagcagcacaggtaggaggcagggtcccgggttccatgtgctgcggggagagatggtcctggtctggaaaatgaaggatttagaacaagacttaatttttaccttaaaactgggctaccatgataacatgtactctttctcctacaggtaaaatacatgagctgtttgtcacctctcgaaatatttgttacacccactgacatacacactggcacacacacatacacacatatgcacaatttgtatatgggtccagagacttcctgtatccccacaatgtgtgaacacttctgaatgtattttgaaatgtg

SEQ ID NO: 408442 - DNA, 826 bp, Homo sapiens
agttggacagttcaggggccgcgccgggccgagctgtcgcccgcgccacctccaccgccgccgctgctaccgccaccgccaccgcctgggctgcagcagatcgcgggagaacgtctgcgcgaagccccggtgcagccctggcgggaccgcagcaaccaccggagcgtgagcaacagcttcccggctggaggagccactgccccacgcgcccgcggcccgcgcgccgagatgttctacatttcaactccatcaaatattaaattgatgtttatgggctaacctggaaaccgaaaaacagtttgtttcactacaagaataagaaaatatgtccaaattcctgtcagctgacttataaagggacttttagaacacaacccaatgcatgaggtactccttaagccctgacaaccatcttgaagatggaatcatgaatatggccaaattttctacggggctttgaagaaaaggggataaagaacgacaggcctgaggaccagttgagcaaagagaaaaagaaaattcttttctccttctgtgaggtgtgcaacatccagctgaactctgcagcccaggctcaggtgcattccaacggcaaatcccaccgcaaacgagtgaagcagctgagtgatgggcagcccccaccacccgcccaggccagccccagcagcaacagcagcacaggtaaaatacatgagctgtttgtcacctctcgaaatatttgttacacccactgacatacacactggcacacacacatacacacatatgcacaatttgtatatgggtccagagacttcctgtatccccacaatgtgtgaacacttct

SEQ ID NO: 408443 - DNA, 307 bp, Homo sapiens
ccctggcttaatctgctccctatttgctgctatttgtcagctgtttctacctctccagacaactatcatcatcttggccagtcccaattcttcctgcatacattcttggactttctttcatccgagtcaatcatctgttacctctgtgggagtttctaaaggctgccatttccataaattcatgttgggaaaattataaatgtatatttcaaacataaatcaaatttaagttccagaaggcaatacataacccatgagatgaattgtttgataaaagatgaagaaggactgcctagaaggagggggt

SEQ ID NO: 408444 - DNA, 3946 bp, Homo sapiens
accgctccggagcgggaggggaggcttcgcggaacgctctcggcgccaggactcgcgtgcaaagcccaggcccgggcggccagaccaagagggaagaagcacagaattcctcaactcccagtgtgcccatgagtaagagcaaatgctccgtgggactcatgtcttccgtggtggccccggctaaggagcccaatgccgtgggcccgaaggaggtggagctcatccttgtcaaggagcagaacggagtgcagctcaccagctccaccctcaccaacccgcggcagagccccgtggaggcccaggatcgggagacctggggcaagaagatcgactttctcctgtccgtcattggctttgctgtggacctggccaacgtctggcggttcccctacctgtgctacaaaaatggtggcggtgccttcctggtcccctacctgctcttcatggtcattgctgggatgccacttttctacatggagctggccctcggccagttcaacagggaaggggccgctggtgtctggaagatctgccccatactgaaaggtgtgggcttcacggtcatcctcatctcactgtatgtcggcttcttctacaacgtcatcatcgcctgggcgctgcactatctcttctcctccttcaccacggagctcccctggatccactgcaacaactcctggaacagccccaactgctcggatgcccatcctggtgactccagtggagacagctcgggcctcaacgacacttttgggaccacacctgctgccgagtactttgaacgtggcgtgctgcacctccaccagagccatggcatcgacgacctggggcctccgcggtggcagctcacagcctgcctggtgctggtcatcgtgctgctctacttcagcctctggaagggcgtgaagacctcagggaaggtggtatggatcacagccaccatgccatacgtggtcctcactgccctgctcctgcgtggggtcaccctccctggagccatagacggcatcagagcatacctgagcgttgacttctaccggctctgcgaggcgtctgtttggattgacgcggccacccaggtgtgcttctccctgggcgtggggttcggggtgctgatcgccttctccagctacaacaagttcaccaacaactgctacagggacgcgattgtcaccacctccatcaactccctgacgagcttctcctccggcttcgtcgtcttctccttcctggggtacatggcacagaagcacagtgtgcccatcggggacgtggccaaggacgggccagggctgatcttcatcatctacccggaagccatcgccacgctccctctgtcctcagcctgggccgtggtcttcttcatcatgctgctcaccctgggtatcgacagcgccatgggtggtatggagtcagtgatcaccgggctcatcgatgagttccagctgctgcacagacaccgtgagctcttcacgctcttcatcgtcctggcgaccttcctcctgtccctgttctgcgtcaccaacggtggcatctacgtcttcacgctcctggaccattttgcagccggcacgtccatcctctttggagtgctcatcgaagccatcggagtggcctggttctatggtgttgggcagttcagcgacgacatccagcagatgaccgggcagcggcccagcctgtactggcggctgtgctggaagctggtcagcccctgctttctcctgttcgtggtcgtggtcagcattgtgaccttcagacccccccactacggagcctacatcttccccgactgggccaacgcgctgggctgggtcatcgccacatcctccatggccatggtgcccatctatgcggcctacaagttctgcagcctgcctgggtcctttcgagagaaactggcctacgccattgcacccgagaaggaccgtgagctggtggacagaggggaggtgcgccagttcacgctccgccactggctcaaggtgtagagggagcagagacgaagaccccaggaagtcatcctgcaatgggagagacacgaacaaaccaaggaaatctaagtttcgagagaaaggagggcaacttctactcttcaacctctactgaaaacacaaacaacaaagcagaagactcctctcttctgactgtttacacctttccgtgccgggagcgcacctcgccgtgtcttgtgttgctgtaataacgacgtagatctgtgcagcgaggtccaccccgttgttgtccctgcagggcagaaaaacgtctaacttcatgctgtctgtgtgaggctccctccctccctgctccctgctcccggctctgaggctgccccaggggcactgtgttctcaggcggggatcacgatccttgtagacgcacctgctgagaatccccgtgctcacagtagcttcctagaccatttactttgcccatattaaaaagccaagtgtcctgcttggtttagctgtgcagaaggtgaaatggaggaaaccacaaattcatgcaaagtcctttcccgatgcgtggctcccagcagaggccgtaaattgagcgttcagttgacacattgcacacacagtctgttcagaggcattggaggatgggggtcctggtatgtctcaccaggaaattctgtttatgttcttgcagcagagagaaataaaactccttgaaaccagctcaggctactgccactcaggcagcctgtgggtccttgtggtgtagggaacggcctgagaggagcgtgtcctatccccggacgcatgcagggcccccacaggagcgtgtcctatccccggacgcatgcagggcccccacaggagcatgtcctatccctggacgcatgcagggcccccacaggagcgtgtactaccccagaacgcatgcagggcccccacaggagcgtgtactaccccaggacgcatgcagggcccccactggagcgtgtactaccccaggacgcatgcagggcccccacaggagcgtgtcctatccccggaccggacgcatgcagggcccccacaggagcgtgtactaccccaggacgcatgcagggcccccacaggagcgtgtactaccccaggatgcatgcagggcccccacaggagcgtgtactaccccaggacgcatgcagggcccccatgcaggcagcctgcagaccaacactctgcctggccttgagccgtgacctccaggaagggaccccactggaattttatttctctcaggtgcgtgccacatcaataacaacagtttttatgtttgcgaatggctttttaaaatcatatttacctgtgaatcaaaacaaattcaagaatgcagtatccgcgagcctgcttgctgatattgcagtttttgtttacaagaataattagcaatactgagtgaaggatgttggccaaaagctgctttccatggcacactgccctctgccactgacaggaaagtggatgccatagtttgaattcatgcctcaagtcggtgggcctgcctacgtgctgcccgagggcaggggccgtgcagggccagtcatggctgtcccctgcaagtggacgtgggctccagggactggagtgtaatgctcggtgggagccgtcagcctgtgaactgccaggcagctgcagttagcacagaggatggcttccccattgccttctggggagggacacagaggacggcttccccatcgccttctggccgctgcagtcagcacagagagcggcttccccattgccttctggggagggacacagaggacagcttccccatcgccttctggctgctgcagtcagcacagagagcggcttccccatcgccttctggggaggggctccgtgtagcaacccaggtgttgtccgtgtctgttgaccaatctctattcagcatcgtgtgggtccctaagcacaataaaagacatccacaatggaaaaaaaaaaaggaattc

SEQ ID NO: 408445 - DNA, 363 bp, Homo sapiens
atgactggaaaattgcagctgctgcagctcagctggttcctgagacggcgtgtcttgttcttacagggacgcgattgtcaccacctccatcaactccctgacgagcttctcctccggcttcgtcgtcttctccttcctggggtacatggcacagaagcacagtgtgcccatcggggacgtggccaaggacggtgagcccctcctgctgcacctgggcctgctccgtgtagcaccagcgccgagctctcagcaaagcctttttccttgtgaaagaggaaggagacgcatgggccctgagcgacttcagtgagagttgctgcctcactcttgaaggatggtggtacacatcccagtacagacctg

SEQ ID NO: 408446 - DNA, 814 bp, Homo sapiens
agccacaattaaatattttaatataaaaatttgttaataagtttaaaaagttaaaagtgcaaggacaacactttgaggaacggagagtgtggtttctatatggaaaatacctgactaacccaagtatcacatttttgagagaatatatgcatttcttagtaaagaataaccactgaaataacttatttaggttatccttttttgcggggggcgaccataagctttattggctgaaagttctaggagcctggtctgctaggactgggtgttcctggctgatcacccccaggcctaagctcccggtttcgtctggcccttctgtagcatgttgtaggttacaaccaactgatcaaagatgatttttcctggtgcttgctcagaattttgcaacttcttctcttgttcagacaaaggctttgaaaatattctgtaccaagagtacttttttaaaaaattgacctttcatgtgatgaaaaatgaagagaagaaaacgtgttgaagtagacagaaaatgaacacatagaaaacaaaaattaggaataaacaaatgcatttctagatgatggtggataatcatcgaaatcctctaggattaggtattggcttaggatctggttagttagcatattcataaatcagggtttcgcaaacctggttgtaatataagaatttcctagggagctggttaaaaatgtaaaatcttggatcccaccccagggattctgactcagtaggtctggagtgggcccagcaattggtaattttaacagcagttctaaatgcttgtgccgccggtggttcccagaccactctc

SEQ ID NO: 408447 - DNA, 4362 bp, Homo sapiens
ggaaggagcggctcggtgttggggctaggccggtattctaggcccaagcccaggcccaggcctgtgttcccggcccttgctcaaagacaggccggtggccgctgcgacactctaggtacagcggagggcgcagcgggccgttcgctgaggtgtccggacccgccgccgagcgggccgtggagccacagtacgtggcggcgcctcttccttgcccgaagcggaactgctgaaggagcggcagcgcaggccggacgaggtgaaccaggtcatttaaccgccttcaggtgatgaatcatctgtctaataatcagatttgaggtccacagccctttgtggtcctgctacagggtgattttcagtggatgactgactggcgtggcccgaggggtgccgcagtgactgccttcccttgataaggaaacgagctttctgttctttctggacacctcgttacctgtaaaacattccggttataacttctttatccggcttgcatctctgtgcaagaggaaagctttcacatgaaagtgtcccttggtaacggcgaaatgggcgtctctgcccatttgcagccttgtaaggcaggaaccacacgcttttttaccagcaatactcacagttcggtggtattgcaaggctttgatcagcttagaatagaaggattgctttgtgatgtgaccctggtaccaggtgatggagatgaaatcttccctgttcacagagctatgatggcgtctgctagtgattatttcaaagccatgttcacaggtggaatgaaagaacaagatttgatgtgcattaagcttcatggggtgaacaaggttggtctgaagaaaatcattgattttatttatactgcaaaactttctcttaatatggacaatcttcaggacacacttgaagctgctagctttttacaaatattacccgttttggatttctgtaaagtatttcttatatcaggagtctctttggataactgtgttgaggttggacgaattgctaacacctacaatcttatagaagtggataaatatgttaataatttcatcctgaagaactttcctgctttattgagtactggggagtttctaaaactcccttttgaacgacttgcatttgtgctttccagtaatagtcttaagcactgtaccgaacttgaactctttaaggcagcctgtcgctggctaaggttggaagaccctcggatggattatgctgcaaagttaatgaagaatattcgatttccactgatgacaccacaggatctcatcaattacgtgcagacagtagatttcatgagaacagacaatacctgcgtgaatttgcttttggaagctagcaattaccaaatgatgccatatatgcagccagtgatgcagtcagatagaactgccattcgatctgactccactcacttggttacattaggaggagttttgaggcagcagctggttgtcagtaaagaattacggatgtatgatgaaagggcacaagaatggagatctttagccccaatggatgctccccgttaccagcatggtattgctgtcattggaaactttctttatgtagttggtggtcagagtaattatgatacaaaaggaaaaactgctgttgatacagttttcagatttgatcctcggtataataaatggatgcaggttgcatcattaaatgaaaagcgcacattctttcacttgagtgccctcaaaggacatttgtatgcagttggtgggcgcagtgcagctggtgaactggccacagtagaatgttacaacccaagaatgaatgagtggagctatgttgcaaaaatgagtgaaccccactatggtcatgctggaacagtatatggaggcttaatgtatatttcaggaggaattacccatgacactttccaaaatgagctcatgtgttttgacccagatacagataaatggatgcaaaaggctccaatgactacagtcagaggtctgcattgcatgtgtacagttggagataagctctatgtcattggtggcaatcacttcagaggaacaagtgattatgatgatgttctaagctgtgaatactattcaccaacccttgaccagtggaccccaattgccgccatgttaagaggccaaagtgatgttggagttgccgtctttgaaaataaaatctatgttgttggtggatattcttggaataatcgttgtatggtagaaattgtccagaaatatgacccagaaaaagatgagtggcataaagtttttgatcttccagagtcacttggtggcattcgagcctgtacactcacagtttttccacctgaagaaaaccctgggtcaccttctagagaatcacctctttcagcaccttcagatcattcttaggtctaaggtgtaacacctttgcagtacgtcatgggtgatctaatacttccccttcagttgtatcttcttacagtgattggtacagttattagatataaaggtaactgatgttattcgtcttgtatggcttttagtatgtttatcaagtggctaacaaatgcattctgaaaatgtatttaacatagctgttttaacaaatgaaaaaaagacgtagaaaaatgtttagatgtctttttgtgatgttatataaaattgtagatgactgtggtaaatgtgtaattatgtccattatgcttcaaagttgagttttcatctttgactccaaaatgtcagagggaggccgctctaaactaaaaataacgaaaggttgccaagtattaatactagttacctccctcttttcgtagtttttgtcatgtctgtcaacttactcgattgtgtggttgcattcagaatatttgaagtttcttacgtagacagaaataataaaaatattaactaggaaaaaacagtatagcaccaagccagtatttggtatctctctctagagcgagcaagagagggagagaggaggaaaaaatacacataatacaaacatacatgcatgcacacatacatacatatgtatacacacacataatttgaaaactgattggcacttcaacgatgctgaaattgtttttaaattgaagtttctttcttccacaaagcagccgtttctattcaaatggaaattcagtaccagagaataaatgtctatgtagtcatactgaatttagatagataagggctacagcatactaaatcgacaaccaaatttgtcatgtgactaaaccgttacttcagatgaagcttacattactgttttctgcttgtgtattttctgtagagtacttttacacagattggtaaagttcaggtttcagagaactgcttttgtgcagaaaatttaggttcttttttccacctttttggtcagtaaaacttaatgaaaaaagcaaagaaaaaaatattctgaacaaagctatagggttttaagttcagcctcccaacttagtcatcctaacatgattattttgtgatttggggtgcttgccctggtgctgttccagtccatgtgcatcctgagctgtgtgatctgcctcgaggctatgatctgagcaagcaggagataacattttcttctgcatcaagtgaggaaaaatgtgcttttggccatgtctcaaagacaggaccaacttcagattcccaaagaagccagctacagagcctctggaacactatggtcttacaagcagtactaaaatcaaccctcagcctcttcaatgccaaaggtatccctattggttgagaaccacatggtaatttttaatgggacttttatcagcaaatggagttacaggaattctctgtaatgagtgattctgaagaggtactttcctggaataattgtctacctgaagaaaaaaaatttatatatacattgtgtgtgtgtgtaatacacacacacacaaccccctatacctggaagattgtcagcatgtaaatcaggaacaactttctccttattgacaatcccataataaaactcaggaaccaaggcaaaatgaattggcttctaggggtctgaaccttactgcccatacaagtgttgattcattttaatgctgtttatgatttctgcattggcagaaattttcatactttctatgtttttttaattactcagttttttattactaaaaatagcacatttgagtacatttgaaaagtagaaaaattagaaattattaactttattgaataagcaagaagtgcatcctaatcctttgattattaatgaggttgaatatttgtgtgctatcggtagctgtgtttctttgatcagatgttcctgtccttttgcccttctgttatctgttggagttgctttgtttttcgtatcaagttataggatctctttatataataaatgtaatttaacttg

SEQ ID NO: 408448 - DNA, 4697 bp, Homo sapiens
  misc_feature (1723)..(1723): n is a, c, g, or t
tttcataaatcatttgctcctgtcttttgctttaattgtcctatttgctataaatacttttttatactctacttttttattcaatttaatatgatcaagtatgttcgtcttttttgtatgttgacctttcggtgatatttttgttttttttaatttggggtgtgtgtgtgtgtggtggtggtggtggttgttatatagtactgatgtggtattacttgttcttgatactatagctctatagctttgtgattactagttcttgacatgttagggtggcatttactgcttgtctcctgttcaagtagcttttctttctagttaaaatgagaatgagattttccttaaaattaataaacttacctttttatattgagattaatcattcatttttttttgagatggggtctcgctatgctgaccaggctgttcttgaactcctggtctccagtgatcctcctatttcagcctcccaaagggctagaattacaggtgtgagccactgcaactggctatattaagattaatctttattctctatttacagcaagtatttgcccacttgtgttctgtgagcaaagaaatcaagtgtttttcctttgtaacgtagcacaattagtttctttgtcattttaatgctttcttgaataatttttttatcattaggtggcataattatcccagtattttatgttgttattattgatacaactttctaccaaacttttggcataaaatctaatgtatttttcaaattacctaatttttccataaccactttttgaatatcttcatttccttgctgaatttttatgctttaaaaaaaatcataaaatcttatagtcaatcaatttagagtatttttcttcacttccaatgatcttttttcaagttaagttgtctttgatatatacgtgtgtgtgtgtgtgtgtttgtgtatttctgctttgaatgggatttcgttatgttatattctgaactcttggtagaagtaggaaatatgtggttttagcataatggttttctgtctaccgactctcattgattcttcagttttttgggtcaattctcatattttcaccttaactaaccattatctgcatattataaaagccaatttcatattattagtttaatgtgaaacattaaagcatggttcatacttccagcaaaattatagtagtgaccgaggaattgtgtcttatgcgtaattttaataggggtaattctagttttaggattcctttgttacaaggaaatatccttgatcttgttcacgaagttcctcattaattaggagtcttaaaaaattagggttgtgtatcttcattacaaatgatttctgtaccagctgatccaaatttttcttagtaccatccatgggctgaaagaaaggctatttcttcgctgtgtgatcagtgtgtcattaactacccatttcttcatttatttagtcaaatttattgagatgataatttaatttttctcatgtcaaatactgaaaaagagtctgttttttaattgttttcaactgttgggttagaaaggactcttacatattgctgagtgcattgtcaattggtttacagtttagaatgcaatttggcaaaagtagtaaaatgatctttcaagtttcataccttttggacagtaagtatatttctagaattaataagtgacagaaaataggccagaaatagtcatctcagcatgatactattatttncttcctaataggaccacattagaccttccattaaaatacttttaaatggatttttaaagattcttcccaccttaattttgatactttatctgcatcctctagtattcaattgttgagcatatatttgaatggctggatgatgattagaataaaagacttagatattcattaaggatgactgaacacataactgttgaattgtgtacctgagccaaatgcactagtacacagaataggtcgttcctctgtaacagtctcagagcaactgctttccaggggctaatgttattctgccatctactggttaaaattaaaagtctttgtttagctagattacagaaaatatatctcctttatcaaaacaacagtaataacaaaacccagaaatttttatagcacatgtgaaagttcaaagttggcagcttatataaattacataagtgaatattaaaaacttttggtaatttttggggtacggtagatcaaagagaagaattattttttatattacttaaaaatacagatttaaatagctatgacctttattttatttataaattcatatacatttaattttaaaatctgcaacatttcatctggattctaagcattcatacccaatacttgctttttcctttgagtggattccccataccatttttatttttagtttttagcagacagcctcatcacaaagacatgtatagagtaaatcttttccacagcagaaaggacgtaatatgcattatatctggttataagtaaatatgacaacctcataatatttaagaaatttttatattggtttgctcatttgggtatgaggatcaaatcatgactgctatagccacataattttcacccggccagccagacacacatatgcataagcatatacatgtgtttgatgtaaaacagcttttggaccagctgatccagatttttcttagtgccacccatgggctcaaagaaagtctatttcttgactatgtgaacagtaagaatggcatcaactacccatttcctcattctccatgttattgtctcagaacaaaatattctcttacaccaagcattttttccctcaagatggatgtgtataacaacaagtgatctcttaatagtgcctcctgaaggatatcaagagtgcacatatcttttctacatagaactgaaggagcaagattagatttcgtgcaatcttagaacaagatgtgtataaagctgttgacagcaactaagtaacccaaacttcagaagtttcgttgtctagagccccttctccaattgtaagtccaaagagtatgtctagctctttactggtccatcttccaaaagactattacaatacagccttacaatctcttataatggaagtttatcattttttgcctcatttcacccaagtgccagtcaacagagtacatgtttgtatgtggtggggatgggaggcaggtctaacttctactgattcaaacagctttatcttacttagggagtatactttatcacttagaagtcaaaacattcttccagccaggaattagtgatccattaaaacttatttctaattcatgtcaaatcatgaaccaaaacatactcagtataaaaacctaatgtgagtcagtgtaatgtttatttcttcatactaagcagtgtttacttcaattttttattactctctccatctttctccagataagaaaatcacagatttcacaaaacctttcatatatgtatatacacatacttgaagacatcaattaactcaaagattaaggaaaaagagtttttgttttgattttgttttttgttgttgttgttattgtttgttttttgagatagagtttcactcttgtcacccaggctggagtgtagtggtgtgatcctggctcactgcaatctccgcctccccagttcaagcgattctcctgcctcagcctccggagtaactggcattacaggcgcctgccaccacccctggctaatttttgtatttttagtagagacggagtttcaccatgttagccaggctggtctcgaactcctgacctcagatgatccgcctgcctgggcctcccaaaagtgctgggattacaggcgtgagccaccgcccccagccagaaaaacaatttttaattttcaaggctggctctccattaataatctctcccatgccctggactagctatactttatcctgcaaggggaataagttatggattccattggtatgtctactttgttcacttcttgggctgcaatatctacacttcccattcacccttaccacttacttagtagatagtctagccacttgcaacaggttcatggctaccatttgggaatgcctataggagatcaaggagatccattgaaactcagcccccaaatccaaagtcactttccttttgatatctgtagtttcatcatctgtcataaccatgcctacttatcatctgtaaaacaccctttctacattaagggatactcacattatgaattctagttgtggttgttttaaaatatattcacaaattttctcatgctcgtttctttcctccttttgactatgtgttggatttagtgattcccatctaatgaatacaatgaaacaatggtgtttaaattatagactaggtcataaaaaattgtgtacttcctccatgtttatctctcttctatcacttcctctagtacaagccagctgccatgttgtgagcacataccacatagctccatggagatgcccatgtgactgtgatgaagagctaagacttcctgtcagtggccgtgtgagtgacccatgttagaaacagatccgccagcccaaacagaaccttcagacaactgcagccccagctggcatcttgactgcaactcatgagcgattctaagcccaccgaagctgctcttgaattattgattcacaaaaacttttaggtaataaatgtgtgttgttttaaaaaaaaaa

SEQ ID NO: 408449 - DNA, 4672 bp, Homo sapiens
  misc_feature (1723)..(1723): n is a, c, g, or t
tttcataaatcatttgctcctgtcttttgctttaattgtcctatttgctataaatacttttttatactctacttttttattcaatttaatatgatcaagtatgttcgtcttttttgtatgttgacctttcggtgatatttttgttttttttaatttggggtgtgtgtgtgtgtggtggtggtggtggttgttatatagtactgatgtggtattacttgttcttgatactatagctctatagctttgtgattactagttcttgacatgttagggtggcatttactgcttgtctcctgttcaagtagcttttctttctagttaaaatgagaatgagattttccttaaaattaataaacttacctttttatattgagattaatcattcatttttttttgagatggggtctcgctatgctgaccaggctgttcttgaactcctggtctccagtgatcctcctatttcagcctcccaaagggctagaattacaggtgtgagccactgcaactggctatattaagattaatctttattctctatttacagcaagtatttgcccacttgtgttctgtgagcaaagaaatcaagtgtttttcctttgtaacgtagcacaattagtttctttgtcattttaatgctttcttgaataatttttttatcattaggtggcataattatcccagtattttatgttgttattattgatacaactttctaccaaacttttggcataaaatctaatgtatttttcaaattacctaatttttccataaccactttttgaatatcttcatttccttgctgaatttttatgctttaaaaaaaatcataaaatcttatagtcaatcaatttagagtatttttcttcacttccaatgatcttttttcaagttaagttgtctttgatatatacgtgtgtgtgtgtgtgtgtttgtgtatttctgctttgaatgggatttcgttatgttatattctgaactcttggtagaagtaggaaatatgtggttttagcataatggttttctgtctaccgactctcattgattcttcagttttttgggtcaattctcatattttcaccttaactaaccattatctgcatattataaaagccaatttcatattattagtttaatgtgaaacattaaagcatggttcatacttccagcaaaattatagtagtgaccgaggaattgtgtcttatgcgtaattttaataggggtaattctagttttaggattcctttgttacaaggaaatatccttgatcttgttcacgaagttcctcattaattaggagtcttaaaaaattagggttgtgtatcttcattacaaatgatttctgtaccagctgatccaaatttttcttagtaccatccatgggctgaaagaaaggctatttcttcgctgtgtgatcagtgtgtcattaactacccatttcttcatttatttagtcaaatttattgagatgataatttaatttttctcatgtcaaatactgaaaaagagtctgttttttaattgttttcaactgttgggttagaaaggactcttacatattgctgagtgcattgtcaattggtttacagtttagaatgcaatttggcaaaagtagtaaaatgatctttcaagtttcataccttttggacagtaagtatatttctagaattaataagtgacagaaaataggccagaaatagtcatctcagcatgatactattatttncttcctaataggaccacattagaccttccattaaaatacttttaaatggatttttaaagattcttcccaccttaattttgatactttatctgcatcctctagtattcaattgttgagcatatatttgaatggctggatgatgattagaataaaagacttagatattcattaaggatgactgaacacataactgttgaattgtgtacctgagccaaatgcactagtacacagaataggtcgttcctctgtaacagtctcagagcaactgctttccaggggctaatgttattctgccatctactggttaaaattaaaagtctttgtttagctagattacagaaaatatatctcctttatcaaaacaacagtaataacaaaacccagaaatttttatagcacatgtgaaagttcaaagttggcagcttatataaattacataagtgaatattaaaaacttttggtaatttttggggtacggtagatcaaagagaagaattattttttatattacttaaaaatacagatttaaatagctatgacctttattttatttataaattcatatacatttaattttaaaatctgcaacatttcatctggattctaagcattcatacccaatacttgctttttcctttgagtggattccccataccatttttatttttagtttttagcagacagcctcatcacaaagacatgtatagagtaaatcttttccacagcagaaaggacgtaatatgcattatatctggttataagtaaatatgacaacctcataatatttaagaaatttttatattggtttgctcatttgggtatgaggatcaaatcatgactgctatagccacataattttcacccggccagccagacacacatatgcataagcatatacatgtgtttgatgtaaaacagcttttggaccagctgatccagatttttcttagtgccacccatgggctcaaagaaagtctatttcttgactatgtgaacagtaagaatggcatcaactacccatttcctcattctccatgttattgtctcagaacaaaatattctcttacaccaagcattttttccctcaagatggatgtgtataacaacaagtgatctcttaatagtgcctcctgaaggatatcaagagtgcacatatcttttctacatagaactgaaggagcaagattagatttcgtgcaatcttagaacaagatgtgtataaagctgttgacagcaactaagtaacccaaacttcagaagtttcgttgtctagagccccttctccaattgtaagtccaaagagtatgtctagctctttactggtccatcttccaaaagactattacaatacagccttacaatctcttataatggaagtttatcattttttgcctcatttcacccaagtgccagtcaacagagtacatgtttgtatgtggtggggatgggaggcaggtctaacttctactgattcaaacagctttatcttacttagggagtatactttatcacttagaagtcaaaacattcttccagccaggaattagtgatccattaaaacttatttctaattcatgtcaaatcatgaaccaaaacatactcagtataaaaacctaatgtgagtcagtgtaatgtttatttcttcatactaagcagtgtttacttcaattttttattactctctccatctttctccagataagaaaatcacagatttcacaaaacctttcatatatgtatatacacatacttgaagacatcaattaactcaaagattaaggaaaaagagtttttgttttgttgtttgttttttgagatagagtttcactcttgtcacccaggctggagtgtagtggtgtgatcctggctcactgcaatctccgcctccccagttcaagcgattctcctgcctcagcctccggagtaactggcattacaggcgcctgccaccacccctggctaatttttgtatttttagtagagacggagtttcaccatgttagccaggctggtctcgaactcctgacctcagatgatccgcctgcctgggcctcccaaaagtgctgggattacaggcgtgagccaccgcccccagccagaaaaacaatttttaattttcaaggctggctctccattaataatctctcccatgccctggactagctatactttatcctgcaaggggaataagttatggattccattggtatgtctactttgttcacttcttgggctgcaatatctacacttcccattcacccttaccacttacttagtagatagtctagccacttgcaacaggttcatggctaccatttgggaatgcctataggagatcaaggagatccattgaaactcagcccccaaatccaaagtcactttccttttgatatctgtagtttcatcatctgtcataaccatgcctacttatcatctgtaaaacaccctttctacattaagggatactcacattatgaattctagttgtggttgttttaaaatatattcacaaattttctcatgctcgtttctttcctccttttgactatgtgttggatttagtgattcccatctaatgaatacaatgaaacaatggtgtttaaattatagactaggtcataaaaaattgtgtacttcctccatgtttatctctcttctatcacttcctctagtacaagccagctgccatgttgtgagcacataccacatagctccatggagatgcccatgtgactgtgatgaagagctaagacttcctgtcagtggccgtgtgagtgacccatgttagaaacagatccgccagcccaaacagaaccttcagacaactgcagccccagctggcatcttgactgcaactcatgagcgattctaagcccaccgaagctgctcttgaattattgattcacaaaaacttttaggtaataaatgtgtgttgttttaaaaaaaaaa

SEQ ID NO: 408450 - DNA, 407 bp, Homo sapiens
cgattctcccacctcagcctcccgattagctgggattacaggcagtaagctcctacaggacattttaaaactacataaatgtgccatccccagctcaaccgattataaacaactgccgaaagattgtgggtacaagccagctgccatgttgtgagcacataccacatagctccatggagatgcccatgtgactgtgatgaagagctaagacttcctgtcagtggccgtgtgagtgacccatgttagaaacagatccgccagcccaaacagaaccttcagacaactgcagccccagctggcatcttgactgcaactcatgagcgattctaagcccaccgaagctgctcttgaattattgattcacaaaaacttttaggtaataaatgtgtgttgttttaaaaaaaaaa

SEQ ID NO: 408451 - DNA, 4308 bp, Homo sapiens
ggaaggagcggctcggtgttggggctaggccggtattctaggcccaagcccaggcccaggcctgtgttcccggcccttgctcaaagacaggccggtggccgctgcgacactctaggtacagcggagggcgcagcgggccgttcgctgaggtgtccggacccgccgccgagcgggccgtggagccacagtacgtggcggcgcctcttccttgcccgaagcggaactgctgaaggagcggcagcgcaggccggacgaggtgaaccaggtcatttaaccgccttcaggtgatgaatcatctgtctaataatcagatttgaggtccacagccctttgtggtcctgctacagggtgattttcagtggatgactgactggcgtggcccgaggggtgccgcagtgactgccttcccttgataaggaaacgagctttctgttctttctggacacctcgttacctgtaaaacattccggttataacttctttatccggcttgcatctctgtgcaagaggaaagctttcacatgaaagtgtcccttggtaacggcgaaatgggcgtctctgcccatttgcagccttgtaaggcaggaaccacacgcttttttaccagcaatactcacagttcggtggtattgcaaggctttgatcagcttagaatagaaggattgctttgtgatgtgaccctggtaccaggtgatggagatgaaatcttccctgttcacagagctatgatggcgtctgctagtgattatttcaaagccatgttcacaggtggaatgaaagaacaagatttgatgtgcattaagcttcatggggtgaacaaggttggtctgaagaaaatcattgattttatttatactgcaaaactttctcttaatatggacaatcttcaggacacacttgaagctgctagctttttacaaatattacccgttttggatttctgtaaagtatttcttatatcaggagtctctttggataactgtgttgaggttggacgaattgctaacacctacaatcttatagaagtggataaatatgttaataatttcatcctgaagaactttcctgctttattgagtactggggagtttctaaaactcccttttgaacgacttgcatttgtgctttccagtaatagtcttaagcactgtaccgaacttgaactctttaaggcagcctgtcgctggctaaggttggaagaccctcggatggattatgctgcaaagttaatgaagaatattcgatttccactgatgacaccacaggatctcatcaattacgtgcagacagtagatttcatgagaacagacaatacctgcgtgaatttgcttttggaagctagcaattaccaaatgatgccatatatgcagccagtgatgcagtcagatagaactgccattcgatctgactccactcacttggttacattaggaggagttttgaggcagcagctggttgtcagtaaagaattacggatgtatgatgaaagggcacaagaatggagatctttagccccaatggatgctccccgttaccagcatggtattgctgtcattggaaactttctttatgtagttggtggtcagagtaattatgatacaaaaggaaaaactgctgttgatacagttttcagatttgatcctcggtataataaatggatgcaggttgcatcattaaatgaaaagcgcacattctttcacttgagtgccctcaaaggacatttgtatgcagttggtgggcgcagtgcagctggtgaactggccacagtagaatgttacaacccaagaatgaatgagtggagctatgttgcaaaaatgagtgaaccccactatggtcatgctggaacagtatatggaggcttaatgtatatttcaggaggaattacccatgacactttccaaaatgagctcatgtgttttgacccagatacagataaatggatgcaaaaggctccaatgactacagtcagaggtctgcattgcatgtgtacagttggagataagctctatgtcattggtggcaatcacttcagaggaacaagtgattatgatgatgttctaagctgtgaatactattcaccaacccttgaccagtggaccccaattgccgccatgttaagaggccaaagtgatgttggagttgccgtctttgaaaataaaatctatgttgttggtggatattcttggaataatcgttgtatggtagaaattgtccagaaatatgacccagaaaaagatgagtggcataaagtttttgatcttccagagtcacttggtggcattcgagcctgtacactcacagtttttccacctgaagcttaggtctaaggtgtaacacctttgcagtacgtcatgggtgatctaatacttccccttcagttgtatcttcttacagtgattggtacagttattagatataaaggtaactgatgttattcgtcttgtatggcttttagtatgtttatcaagtggctaacaaatgcattctgaaaatgtatttaacatagctgttttaacaaatgaaaaaaagacgtagaaaaatgtttagatgtctttttgtgatgttatataaaattgtagatgactgtggtaaatgtgtaattatgtccattatgcttcaaagttgagttttcatctttgactccaaaatgtcagagggaggccgctctaaactaaaaataacgaaaggttgccaagtattaatactagttacctccctcttttcgtagtttttgtcatgtctgtcaacttactcgattgtgtggttgcattcagaatatttgaagtttcttacgtagacagaaataataaaaatattaactaggaaaaaacagtatagcaccaagccagtatttggtatctctctctagagcgagcaagagagggagagaggaggaaaaaatacacataatacaaacatacatgcatgcacacatacatacatatgtatacacacacataatttgaaaactgattggcacttcaacgatgctgaaattgtttttaaattgaagtttctttcttccacaaagcagccgtttctattcaaatggaaattcagtaccagagaataaatgtctatgtagtcatactgaatttagatagataagggctacagcatactaaatcgacaaccaaatttgtcatgtgactaaaccgttacttcagatgaagcttacattactgttttctgcttgtgtattttctgtagagtacttttacacagattggtaaagttcaggtttcagagaactgcttttgtgcagaaaatttaggttcttttttccacctttttggtcagtaaaacttaatgaaaaaagcaaagaaaaaaatattctgaacaaagctatagggttttaagttcagcctcccaacttagtcatcctaacatgattattttgtgatttggggtgcttgccctggtgctgttccagtccatgtgcatcctgagctgtgtgatctgcctcgaggctatgatctgagcaagcaggagataacattttcttctgcatcaagtgaggaaaaatgtgcttttggccatgtctcaaagacaggaccaacttcagattcccaaagaagccagctacagagcctctggaacactatggtcttacaagcagtactaaaatcaaccctcagcctcttcaatgccaaaggtatccctattggttgagaaccacatggtaatttttaatgggacttttatcagcaaatggagttacaggaattctctgtaatgagtgattctgaagaggtactttcctggaataattgtctacctgaagaaaaaaaatttatatatacattgtgtgtgtgtgtaatacacacacacacaaccccctatacctggaagattgtcagcatgtaaatcaggaacaactttctccttattgacaatcccataataaaactcaggaaccaaggcaaaatgaattggcttctaggggtctgaaccttactgcccatacaagtgttgattcattttaatgctgtttatgatttctgcattggcagaaattttcatactttctatgtttttttaattactcagttttttattactaaaaatagcacatttgagtacatttgaaaagtagaaaaattagaaattattaactttattgaataagcaagaagtgcatcctaatcctttgattattaatgaggttgaatatttgtgtgctatcggtagctgtgtttctttgatcagatgttcctgtccttttgcccttctgttatctgttggagttgctttgtttttcgtatcaagttataggatctctttatataataaatgtaatttaacttg

SEQ ID NO: 408452 - DNA, 2128 bp, Homo sapiens
gtgatctcgaggatccctggacatttccacgagtcacttggtggcattcgagcctgtacactcacagtttttccacctgaagaaaaccctgggtcaccttctagagaatcacctctttcagcaccttcagatcattcttaggtctaaggtgtaacacctttgcagtacgtcatgggtgatctaatacttccccttcagttgtatcttcttacagtgattggtacagttattagatataaaggtaactgatgttattcgtcttgtatggcttttagtatgtttatcaagtggctaacaaatgcattctgaaaatgtatttaacatagctgttttaacaaatgaaaaaaagacgtagaaaaatgtttagatgtctttttgtgatgttatataaaattgtagatgactgtggtaaatgtgtaattatgtccattatgcttcaaagttgagttttcatctttgactccaaaatgtcagagggaggccgctctaaactaaaaataacgaaaggttgccaagtattaatactagttacctccctcttttcgtagtttttgtcatgtctgtcaacttactcgattgtgtggttgcattcagaatatttgaagtttcttacgtagacagaaataataaaaatattaactaggaaaaaacagtatagcaccaagccagtatttggtatctctctctagagcgagcaagagagggagagaggaggaaaaaatacacataatacaaacatacatgcatgcacacatacatacatatgtatacacacacataatttgaaaactgattggcacttcaacgatgctgaaattgtttttaaattgaagtttctttcttccacaaagcagccgtttctattcaaatggaaattcagtaccagagaataaatgtctatgtagtcatactgaatttagatagataagggctacagcatactaaatcgacaaccaaatttgtcatgtgactaaaccgttacttcagatgaagcttacattactgttttctgcttgtgtattttctgtagagtacttttacacagattggtaaagttcaggtttcagagaactgcttttgtgcagaaaatttaggttcttttttccacctttttggtcagtaaaacttaatgaaaaaagcaaagaaaaaaatattctgaacaaagctatagggttttaagttcagcctcccaacttagtcatcctaacatgattattttgtgatttggggtgcttgccctggtgctgttccagtccatgtgcatcctgagctgtgtgatctgcctcgaggctatgatctgagcaagcaggagataacattttcttctgcatcaagtgaggaaaaatgtgcttttggccatgtctcaaagacaggaccaacttcagattcccaaagaagccagctacagagcctctggaacactatggtcttacaagcagtactaaaatcaaccctcagcctcttcaatgccaaaggtatccctattggttgagaaccacatggtaatttttaatgggacttttatcagcaaatggagttacaggaattctctgtaatgagtgattctgaagaggtactttcctggaataattgtctacctgaagaaaaaaaatttatatatacattgtgtgtgtgtgtaatacacacacacacaaccccctatacctggaagattgtcagcatgtaaatcaggaacaactttctccttattgacaatcccataataaaactcaggaaccaaggcaaaatgaattggcttctaggggtctgaaccttactgcccatacaagtgttgattcattttaatgctgtttatgatttctgcattggcagaaattttcatactttctatgtttttttaattactcagttttttattactaaaaatagcacatttgagtacatttgaaaagtagaaaaattagaaattattaactttattgaataagcaagaagtgcatcctaatcctttgattattaatgaggttgaatatttgtgtgctatcggtagctgtgtttctttgatcagatgttcctgtccttttgcccttctgttatctgttggagttgctttgtttttcgtatcaagttataggatctctttatataataaatgtaatttaacttg

SEQ ID NO: 408453 - DNA, 2007 bp, Homo sapiens
tggacatttccacgagtcacagcaatcctaaggggggaaaaaaagttggagaacaaatcactctgatttcaaactatattacaaagccacagtaatcaaaacagcatagtactggcagcaaaacagatacataaatcaacaaacagaatgtaggtgactcgtggaagtggctaacaaatgcattctgaaaatgtatttaacatagctgttttaacaaatgaaaaaaagacgtagaaaaatgtttagatgtctttttgtgatgttatataaaattgtagatgactgtggtaaatgtgtaattatgtccattatgcttcaaagttgagttttcatctttgactccaaaatgtcagagggaggccgctctaaactaaaaataacgaaaggttgccaagtattaatactagttacctccctcttttcgtagtttttgtcatgtctgtcaacttactcgattgtgtggttgcattcagaatatttgaagtttcttacgtagacagaaataataaaaatattaactaggaaaaaacagtatagcaccaagccagtatttggtatctctctctagagcgagcaagagagggagagaggaggaaaaaatacacataatacaaacatacatgcatgcacacatacatacatatgtatacacacacataatttgaaaactgattggcacttcaacgatgctgaaattgtttttaaattgaagtttctttcttccacaaagcagccgtttctattcaaatggaaattcagtaccagagaataaatgtctatgtagtcatactgaatttagatagataagggctacagcatactaaatcgacaaccaaatttgtcatgtgactaaaccgttacttcagatgaagcttacattactgttttctgcttgtgtattttctgtagagtacttttacacagattggtaaagttcaggtttcagagaactgcttttgtgcagaaaatttaggttcttttttccacctttttggtcagtaaaacttaatgaaaaaagcaaagaaaaaaatattctgaacaaagctatagggttttaagttcagcctcccaacttagtcatcctaacatgattattttgtgatttggggtgcttgccctggtgctgttccagtccatgtgcatcctgagctgtgtgatctgcctcgaggctatgatctgagcaagcaggagataacattttcttctgcatcaagtgaggaaaaatgtgcttttggccatgtctcaaagacaggaccaacttcagattcccaaagaagccagctacagagcctctggaacactatggtcttacaagcagtactaaaatcaaccctcagcctcttcaatgccaaaggtatccctattggttgagaaccacatggtaatttttaatgggacttttatcagcaaatggagttacaggaattctctgtaatgagtgattctgaagaggtactttcctggaataattgtctacctgaagaaaaaaaatttatatatacattgtgtgtgtgtgtaatacacacacacacaaccccctatacctggaagattgtcagcatgtaaatcaggaacaactttctccttattgacaatcccataataaaactcaggaaccaaggcaaaatgaattggcttctaggggtctgaaccttactgcccatacaagtgttgattcattttaatgctgtttatgatttctgcattggcagaaattttcatactttctatgtttttttaattactcagttttttattactaaaaatagcacatttgagtacatttgaaaagtagaaaaattagaaattattaactttattgaataagcaagaagtgcatcctaatcctttgattattaatgaggttgaatatttgtgtgctatcggtagctgtgtttctttgatcagatgttcctgtccttttgcccttctgttatctgttggagttgctttgtttttcgtatcaagttataggatctctttatataataaatgtaatttaacttg

SEQ ID NO: 408454 - DNA, 1335 bp, Homo sapiens
cattaagttttactgaccaaaaaggtggaaaaaagaacctaaattttcttccacaaagcagccgtttctattcaaatggaaattcagtaccagagaataaatgtctatgtagtcatactgaatttagatagataagggctacagcatactaaatcgacaaccaaatttgtcatgtgactaaaccgttacttcagatgaagcttacattactgttttctgcttgtgtattttctgtagagtacttttacacagattggtaaagttcaggtttcagagaactgcttttgtgcagaaaatttaggttcttttttccacctttttggtcagtaaaacttaatgaaaaaagcaaagaaaaaaatattctgaacaaagctatagggttttaagttcagcctcccaacttagtcatcctaacatgattattttgtgatttggggtgcttgccctggtgctgttccagtccatgtgcatcctgagctgtgtgatctgcctcgaggctatgatctgagcaagcaggagataacattttcttctgcatcaagtgaggaaaaatgtgcttttggccatgtctcaaagacaggaccaacttcagattcccaaagaagccagctacagagcctctggaacactatggtcttacaagcagtactaaaatcaaccctcagcctcttcaatgccaaaggtatccctattggttgagaaccacatggtaatttttaatgggacttttatcagcaaatggagttacaggaattctctgtaatgagtgattctgaagaggtactttcctggaataattgtctacctgaagaaaaaaaatttatatatacattgtgtgtgtgtgtaatacacacacacacaaccccctatacctggaagattgtcagcatgtaaatcaggaacaactttctccttattgacaatcccataataaaactcaggaaccaaggcaaaatgaattggcttctaggggtctgaaccttactgcccatacaagtgttgattcattttaatgctgtttatgatttctgcattggcagaaattttcatactttctatgtttttttaattactcagttttttattactaaaaatagcacatttgagtacatttgaaaagtagaaaaattagaaattattaactttattgaataagcaagaagtgcatcctaatcctttgattattaatgaggttgaatatttgtgtgctatcggtagctgtgtttctttgatcagatgttcctgtccttttgcccttctgttatctgttggagttgctttgtttttcgtatcaagttataggatctctttatataataaatgtaatttaacttg

SEQ ID NO: 408455 - DNA, 4477 bp, Homo sapiens
ggaaggagcggctcggtgttggggctaggccggtattctaggcccaagcccaggcccaggcctgtgttcccggcccttgctcaaagacaggccggtggccgctgcgacactctaggtacagcggagggcgcagcgggccgttcgctgaggtgtccggacccgccgccgagcgggccgtggagccacagtacgtggcggcgcctcttccttgcccgaagcggaactgctgaaggagcggcagcgcaggccggacgaggtgaaccaggtcatttaaccgccttcaggtgatgaatcatctgtctaataatcagatttgaggtccacagccctttgtggtcctgctacagggtgattttcagtggatgactgactggcgtggcccgaggggtgccgcagtgactgccttcccttgataaggaaacgagctttctgttctttctggacacctcgttacctgtaaaacattccggttataacttctttatccggcttgcatctctgtgcaagaggaaagctttcacatgaaagtgtcccttggtaacggcgaaatgggcgtctctgcccatttgcagccttgtaaggcaggaaccacacgcttttttaccagcaatactcacagttcggtggtattgcaaggctttgatcagcttagaatagaaggattgctttgtgatgtgaccctggtaccaggtgatggagatgaaatcttccctgttcacagagctatgatggcgtctgctagtgattatttcaaagccatgttcacaggtggaatgaaagaacaagatttgatgtgcattaagcttcatggggtgaacaaggttggtctgaagaaaatcattgattttatttatactgcaaaactttctcttaatatggacaatcttcaggacacacttgaagctgctagctttttacaaatattacccgttttggatttctgtaaagtatttcttatatcaggagtctctttggataactgtgttgaggttggacgaattgctaacacctacaatcttatagaagtggataaatatgttaataatttcatcctgaagaactttcctgctttattgagtactggggagtttctaaaactcccttttgaacgacttgcatttgtgctttccagtaatagtcttaagcactgtaccgaacttgaactctttaaggcagcctgtcgctggctaaggttggaagaccctcggatggattatgctgcaaagttaatgaagaatattcgatttccactgatgacaccacaggatctcatcaattacgtgcagacagtagatttcatgagaacagacaatacctgcgtgaatttgcttttggaagctagcaattaccaaatgatgccatatatgcagccagtgatgcagtcagatagaactgccattcgatctgactccactcacttggttacattaggaggagttttgaggcagcagctggttgtcagtaaagaattacggatgtatgatgaaagggcacaagaatggagatctttagccccaatggatgctccccgttaccagcatggtattgctgtcattggaaactttctttatgtagttggtggtcagagtaattatgatacaaaaggaaaaactgctgttgatacagttttcagatttgatcctcggtataataaatggatgcaggttgcatcattaaatgaaaagcgcacattctttcacttgagtgccctcaaaggacatttgtatgcagttggtgggcgcagtgcagctggtgaactggccacagtagaatgttacaacccaagaatgaatgagtggagctatgttgcaaaaatgagtgaaccccactatggtcatgctggaacagtatatggaggcttaatgtatatttcaggaggaattacccatgacactttccaaaatgagctcatgtgttttgacccagatacagataaatggatgcaaaaggctccaatgactacagtcagaggtctgcattgcatgtgtacagttggagataagctctatgtcattggtggcaatcacttcagaggaacaagtgattatgatgatgttctaagctgtgaatactattcaccaacccttgaccagtggaccccaattgccgccatgttaagaggccaaagtgatgttggagttgccgtctttgaaaataaaatctatgttgttggtggatattcttggaataatcgttgtatggtagaaattgtccagaaatatgacccagaaaaagatgagtggcataaagtttttgatcttccagagtcacttggtggcattcgagcctgtacactcacagtttttccacctgaagaaaaccctgggtcaccttctagagaatcacctctttcagcaccttcagatcattcttaggtctaaggtgtaacacctttgcagtacgtcatgggtgatctaatacttccccttcagttgtatcttcttacagtgattggtacagttattagatataaaggtaactgatgttattcgtcttgtatggcttttagtatgtttatcaagtggctaacaaatgcattctgaaaatgtatttaacatagctgttttaacaaatgaaaaaaagacgtagaaaaatgtttagatgtctttttgtgatgttatataaaattgtagatgactgtggtaaatgtgtaattatgtccattatgcttcaaagttgagttttcatctttgactccaaaatgtcagagggaggccgctctaaactaaaaataacgaaaggttgccaagtattaatactagttacctccctcttttcgtagtttttgtcatgtctgtcaacttactcgattgtgtggttgcattcagaatatttgaagtttcttacgtagacagaaataataaaaatattaactaggaaaaaacagtatagcaccaagccagtatttggtatctctctctagagcgagcaagagagggagagaggaggaaaaaatacacataatacaaacatacatgcatgcacacatacatacatatgtatacacacacataatttgaaaactgattggcacttcaacgatgctgaaattgtttttaaattgaagtttctttcttccacaaagcagccgtttctattcaaatggaaattcagtaccagagaataaatgtctatgtagtcatactgaatttagatagataagggctacagcatactaaatcgacaaccaaatttgtcatgtgactaaaccgttacttcagatgaagcttacattactgttttctgcttgtgtattttctgtagagtacttttacacagattggtaaagttcaggtttcagagaactgcttttgtgcagaaaatttaggttcttttttccacctttttggtcagtaaaacttaatgaaaaaagcaaagaaaaaaatattctgaacaaagctatagggttttaagttcagcctcccaacttagtcatcctaacatgattattttgtgatttggggtgcttgccctggtgctgttccagtccatgtgcatcctgagctgtgtgatctgcctcgaggctatgatctgagcaagcaggagataacattttcttctgcatcaagtgaggaaaaatgtgcttttggccatgtctcaaagacaggaccaacttcagattcccaaagaagccagctacagagcctctggaacactatggtcttacaagcagtactaaaatcaaccctcagcctcttcaatgccaaaggtatccctattggttgagaaccacatggtaatttttaatgggacttttatcagcaaatggagttacaggaattctctgtaatgagtgattctgaagaggtactttcctggaataattgtctacctgaagaaaaaaaatttatatatacattgtgtgtgtgtgtaatacacacacacacaaccccctatacctggaagattgtcagcatgtaaatcaggaacaactttctccttattgacaatcccataataaaactcaggaaccaaggcaaaatgaattggcttctaggggtctgaaccttactgcccatacaagtgttgattcattttaatgctgtttatgatttctgcattggcagaaattttcatactttctatgtttttttaattactcagttttttattactaaaaatagcacatttgagtacatttgaaaagtagaaaaattagaaattattaactttattgaataagcaagaagtgcatcctaatcctttgattattaatgaggttgaatatttgtgtgctatcggtagctgtgtttctttgatcagatgttcctgtccttttgcccttctgttatctgttggagttgctttgtttttcgtatcaagttataggatctctttatataataaatgtaatttaacttggcatttgcttggcatttatttcttccctcaatctgttgtagttttacaaaggcaacgctgttcagttaatttttgagatcaaatttgtctttttttttttttgagacagggtctc

SEQ ID NO: 408456 - DNA, 3528 bp, Homo sapiens
taactatgcgcataactattacagcataaactatacagcataaactattacagcataaactattacagcataaactattacagcatactattcccgttttggatttctgtaaagtatttcttatatcaggagtctctttggataactgtgttgaggttggacgaattgctaacacctacaatcttatagaagtggataaatatgttaataatttcatcctgaagaactttcctgctttattgagtactggggagtttctaaaactcccttttgaacgacttgcatttgtgctttccagtaatagtcttaagcactgtaccgaacttgaactctttaaggcagcctgtcgctggctaaggttggaagaccctcggatggattatgctgcaaagttaatgaagaatattcgatttccactgatgacaccacaggatctcatcaattacgtgcagacagtagatttcatgagaacagacaatacctgcgtgaatttgcttttggaagctagcaattaccaaatgatgccatatatgcagccagtgatgcagtcagatagaactgccattcgatctgactccactcacttggttacattaggaggagttttgaggcagcagctggttgtcagtaaagaattacggatgtatgatgaaagggcacaagaatggagatctttagccccaatggatgctccccgttaccagcatggtattgctgtcattggaaactttctttatgtagttggtggtcagagtaattatgatacaaaaggaaaaactgctgttgatacagttttcagatttgatcctcggtataataaatggatgcaggttgcatcattaaatgaaaagcgcacattctttcacttgagtgccctcaaaggacatttgtatgcagttggtgggcgcagtgcagctggtgaactggccacagtagaatgttacaacccaagaatgaatgagtggagctatgttgcaaaaatgagtgaaccccactatggtcatgctggaacagtatatggaggcttaatgtatatttcaggaggaattacccatgacactttccaaaatgagctcatgtgttttgacccagatacagataaatggatgcaaaaggctccaatgactacagtcagaggtctgcattgcatgtgtacagttggagataagctctatgtcattggtggcaatcacttcagaggaacaagtgattatgatgatgttctaagctgtgaatactattcaccaacccttgaccagtggaccccaattgccgccatgttaagaggccaaagtgatgttggagttgccgtctttgaaaataaaatctatgttgttggtggatattcttggaataatcgttgtatggtagaaattgtccagaaatatgacccagaaaaagatgagtggcataaagtttttgatcttccagagtcacttggtggcattcgagcctgtacactcacagtttttccacctgaagaaaaccctgggtcaccttctagagaatcacctctttcagcaccttcagatcattcttaggtctaaggtgtaacacctttgcagtacgtcatgggtgatctaatacttccccttcagttgtatcttcttacagtgattggtacagttattagatataaaggtaactgatgttattcgtcttgtatggcttttagtatgtttatcaagtggctaacaaatgcattctgaaaatgtatttaacatagctgttttaacaaatgaaaaaaagacgtagaaaaatgtttagatgtctttttgtgatgttatataaaattgtagatgactgtggtaaatgtgtaattatgtccattatgcttcaaagttgagttttcatctttgactccaaaatgtcagagggaggccgctctaaactaaaaataacgaaaggttgccaagtattaatactagttacctccctcttttcgtagtttttgtcatgtctgtcaacttactcgattgtgtggttgcattcagaatatttgaagtttcttacgtagacagaaataataaaaatattaactaggaaaaaacagtatagcaccaagccagtatttggtatctctctctagagcgagcaagagagggagagaggaggaaaaaatacacataatacaaacatacatgcatgcacacatacatacatatgtatacacacacataatttgaaaactgattggcacttcaacgatgctgaaattgtttttaaattgaagtttctttcttccacaaagcagccgtttctattcaaatggaaattcagtaccagagaataaatgtctatgtagtcatactgaatttagatagataagggctacagcatactaaatcgacaaccaaatttgtcatgtgactaaaccgttacttcagatgaagcttacattactgttttctgcttgtgtattttctgtagagtacttttacacagattggtaaagttcaggtttcagagaactgcttttgtgcagaaaatttaggttcttttttccacctttttggtcagtaaaacttaatgaaaaaagcaaagaaaaaaatattctgaacaaagctatagggttttaagttcagcctcccaacttagtcatcctaacatgattattttgtgatttggggtgcttgccctggtgctgttccagtccatgtgcatcctgagctgtgtgatctgcctcgaggctatgatctgagcaagcaggagataacattttcttctgcatcaagtgaggaaaaatgtgcttttggccatgtctcaaagacaggaccaacttcagattcccaaagaagccagctacagagcctctggaacactatggtcttacaagcagtactaaaatcaaccctcagcctcttcaatgccaaaggtatccctattggttgagaaccacatggtaatttttaatgggacttttatcagcaaatggagttacaggaattctctgtaatgagtgattctgaagaggtactttcctggaataattgtctacctgaagaaaaaaaatttatatatacattgtgtgtgtgtgtaatacacacacacacaaccccctatacctggaagattgtcagcatgtaaatcaggaacaactttctccttattgacaatcccataataaaactcaggaaccaaggcaaaatgaattggcttctaggggtctgaaccttactgcccatacaagtgttgattcattttaatgctgtttatgatttctgcattggcagaaattttcatactttctatgtttttttaattactcagttttttattactaaaaatagcacatttgagtacatttgaaaagtagaaaaattagaaattattaactttattgaataagcaagaagtgcatcctaatcctttgattattaatgaggttgaatatttgtgtgctatcggtagctgtgtttctttgatcagatgttcctgtccttttgcccttctgttatctgttggagttgctttgtttttcgtatcaagttataggatctctttatataataaatgtaatttaacttg

SEQ ID NO: 408457 - DNA, 2752 bp, Homo sapiens
ggaaggagcggctcggtgttggggctaggccggtattctaggcccaagcccaggcccaggcctgtgttcccggcccttgctcaaagacaggccggtggccgctgcgacactctaggtacagcggagggcgcagcgggccgttcgctgaggtgtccggacccgccgccgagcgggccgtggagccacagtacgtggcggcgcctcttccttgcccgaagcggaactgctgaaggagcggcagcgcaggccggacgaggtgaaccaggtcatttaaccgccttcaggtgatgaatcatctgtctaataatcagatttgaggtccacagccctttgtggtcctgctacagggtgattttcagtggatgactgactggcgtggcccgaggggtgccgcagtgactgccttcccttgataaggaaacgagctttctgttctttctggacacctcgttacctgtaaaacattccggttataacttctttatccggcttgcatctctgtgcaagaggaaagctttcacatgaaagtgtcccttggtaacggcgaaatgggcgtctctgcccatttgcagccttgtaaggcaggaaccacacgcttttttaccagcaatactcacagttcggtggtattgcaaggctttgatcagcttagaatagaaggattgctttgtgatgtgaccctggtaccaggtgatggagatgaaatcttccctgttcacagagctatgatggcgtctgctagtgattatttcaaagccatgttcacaggtggaatgaaagaacaagatttgatgtgcattaagcttcatggggtgaacaaggttggtctgaagaaaatcattgattttatttatactgcaaaactttctcttaatatggacaatcttcaggacacacttgaagctgctagctttttacaaatattacccgttttggatttctgtaaagtatttcttatatcaggagtctctttggataactgtgttgaggttggacgaattgctaacacctacaatcttatagaagtggataaatatgttaataatttcatcctgaagaactttcctgctttattgagtactggggagtttctaaaactcccttttgaacgacttgcatttgtgctttccagtaatagtcttaagcactgtaccgaacttgaactctttaaggcagcctgtcgctggctaaggttggaagaccctcggatggattatgctgcaaagttaatgaagaatattcgatttccactgatgacaccacaggatctcatcaattacgtgcagacagtagatttcatgagaacagacaatacctgcgtgaatttgcttttggaagctagcaattaccaaatgatgccatatatgcagccagtgatgcagtcagatagaactgccattcgatctgactccactcacttggttacattaggaggagttttgaggcagcagctggttgtcagtaaagaattacggatgtatgatgaaagggcacaagaatggagatctttagccccaatggatgctccccgttaccagcatggtattgctgtcattggaaactttctttatgtagttggtggtcagagtaattatgatacaaaaggaaaaactgctgttgatacagttttcagatttgatcctcggtataataaatggatgcaggttgcatcattaaatgaaaagcgcacattctttcacttgagtgccctcaaaggacatttgtatgcagttggtgggcgcagtgcagctggtgaactggccacagtagaatgttacaacccaagaatgaatgagtggagctatgttgcaaaaatgagtgaaccccactatggtcatgctggaacagtatatggaggcttaatgtatatttcaggaggaattacccatgacactttccaaaatgagctcatgtgttttgacccagatacagataaatggatgcaaaaggctccaatgactacagtcagaggtctgcattgcatgtgtacagttggagataagctctatgtcattggtggcaatcacttcagaggaacaagtgattatgatgatgttctaagctgtgaatactattcaccaacccttgaccagtggaccccaattgccgccatgttaagaggccaaagtgatgttggagttgccgtctttgaaaataaaatctatgttgttggtggatattcttggaataatcgttgtatggtagaaattgtccagaaatatgacccagaaaaagatgagtggcataaagtttttgatcttccagagtcacttggtggcattcgagcctgtacactcacagtttttccacctgaagaaaaccctgggtcaccttctagagaatcacctctttcagcaccttcagatcattcttaggtctaaggtgtaacacctttgcagtacgtcatgggtgatctaatacttccccttcagttgtatcttcttacagtgattggtacagttattagatataaagtacaagccagctgccatgttgtgagcacataccacatagctccatggagatgcccatgtgactgtgatgaagagctaagacttcctgtcagtggccgtgtgagtgacccatgttagaaacagatccgccagcccaaacagaaccttcagacaactgcagccccagctggcatcttgactgcaactcatgagcgattctaagcccaccgaagctgctcttgaattattgattcacaaaaacttttaggtaataaatgtgtgttgttttaaaaaaaaaa

SEQ ID NO: 408458 - DNA, 621 bp, Homo sapiens
tgaagtcaccacacagataaagacacttttcattctcagtaaggaactttgggagataattggggcaggcagctaaagaacaggtgtcttttgtctgacatcagcaaactcatggaaaccgatgggcggctcactttgcttagaacccccacagcacgcacacagggctgcttcccagtcacactgctcctgggatgggggtgctgctgttctgcagttagcactgttctttacttcctattactgaactgccagcgttcatttgtgttcagttaggtagattaccaattcttgttcattcagattttcttttgctcactaatgtgtttcatgttcactaacttaccaaatgtgatttattagtgactttttttttgaagatggagtggaggaatccttgcgccttctgcagcattctgctgccgttatggaacagtgcatctatggaagtgcatcagcgggggatggggagaggctagggcagtacacgtgaatggagaggtagccccaccagtatgttttctgaaatacagtcccgcagagggcagtcttgggaaattactgctttcacacactcttcttgaccctatccctccagcacctccctgctatccaaaggtt

SEQ ID NO: 408459 - DNA, 1538 bp, Homo sapiens
cacagaagccctctagccaaggcctcgggcagccctaccaaatgaatatgggcacttgagttttctaggagggctttcctgctgccctgggtctcatccaactggtatccatctaaacattcccacccagggttattcatgctagaggaagaagaatgccctttccagagccagttcttggggaaaagaggaactgttgatatagccagagcccgaaaagaagattactctgcaacagctaaagcctcacgaaagattttacttgtagatcaactttcaaaatgtaggaagtcagaatgggtgacatcatcagaaaaatatgtggagctgatcacaagaagtgaagaacccagagcacgaaagcggttgtgactcctgggcccagggagttgacagcgtctgggtttcagaggagccagcgcctccgagttgtcttgaagtgaggctctgctgtagtcctgttcttctggctctaagatctgaatgttgtgaccactaatttgctctttcctggagagtaaccccagtttggtccacaaggcttgctgcccaatctttgccaacagttgaaccaagactctgaggctgatatgcaatgtcacttacaacattaatcagatactgcatttaagtcacagtgtcttcacctggaatagattccacctcaagaaaccagtttctttgctcatccataagaagcaactcctcatctgatcaagttttataataagattgcagaaattcagtctcatctttaggctccacttctagttcttatgctatttccaccacatctgcagttacttcctccactgaagtcttgaatctctcaaagtcatccatgagggttggaaccaacatcttccaaactcctgatcttgatgtggaagaaatggaggactcagaaccaaggatttccaagtgatttcttccaaagcacaggaatctcactctgttaaagctggtctgttctaactgagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcagctgcaggaaaaaagctgggaatatcgttcttggaagaccttactgatcgcaacttctcaaattccccgggtccctatgtattctgtattactgaaaagggagtggttaaagaagaaaaaaatgaaaaaaggcatgaagaaccagccatcactaatgggccaaggatcacaaatgcattttccatcatcgaaacagaaaatagtaataacatgttttccccgctggacttgagg

SEQ ID NO: 408460 - DNA, 1158 bp, Homo sapiens
tggcactcgcagctgcagcaaatctcaaaataaagaggcaacggcctttctcttcctctccatctccctatagcacaccttttatttcttttcttcttttttttaagcctcacgaaagattttacttgtagatcaactttcaaaatgtaggaagtcagaatgggtgacatcatcagaaaaatatgtggagctgatcacaagaagtgaagaacccagagcacgaaagcggttgtgactcctgggcccagggagttgacagcgtctgggtttcagaggagccagcgcctccgagttgtcttgaagtgaggctctgctgtagtcctgttcttctggctctaagatctgaatgttgtgaccactaatttgctctttcctggagagtaaccccagtttggtccacaaggcttgctgcccaatctttgccaacagttgaaccaagactctgaggctgatatgcaatgtcacttacaacattaatcagatactgcatttaagatcttgatgtggaagaaatggaggactcagaaccaaggatttccaagtgatttcttccaaagcacaggaatctcactctgttaaagctggtctgttctaactgagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcagctgcaggaaaaaagctgggaatatcgttcttggaagaccttactgatcgcaacttctcaaattccccgggtccctatgtattctgtattactgaaaagggagtggttaaagaagaaaaaaatgaaaaaaggcatgaagaaccagccatcactaatgggccaaggatcacaaatgcattttccatcatcgaaacagaaaatagtaataacatgttttccccgctggacttgagg

SEQ ID NO: 408461 - DNA, 682 bp, Homo sapiens
tggcactcgcagctgcagcaaatctcaaaataaagaggcaacggcctttctcttcctctccatctccctatagcacaccttttatttcttttcttcttttttttaagcctcacgaaagattttacttgtagatcaactttcaaaatgtaggaagtcagaatgggtgacatcatcagaaaaatatgtggagctgatcacaagaagtgaagaacccagagcacgaaagcggttgtgactcctgggcccagggagttgacagcgtctgggtttcagaggagccagcgcctccgagttgtcttgaagtgaggctctgctgtagtcctgttcttctggctctaagatctgaatgttgtgaccactaatttgctctttcctggagagtaaccccagtttggtccacaaggcttgctgcccaatctttgccaacagttgaaccaagactctgaggctgatatgcaatgtcacttacaacattaatcagatactgcatttaagtacagacggggtttcaccatgttggccaggatggtctcaatctgttgacctcgcgatccgcccgcctcagcctcccaaagtgctgggattacaggcgtgagccaccgcgcccagcctgaactttccatttctctcccaagtctcctattctacatgctgaggatgccagaggggccccttaccacca

SEQ ID NO: 408462 - DNA, 790 bp, Homo sapiens
agcggaggctgccctgaggggctccagcataagcaggagacatggagactcttgcctccatcatggaggaggttcacaccagaagccagctctgcccttggagactctcttcccccagtgctcccctgaagcttcacactcaccagtctcatgctgcaccctgaccggcaggtccctagcatgagccccataatccctggggactgcattatcacagaccagtaataagaagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcagctgcaggaaaaaagctgggaatatcgttcttggaagaccttactgatcgcaacttctcaaattccccgggtccctatgtattctgtattactgaaaagggagtggttaaagaagaaaaaaatgaaaaaaggcatgaagaaccagccatcactaatgggccaaggatcacaaatgcattttccatcatcgaaacagaaaatagtaataacatgttttccccgctggacttgagg

SEQ ID NO: 408463 - DNA, 1079 bp, Homo sapiens
aggttgtccaagctggcctccctctctgctgagtgcactccagcagcttcccgatgttggcctttagaacagcctgaatttcagttaaaaaataagcttcccctgtcacacgatgccttcttgaatctgatagcttaagtgcagtaaaatctgataaatgtagcttttctgtgcccgtttcaggccacatttagaaggcaacatcaacaggattttccttttcctagacacagctcaactccataaaggacttctgttttgtaatctgttttcgagatctgatgcgtgtgtttctaacaccccgtcacgtgaggaggtctgacgtagtcacccaacatgactttgagaaaatatactgtaaagatgtgtgtgggatggtacagccagctcactgaagcaaaatatcctttgtcggaaaactttccgcagggaataacagacctgcgcagtagatttcactttgatatggcccctgtgctggcccagtatggactgcaggtttgacttttgcaggattccagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcagctgcaggaaaaaagctgggaatatcgttcttggaagaccttactgatcgcaacttctcaaattccccgggtccctatgtattctgtattactgaaaagggagtggttaaagaagaaaaaaatgaaaaaaggcatgaagaaccagccatcactaatgggccaaggatcacaaatgcattttccatcatcgaaacagaaaatagtaataacatgttttccccgctggacttgagg

SEQ ID NO: 408464 - DNA, 277 bp, Homo sapiens
ccttgtaatcacacgtgtaaggttaactggttaatataaattaaaataaaaatagatgtcactgacattattccataatgaacagctttgcaggaaaagaattagatctactctttcctgctactttaattatataaaacatacataaataattgccaacagtgacattattagggaacaacaaacttggaggaatattttgattagtctgaaatactaagcaatgcagctagttcaaagctagtttaaaaatttaaatacctgggtttttttgggt

SEQ ID NO: 408465 - DNA, 433 bp, Homo sapiens
tttaaaacccctgcagtttctctttggtggagaaagattctttgttcatttcgtcactcagtaaatatttagtgagctccatgctttgtgtcatgcacattgctgggtgctggagatacaaaggtgaccaagacagaggtggccctttgcccttctcaggggagaaaggtaggaagcaagtaaatgatcgagatgctgtacattgagtgggtgccatggaaggaactaggggagcatcctggggcaggatggggtacagaggaagggatgactcttccgtagggttgtcaggagagccctctctggggaggtgacattcaagttgggcatttattgttttgatattacgttatcaggttcacacaggtcagactttaatttcatttatgttgggtctatttaggcccatttgctctgttacattgctctcagc

SEQ ID NO: 408466 - DNA, 395 bp, Homo sapiens
acttaatagcttaagtagcttagcctctcttgccttaaacatgcttagaagacttaaattagccaacagttgcgcaaaatcatctggcagcacagtaccctgtagcgtattggttgtttaccctgatctgtggctgatcgtgtggctgactaggatggtgtggctgactgggagctgcggcttgctgccgctgcgcagcatcgtgagagaggatcacctggcgtattgctagctcgggaaaaaatcaaaattcaaaatttgaagtagggtttctactgaacacatatcactttctcatcgttgtaaagttgaaatatcggaagttgaaccctcataagccagggactgtctgtgaattgaaattagcctaaaagacagcagtagtatcatatttc

SEQ ID NO: 408467 - DNA, 543 bp, Homo sapiens
tgaggttcttcttctggctacaaaacctctttctgggtgattcatctccccaaaagttttggtgagcaccttctctgggtctctgattctacctttgaaaaatggctattggtctggataaccatttaggtcctccaactttttttataatttgaaattcctaaaaggtcttaaattattagggtgtctacttgcaggccttcgggcagatgggccaagagctcaggccagacctctgtgtagtagtggacatgaagccttgactagccacgaaaaaatataccacagagagcaaaccctatgaggggcaggcatcttctcatgtcttactcctcagtgcctggagaagtgctggtgcatggtagatgctcaagaaaatgcttactgagtaaacgaacatgtgattgcctctggacaatactgttaaaactaaatacttgccaggtgtggtggctcacacctgtgatagttcttttggaggccgaggtgggaggatagcttgagcccaggagttcaagcaaaatagtgagaccctgtctctac

SEQ ID NO: 408468 - DNA, 396 bp, Homo sapiens
attagataggaaagtatggaaagttttgagattgctacatgattgctcttttaatttgtccaatgtattcctttaaatgttgtgagggatttttttaccagtgaagtagcttttgcatgctaagttgtagtgaactgctgggcagaactaaaacataaatggtttgaggcatgattaatagttgtatatggtggccgggcgtggtggctcatgcctgtaatcccagcactttgggaggccgaggcgggtggctcacgaggtcaggagattgagaccatcctggctaacatggtgaaaccccgtctctactgaaaatacaaaaagtagccgggtgtggtggtgggtgcctgtagtcccagctactcaggaggctgaggcaggagaatggcatgaacc

SEQ ID NO: 408469 - DNA, 365 bp, Homo sapiens
taatgcttattcgattacttcagttgtcttttgtttctccaactagactgatggctttgtcatagcaaggattttgcttattcagtgccaaatcctagttcaatgcttggcacaagaaattgcttgtcttaatttgtctgtgtggctataacaaaatatctgaaatacataatttgtaaagaacagaaatttatttctcacagttctggaggctggcaagtccaagatcagagaggttgcttgtgaaggccactctctgcttccaagatggctcccctcatggtggggaggaatactgtgtcctcacatggcagaaggcagaagggcaagagagccaaatacctttaaaaaaaaaaaggaaaaag

SEQ ID NO: 408470 - DNA, 1101 bp, Homo sapiens
tttcaattgtagtatatgcactgctgaggcaagcacagaatctgcatgtttaataagctctccctccattcgtatgcctattaaagcttgtaaagtaggaaaccctgtgctgcaaaacaaaatctgaactcctaacaaagttctccaacagcttttcaatcttattttatcttactccaacacttgaactctctgcttccaatgcaattcagaaaggaaagtatccttgcattgacaagtagaagaattgagttttttattttattttatttttttattttgagtcaaagtctagctctgtcacccaggctggagtgcagtggcatgatctcggctcactgcaacctctgccccttgggttcaagcgattcccctgcctcagcctccagagtagctgggatgacaggcatgcaccaccagcccagctaatgttttgtgtttttagtagagacgggtttcatcgtgttggtcaggctggtctggaactcctggcttcaggtgatccacccacctttgtctccgaaagtgctgggattacaggtgtgagccacagtgcccggccagaagaatgagttaactacagctgagcacacaaaaaagtaagaatccactaggcagtacttgattaagtgccagatgactagcagaggcaagacatgctctgagttagaaggagtcatcatgatttttgaagttttcaccaagtagagagttaatttggtcttttaaggttggggaggtttctgcagtcaggaatagggggagagtaccagggacatggagtggtttatgcaaagcaaacaaataagaaagcaaaaatgaacagagattagacaactttgctatcaaggggagtagctgcgatctggctggaaaaactgtgaataagaggccaagtatttgttcgggagggcggtgttttctctaacttattcatgataaaattttgatatattgcattccatcacaaaacaaacagaaacgcttttgaagaaggaaaatggctatataattaattgacgtgcattataaaaatcacaaccacccgtatgtgcccatgagaaaaccaatctatcgaagtaaatatgatctgctgtggtc

SEQ ID NO: 408471 - DNA, 652 bp, Homo sapiens
ctcaaactcctccttaaccggccaggtttacattttgatgtgaatctggacttctctccccttcgaagtcttgatcttcccatattcacattatatatactgtccattttgctcaatctgtcttctactcaagtgatttctgcatgtatcttatctccccactaggcagtacttgattaagtgccagatgactagcagaggcaagacatgctctgagttagaaggagtcatcatgatttttgaagttttcaccaagtagagagttaatttggtcttttaaggttggggaggtttctgcagtcaggaatagggggagagtaccagggacatggagtggtttatgcaaagcaaacaaataagaaagcaaaaatgaacagagattagacaactttgctatcaaggggagtagctgcgatctggctggaaaaactgtgaataagaggccaagtatttgttcgggagggcggtgttttctctaacttattcatgataaaattttgatatattgcattccatcacaaaacaaacagaaacgcttttgaagaaggaaaatggctatataattaattgacgtgcattataaaaatcacaaccacccgtatgtgcccatgagaaaaccaatctatcgaagtaaatatgatctgctgtggtc

SEQ ID NO: 408472 - DNA, 3262 bp, Homo sapiens
ggagctttctattggtcctgggtaccgagcatgggcgctgcgtcagtgcgcgctggcgcaaggttggtggaagtcgcgttgtgcagtttcactgttacatgccttgaagtgatgaggaggtttctgttactatatgctacacagcagggacaggcaaaggccatcgcagaagaaatgtgtgagcaagctgtggtacatggattttctgcagatcttcactgtattagtgaatccgataagtatgacctaaaaaccgaaacagctcctcttgttgttgtggtttctaccacgggcaccggagacccacccgacacagcccgcaagtttgttaaggaaatacagaaccaaacactgccggttgatttctttgctcacctgcggtatgggttactgggtctcggtgattcagaatacacctacttttgcaatggggggaagataattgataaacgacttcaagagcttggagcccggcatttctatgacactggacatgcagatgactgtgtaggtttagaacttgtggttgagccgtggattgctggactctggccagccctcagaaagcattttaggtcaagcagaggacaagaggagataagtggcgcactcccggtggcatcacctgcatcctcgaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggaggaaagccaagtatctgtgacttcagcagatccagtttttcaagtgccaatttcaaaggcagttcaacttactacgaatgatgccataaaaaccactctgctggtagaattggacatttcaaatacagacttttcctatcagcctggagatgccttcagcgtgatctgccctaacagtgattctgaggtacaaagcctactccaaagactgcagcttgaagataaaagagagcactgcgtccttttgaaaataaaggcagacacaaagaagaaaggagctaccttaccccagcatatacctgcgggatgttctctccagttcatttttacctggtgtcttgaaatccgagcaattcctaaaaaggcatttttgcgagcccttgtggactataccagtgacagtgctgaaaagcgcaggctacaggagctgtgcagtaaacaaggggcagccgattatagccgctttgtacgagatgcctgtgcctgcttgttggatctcctcctcgctttcccttcttgccagccaccactcagtctcctgctcgaacatcttcctaaacttcaacccagaccatattcgtgtgcaagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaagatatccatctctcctcgaacaacaaattctttccacttaccagatgacccctcaatccccatcataatggtgggtccaggaaccggcatagccccgtttattgggttcctacaacatagagagaaactccaagaacaacacccagatggaaattttggagcaatgtggttgttttttggctgcaggcataaggatagggattatctattcagaaaagagctcagacatttccttaagcatgggatcttaactcatctaaaggtttccttctcaagagatgctcctgttggggaggaggaagccccagcaaagtatgtacaagacaacatccagcttcatggccagcaggtggcgagaatcctcctccaggagaacggccatatttatgtgtgtggagatgcaaagaatatggccaaggatgtacatgatgcccttgtgcaaataataagcaaagaggttggagttgaaaaactagaagcaatgaaaaccctggccactttaaaagaagaaaaacgctaccttcaggatatttggtcataaaaccagaaattaaagaaagaggattaagcttttttgactgaaagtactaaaagtcagctttactagtgccaaacctttaaattttcaaaagaaaattttctttcaacatttcttgaaggacatggagtggagattggatcatttaacaatataacaaaacttcctgatttgattttacgtatcttctatctacgcccttcctgtgcctgtgactctccccaaattgccctgttgccttgagctcttctgagctaaggcagccttcagtccctatcagcgcctcctttacttcccagagaacttcacagagactctgtccttccatgcaaaggcttcctgaaatagggagactgactgagtagctcattcttgtgacttacagtgccaacatttaaaaaagtatgaaaatgatttatttttatatgatgtatacccataaagaatgctcatattaatgtacttaaattacacatgtagagcatatctgttatatgtttatgtaactatcaaatggttatttgttactaaagctatatttctgataaaaaatattttaggataattgcctacagagggatttatttttatgatgctggaaatatgaaatgtattttaaaatttcactctggcatatgatttatctatcaccattactttttttaaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactaagcagtgtgctggacctaaaatactgactttagttagtatccttggatttttagattcccagtgtctaattccctgttataatttgcacaaacaaaacaaaatgttatgataatctttctccactgttctaatatatattgtatttttatttgatagcttgggatttaaaacatctctgttgaaggcttttgatccttttgagaaataaagatctgaaagaaatggca

SEQ ID NO: 408473 - DNA, 3108 bp, Homo sapiens
ggagctttctattggtcctgggtaccgagcatgggcgctgcgtcagtgcgcgctggcgcaaggttggtggaagtcgcgttgtgcagtttcactgttacatgccttgaagtgatgaggaggtttctgttactatatgctacacagcagggacaggcaaaggccatcgcagaagaaatgtgtgagcaagctgtggtacatggattttctgcagatcttcactgtattagtgaatccgataaggtctcggtgattcagaatacacctacttttgcaatggggggaagataattgataaacgacttcaagagcttggagcccggcatttctatgacactggacatgcagatgactgtgtaggtttagaacttgtggttgagccgtggattgctggactctggccagccctcagaaagcattttaggtcaagcagaggacaagaggagataagtggcgcactcccggtggcatcacctgcatcctcgaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggaggaaagccaagtatctgtgacttcagcagatccagtttttcaagtgccaatttcaaaggcagttcaacttactacgaatgatgccataaaaaccactctgctggtagaattggacatttcaaatacagacttttcctatcagcctggagatgccttcagcgtgatctgccctaacagtgattctgaggtacaaagcctactccaaagactgcagcttgaagataaaagagagcactgcgtccttttgaaaataaaggcagacacaaagaagaaaggagctaccttaccccagcatatacctgcgggatgttctctccagttcatttttacctggtgtcttgaaatccgagcaattcctaaaaaggcatttttgcgagcccttgtggactataccagtgacagtgctgaaaagcgcaggctacaggagctgtgcagtaaacaaggggcagccgattatagccgctttgtacgagatgcctgtgcctgcttgttggatctcctcctcgctttcccttcttgccagccaccactcagtctcctgctcgaacatcttcctaaacttcaacccagaccatattcgtgtgcaagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaagatatccatctctcctcgaacaacaaattctttccacttaccagatgacccctcaatccccatcataatggtgggtccaggaaccggcatagccccgtttattgggttcctacaacatagagagaaactccaagaacaacacccagatggaaattttggagcaatgtggttgttttttggctgcaggcataaggatagggattatctattcagaaaagagctcagacatttccttaagcatgggatcttaactcatctaaaggtttccttctcaagagatgctcctgttggggaggaggaagccccagcaaagtatgtacaagacaacatccagcttcatggccagcaggtggcgagaatcctcctccaggagaacggccatatttatgtgtgtggagatgcaaagaatatggccaaggatgtacatgatgcccttgtgcaaataataagcaaagaggttggagttgaaaaactagaagcaatgaaaaccctggccactttaaaagaagaaaaacgctaccttcaggatatttggtcataaaaccagaaattaaagaaagaggattaagcttttttgactgaaagtactaaaagtcagctttactagtgccaaacctttaaattttcaaaagaaaattttctttcaacatttcttgaaggacatggagtggagattggatcatttaacaatataacaaaacttcctgatttgattttacgtatcttctatctacgcccttcctgtgcctgtgactctccccaaattgccctgttgccttgagctcttctgagctaaggcagccttcagtccctatcagcgcctcctttacttcccagagaacttcacagagactctgtccttccatgcaaaggcttcctgaaatagggagactgactgagtagctcattcttgtgacttacagtgccaacatttaaaaaagtatgaaaatgatttatttttatatgatgtatacccataaagaatgctcatattaatgtacttaaattacacatgtagagcatatctgttatatgtttatgtaactatcaaatggttatttgttactaaagctatatttctgataaaaaatattttaggataattgcctacagagggatttatttttatgatgctggaaatatgaaatgtattttaaaatttcactctggcatatgatttatctatcaccattactttttttaaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactaagcagtgtgctggacctaaaatactgactttagttagtatccttggatttttagattcccagtgtctaattccctgttataatttgcacaaacaaaacaaaatgttatgataatctttctccactgttctaatatatattgtatttttatttgatagcttgggatttaaaacatctctgttgaaggcttttgatccttttgagaaataaagatctgaaagaaatggca

SEQ ID NO: 408474 - DNA, 3045 bp, Homo sapiens
ggagctttctattggtcctgggtaccgagcatgggcgctgcgtcagtgcgcgctggcgcaaggttggtggaagtcgcgttgtgcaggttcgtgcccggctggcgcggcgtggtttcactgttacatgccttgaagtgatgaggaggtttctgttactatatgctacacagcagggacaggcaaaggccatcgcagaagaaatgtgtgagcaagctgtggtacatggattttctgcagatcttcactgtattagtgaatccgataaggtctcggtgattcagaatacacctacttttgcaatggggggaagataattgataaacgacttcaagagcttggagcccggcatttctatgacactggacatgcagatgactgtgtaggtttagaacttgtggttgagccgtggattgctggactctggccagccctcagaaagcattttaggtcaagcagaggacaagaggagataagtggcgcactcccggtggcatcacctgcatcctcgaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggaggaaagccaagtatctgtgacttcagcagatccagtttttcaagtgccaatttcaaaggcagttcaacttactacgaatgatgccataaaaaccactctgctggtagaattggacatttcaaatacagacttttcctatcagcctggagatgccttcagcgtgatctgccctaacagtgattctgaggtacaaagcctactccaaagactgcagcttgaagataaaagagagcactgcgtccttttgaaaataaaggcagacacaaagaagaaaggcatttttgcgagcccttgtggactataccagtgacagtgctgaaaagcgcaggctacaggagctgtgcagtaaacaaggggcagccgattatagccgctttgtacgagatgcctgtgcctgcttgttggatctcctcctcgctttcccttcttgccagccaccactcagtctcctgctcgaacatcttcctaaacttcaacccagaccatattcgtgtgcaagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaagatatccatctctcctcgaacaacaaattctttccacttaccagatgacccctcaatccccatcataatggtgggtccaggaaccggcatagccccgtttattgggttcctacaacatagagagaaactccaagaacaacacccagatggaaattttggagcaatgtggttgttttttggctgcaggcataaggatagggattatctattcagaaaagagctcagacatttccttaagcatgggatcttaactcatctaaaggtttccttctcaagagatgctcctgttggggaggaggaagccccagcaaagtatgtacaagacaacatccagcttcatggccagcaggtggcgagaatcctcctccaggagaacggccatatttatgtgtgtggagatgcaaagaatatggccaaggatgtacatgatgcccttgtgcaaataataagcaaagaggttggagttgaaaaactagaagcaatgaaaaccctggccactttaaaagaagaaaaacgctaccttcaggatatttggtcataaaaccagaaattaaagaaagaggattaagcttttttgactgaaagtactaaaagtcagctttactagtgccaaacctttaaattttcaaaagaaaattttctttcaacatttcttgaaggacatggagtggagattggatcatttaacaatataacaaaacttcctgatttgattttacgtatcttctatctacgcccttcctgtgcctgtgactctccccaaattgccctgttgccttgagctcttctgagctaaggcagccttcagtccctatcagcgcctcctttacttcccagagaacttcacagagactctgtccttccatgcaaaggcttcctgaaatagggagactgactgagtagctcattcttgtgacttacagtgccaacatttaaaaaagtatgaaaatgatttatttttatatgatgtatacccataaagaatgctcatattaatgtacttaaattacacatgtagagcatatctgttatatgtttatgtaactatcaaatggttatttgttactaaagctatatttctgataaaaaatattttaggataattgcctacagagggatttatttttatgatgctggaaatatgaaatgtattttaaaatttcactctggcatatgatttatctatcaccattactttttttaaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactaagcagtgtgctggacctaaaatactgactttagttagtatccttggatttttagattcccagtgtctaattccctgttataatttgcacaaacaaaacaaaatgttatgataatctttctccactgttctaatatatattgtatttttatttgatagcttgggatttaaaacatctctgttgaaggcttttgatccttttgagaaataaagatctgaaagaaatggca

SEQ ID NO: 408475 - DNA, 3286 bp, Homo sapiens
ggagctttctattggtcctgggtaccgagcatgggcgctgcgtcagtgcgcgctggcgcaaggttggtggaagtcgcgttgtgcaggttcgtgcccggctggcgcggcgtggtttcactgttacatgccttgaagtgatgaggaggtttctgttactatatgctacacagcagggacaggcaaaggccatcgcagaagaaatgtgtgagcaagctgtggtacatggattttctgcagatcttcactgtattagtgaatccgataaggtctcggtgattcagaatacacctacttttgcaatggggggaagataattgataaacgacttcaagagcttggagcccggcatttctatgacactggacatgcagatgactgtgtaggtttagaacttgtggttgagccgtggattgctggactctggccagccctcagaaagcattttaggtcaagcagaggacaagaggagataagtggcgcactcccggtggcatcacctgcatcctcgaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggaggaaagccaagtatctgtgacttcagcagatccagtttttcaagtgccaatttcaaaggcagttcaacttactacgaatgatgccataaaaaccactctgctggtagaattggacatttcaaatacagacttttcctatcagcctggagatgccttcagcgtgatctgccctaacagtgattctgaggtacaaagcctactccaaagactgcagcttgaagataaaagagagcactgcgtccttttgaaaataaaggcagacacaaagaagaaaggagctaccttaccccagcatatacctgcgggatgttctctccagttcatttttacctggtgtcttgaaatccgagcaattcctaaaaaggcatttttgcgagcccttgtggactataccagtgacagtgctgaaaagcgcaggctacaggagctgtgcagtaaacaaggggcagccgattatagccgctttgtacgagatgcctgtgcctgcttgttggatctcctcctcgctttcccttcttgccagccaccactcagtctcctgctcgtgttttttccacttaggacctccccaaaatggtaagaccgtgttgctgaatgaggctgctcttctcaccatcctgtcctcaggctggccctctcaccctcttcagtgaagtcttcgagaaccatcagcaggaataggatgacagaacacaggaacatcttcctaaacttcaacccagaccatattcgtgtgcaagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaagatatccatctctcctcgaacaacaaattctttccacttaccagatgacccctcaatccccatcataatggtgggtccaggaaccggcatagccccgtttattgggttcctacaacatagagagaaactccaagaacaacacccagatggaaattttggagcaatgtggttgttttttggctgcaggcataaggatagggattatctattcagaaaagagctcagacatttccttaagcatgggatcttaactcatctaaaggtttccttctcaagagatgctcctgttggggaggaggaagccccagcaaagtatgtacaagacaacatccagcttcatggccagcaggtggcgagaatcctcctccaggagaacggccatatttatgtgtgtggagatgcaaagaatatggccaaggatgtacatgatgcccttgtgcaaataataagcaaagaggttggagttgaaaaactagaagcaatgaaaaccctggccactttaaaagaagaaaaacgctaccttcaggatatttggtcataaaaccagaaattaaagaaagaggattaagcttttttgactgaaagtactaaaagtcagctttactagtgccaaacctttaaattttcaaaagaaaattttctttcaacatttcttgaaggacatggagtggagattggatcatttaacaatataacaaaacttcctgatttgattttacgtatcttctatctacgcccttcctgtgcctgtgactctccccaaattgccctgttgccttgagctcttctgagctaaggcagccttcagtccctatcagcgcctcctttacttcccagagaacttcacagagactctgtccttccatgcaaaggcttcctgaaatagggagactgactgagtagctcattcttgtgacttacagtgccaacatttaaaaaagtatgaaaatgatttatttttatatgatgtatacccataaagaatgctcatattaatgtacttaaattacacatgtagagcatatctgttatatgtttatgtaactatcaaatggttatttgttactaaagctatatttctgataaaaaatattttaggataattgcctacagagggatttatttttatgatgctggaaatatgaaatgtattttaaaatttcactctggcatatgatttatctatcaccattactttttttaaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactaagcagtgtgctggacctaaaatactgactttagttagtatccttggatttttagattcccagtgtctaattccctgttataatttgcacaaacaaaacaaaatgttatgataatctttctccactgttctaatatatattgtatttttatttgatagcttgggatttaaaacatctctgttgaaggcttttgatccttttgagaaataaagatctgaaagaaatggca

SEQ ID NO: 408476 - DNA, 2130 bp, Homo sapiens
atgtcatgaacccctttcccgtctttacctgaaaaggagctaccttaccccagcatatacctgcgggatgttctctccagttcatttttacctggtgtcttgaaatccgagcaattcctaaaaaggcatttttgcgagcccttgtggactataccagtgacagtgctgaaaagcgcaggctacaggagctgtgcagtaaacaaggggcagccgattatagccgctttgtacgagatgcctgtgcctgcttgttggatctcctcctcgctttcccttcttgccagccaccactcagtctcctgctcgaacatcttcctaaacttcaacccagaccatattcgtgtgcaagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaagatatccatctctcctcgaacaacaaattctttccacttaccagatgacccctcaatccccatcataatggtgggtccaggaaccggcatagccccgtttattgggttcctacaacatagagagaaactccaagaacaacacccagatggaaattttggagcaatgtggttgttttttggctgcaggcataaggatagggattatctattcagaaaagagctcagacatttccttaagcatgggatcttaactcatctaaaggtttccttctcaagagatgctcctgttggggaggaggaagccccagcaaagtatgtacaagacaacatccagcttcatggccagcaggtggcgagaatcctcctccaggagaacggccatatttatgtgtgtggagatgcaaagaatatggccaaggatgtacatgatgcccttgtgcaaataataagcaaagaggttggagttgaaaaactagaagcaatgaaaaccctggccactttaaaagaagaaaaacgctaccttcaggatatttggtcataaaaccagaaattaaagaaagaggattaagcttttttgactgaaagtactaaaagtcagctttactagtgccaaacctttaaattttcaaaagaaaattttctttcaacatttcttgaaggacatggagtggagattggatcatttaacaatataacaaaacttcctgatttgattttacgtatcttctatctacgcccttcctgtgcctgtgactctccccaaattgccctgttgccttgagctcttctgagctaaggcagccttcagtccctatcagcgcctcctttacttcccagagaacttcacagagactctgtccttccatgcaaaggcttcctgaaatagggagactgactgagtagctcattcttgtgacttacagtgccaacatttaaaaaagtatgaaaatgatttatttttatatgatgtatacccataaagaatgctcatattaatgtacttaaattacacatgtagagcatatctgttatatgtttatgtaactatcaaatggttatttgttactaaagctatatttctgataaaaaatattttaggataattgcctacagagggatttatttttatgatgctggaaatatgaaatgtattttaaaatttcactctggcatatgatttatctatcaccattactttttttaaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactaagcagtgtgctggacctaaaatactgactttagttagtatccttggatttttagattcccagtgtctaattccctgttataatttgcacaaacaaaacaaaatgttatgataatctttctccactgttctaatatatattgtatttttatttgatagcttgggatttaaaacatctctgttgaaggcttttgatccttttgagaaataaagatctgaaagaaatggca

SEQ ID NO: 408477 - DNA, 3377 bp, Homo sapiens
ggagctttctattggtcctgggtaccgagcatgggcgctgcgtcagtgcgcgctggcgcaaggttggtggaagtcgcgttgtgcaggttcgtgcccggctggcgcggcgtggtttcactgttacatgccttgaagtgatgaggaggtttctgttactatatgctacacagcagggacaggcaaaggccatcgcagaagaaatgtgtgagcaagctgtggtacatggattttctgcagatcttcactgtattagtgaatccgataaggtctcggtgattcagaatacacctacttttgcaatggggggaagataattgataaacgacttcaagagcttggagcccggcatttctatgacactggacatgcagatgactgtgtaggtttagaacttgtggttgagccgtggattgctggactctggccagccctcagaaagcattttaggtcaagcagaggacaagaggagataagtggcgcactcccggtggcatcacctgcatcctcgaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggaggaaagccaagtatctgtgacttcagcagatccagtttttcaagtgccaatttcaaaggcagttcaacttactacgaatgatgccataaaaaccactctgctggtagaattggacatttcaaatacagacttttcctatcagcctggagatgccttcagcgtgatctgccctaacagtgattctgaggtacaaagcctactccaaagactgcagcttgaagataaaagagagcactgcgtccttttgaaaataaaggcagacacaaagaagaaaggagctaccttaccccagcatatacctgcgggatgttctctccagttcatttttacctggtgtcttgaaatccgagcaattcctaaaaaggcatttttgcgagcccttgtggactataccagtgacagtgctgaaaagcgcaggctacaggagctgtgcagtaaacaaggggcagccgattatagccgctttgtacgagatgcctgtgcctgcttgttggatctcctcctcgctttcccttcttgccagccaccactcagtctcctgctcgaacatcttcctaaacttcaacccagaccatattcgtgtgcaagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaagatatccatctctcctcgaacaacaaattctttccacttaccagatgacccctcaatccccatcataatggtgggtccaggaaccggcatagccccgtttattgggttcctacaacatagagagaaactccaagaacaacacccagatggaaattttggagcaatgtggttgttttttggctgcaggcataaggatagggattatctattcagaaaagagctcagacatttccttaagcatgggatcttaactcatctaaaggtttccttctcaagagatgctcctgttggggaggaggaagccccagcaaagtatgtacaagacaacatccagcttcatggccagcaggtggcgagaatcctcctccaggagaacggccatatttatgtgtgtggagatgcaaagaatatggccaaggatgtacatgatgcccttgtgcaaataataagcaaagaggttggagttgaaaaactagaagcaatgaaaaccctggccactttaaaagaagaaaaacgctaccttcaggatatttggtcataaaaccagaaattaaagaaagaggattaagcttttttgactgaaagtactaaaagtcagctttactagtgccaaacctttaaattttcaaaagaaaattttctttcaacatttcttgaaggacatggagtggagattggatcatttaacaatataacaaaacttcctgatttgattttacgtatcttctatctacgcccttcctgtgcctgtgactctccccaaattgccctgttgccttgagctcttctgagctaaggcagccttcagtccctatcagcgcctcctttacttcccagagaacttcacagagactctgtccttccatgcaaaggcttcctgaaatagggagactgactgagtagctcattcttgtgacttacagtgccaacatttaaaaaagtatgaaaatgatttatttttatatgatgtatacccataaagaatgctcatattaatgtacttaaattacacatgtagagcatatctgttatatgtttatgtaactatcaaatggttatttgttactaaagctatatttctgataaaaaatattttaggataattgcctacagagggatttatttttatgatgctggaaatatgaaatgtattttaaaatttcactctggcatatgatttatctatcaccattactttttttaaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactaagcagtgtgctggacctaaaatactgactttagttagtatccttggatttttagattcccagtgtctaattccctgttataatttgcacaaacaaaacaaaatgttatgataatctttctccactgttctaatatatattgtatttttatttgatagcttgggatttaaaacatctctgttgaaggcttttgatccttttgagaaataaagatctgaaagaaatggcaaaaaaaaaaacacacaacataacaaaacaacttttttgggccgccttgggccctctaaaaggttttctaaacacccttgttttggcccgcgggcccagtgtgtgttcgttaaaccttggcaatagcgggggtccccagggagacccgggcctgacatgggtttgttttcccattaaaaccccggggcccggggtttgaccaactccggggttgggctacgggttacacgggcacgggctatag

SEQ ID NO: 408478 - DNA, 1802 bp, Homo sapiens
ggagctttctattggtcctgggtaccgagcatgggcgctgcgtcagtgcgcgctggcgcaaggttggtggaagtcgcgttgtgcaggttcgtgcccggctggcgcggcgtggtttcactgttacatgccttgaagtgatgaggaggtttctgttactatatgctacacagcagggacaggcaaaggccatcgcagaagaaatgtgtgagcaagctgtggtacatggattttctgcagatcttcactgtattagtgaatccgataaggtctcggtgattcagaatacacctacttttgcaatggggggaagataattgataaacgacttcaagagcttggagcccggcatttctatgacactggacatgcagatgactgtgtaggtttagaacttgtggttgagccgtggattgctggactctggccagccctcagaaagcattttaggtcaagcagaggacaagaggagataagtggcgcactcccggtggcatcacctgcatcctcgaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggaggaaagccaagtatctgtgacttcagcagatccagtttttcaagtgccaatttcaaaggcagttcaacttactacgaatgatgccataaaaaccactctgctggtagaattggacatttcaaatacagacttttcctatcagcctggagatgccttcagcgtgatctgccctaacagtgattctgaggtacaaagcctactccaaagactgcagcttgaagataaaagagagcactgcgtccttttgaaaataaaggcagacacaaagaagaaaggagctaccttaccccagcatatacctgcgggatgttctctccagttcatttttacctggtgtcttgaaatccgagcaattcctaaaaaggcatttttgcgagcccttgtggactataccagtgacagtgctgaaaagcgcaggctacaggagctgtgcagtaaacaaggggcagccgattatagccgctttgtacgagatgcctgtgcctgcttgttggatctcctcctcgctttcccttcttgccagccaccactcagtctcctgctcgaacatcttcctaaacttcaacccagaccatattcgtgtgcaagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaaggtaagaaattagtaccttaacctcagcattgttaactcatactctttgtttcattagaaaaaacagtgttgtctcacccacatcattcattactgtcataagaaaatttatgctgttcttgaattttaaaatctctattgcaagagcagaaaactgtttacttccatgtactctttaactagtgtgtgtattttctgaatgtataaagcatgaattttatatagtacggtctttgcttgtcctattcatggaaaagaagacc

SEQ ID NO: 408479 - DNA, 534 bp, Homo sapiens
tctgagcaagtccagatcgagggtccttcaagagcaaaaggggactgtgtcgtaccagtgcaaatcaacatactcatggtactgccaggcagagaaccatcatcccatttcagatgaagagtaacccatttttttgcccagagtgactcttctagtcctcatactccaacagaagagacctcagcattgtccctgagcagtcgatgtcctaggacctctctgtggctctcaggaagggattgaaaatgcttgctaggggtgaagactaagcgctttataggacttcaaagcctttattactttcttgtgcttgtaactttgtcatctcctttcccatagtggtaagtagttatgcctttaacatttgcatttttctttggtgacaccaaaatgtatattgtcctttttactcttgggccagcaagatccttttcgatgcccagtacaattaaaggcacccttctttgcaagtcagggcctgatttctcctcctttttcttagtgttttttccacttaggacctccccaaaatgg

SEQ ID NO: 408480 - DNA, 3288 bp, Homo sapiens
ggagctttctattggtcctgggtaccgagcatgggcgctgcgtcagtgcgcgctggcgcaaggttggtggaagtcgcgttgtgcaggttcgtgcccggctggcgcggcgtggtttcactgttacatgccttgaagtgatgaggaggtttctgttactatatgctacacagcagggacaggcaaaggccatcgcagaagaaatgtgtgagcaagctgtggtacatggattttctgcagatcttcactgtattagtgaatccgataagtatgacctaaaaaccgaaacagctcctcttgttgttgtggtttctaccacgggcaccggagacccacccgacacagcccgcaagtttgttaaggaaatacagaaccaaacactgccggttgatttctttgctcacctgcggtatgggttactgggtctcggtgattcagaatacacctacttttgcaatggggggaagataattgataaacgacttcaagagcttggagcccggcatttctatgacactggacatgcagatgactgtgtaggtttagaacttgtggttgagccgtggattgctggactctggccagccctcagaaagcattttaggtcaagcagaggacaagaggagataagtggcgcactcccggtggcatcacctgcatcctcgaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggaggaaagccaagtatctgtgacttcagcagatccagtttttcaagtgccaatttcaaaggcagttcaacttactacgaatgatgccataaaaaccactctgctggtagaattggacatttcaaatacagacttttcctatcagcctggagatgccttcagcgtgatctgccctaacagtgattctgaggtacaaagcctactccaaagactgcagcttgaagataaaagagagcactgcgtccttttgaaaataaaggcagacacaaagaagaaaggagctaccttaccccagcatatacctgcgggatgttctctccagttcatttttacctggtgtcttgaaatccgagcaattcctaaaaaggcatttttgcgagcccttgtggactataccagtgacagtgctgaaaagcgcaggctacaggagctgtgcagtaaacaaggggcagccgattatagccgctttgtacgagatgcctgtgcctgcttgttggatctcctcctcgctttcccttcttgccagccaccactcagtctcctgctcgaacatcttcctaaacttcaacccagaccatattcgtgtgcaagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaagatatccatctctcctcgaacaacaaattctttccacttaccagatgacccctcaatccccatcataatggtgggtccaggaaccggcatagccccgtttattgggttcctacaacatagagagaaactccaagaacaacacccagatggaaattttggagcaatgtggttgttttttggctgcaggcataaggatagggattatctattcagaaaagagctcagacatttccttaagcatgggatcttaactcatctaaaggtttccttctcaagagatgctcctgttggggaggaggaagccccagcaaagtatgtacaagacaacatccagcttcatggccagcaggtggcgagaatcctcctccaggagaacggccatatttatgtgtgtggagatgcaaagaatatggccaaggatgtacatgatgcccttgtgcaaataataagcaaagaggttggagttgaaaaactagaagcaatgaaaaccctggccactttaaaagaagaaaaacgctaccttcaggatatttggtcataaaaccagaaattaaagaaagaggattaagcttttttgactgaaagtactaaaagtcagctttactagtgccaaacctttaaattttcaaaagaaaattttctttcaacatttcttgaaggacatggagtggagattggatcatttaacaatataacaaaacttcctgatttgattttacgtatcttctatctacgcccttcctgtgcctgtgactctccccaaattgccctgttgccttgagctcttctgagctaaggcagccttcagtccctatcagcgcctcctttacttcccagagaacttcacagagactctgtccttccatgcaaaggcttcctgaaatagggagactgactgagtagctcattcttgtgacttacagtgccaacatttaaaaaagtatgaaaatgatttatttttatatgatgtatacccataaagaatgctcatattaatgtacttaaattacacatgtagagcatatctgttatatgtttatgtaactatcaaatggttatttgttactaaagctatatttctgataaaaaatattttaggataattgcctacagagggatttatttttatgatgctggaaatatgaaatgtattttaaaatttcactctggcatatgatttatctatcaccattactttttttaaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactaagcagtgtgctggacctaaaatactgactttagttagtatccttggatttttagattcccagtgtctaattccctgttataatttgcacaaacaaaacaaaatgttatgataatctttctccactgttctaatatatattgtatttttatttgatagcttgggatttaaaacatctctgttgaaggcttttgatccttttgagaaataaagatctgaaagaaatggca

SEQ ID NO: 408481 - DNA, 3134 bp, Homo sapiens
ggagctttctattggtcctgggtaccgagcatgggcgctgcgtcagtgcgcgctggcgcaaggttggtggaagtcgcgttgtgcaggttcgtgcccggctggcgcggcgtggtttcactgttacatgccttgaagtgatgaggaggtttctgttactatatgctacacagcagggacaggcaaaggccatcgcagaagaaatgtgtgagcaagctgtggtacatggattttctgcagatcttcactgtattagtgaatccgataaggtctcggtgattcagaatacacctacttttgcaatggggggaagataattgataaacgacttcaagagcttggagcccggcatttctatgacactggacatgcagatgactgtgtaggtttagaacttgtggttgagccgtggattgctggactctggccagccctcagaaagcattttaggtcaagcagaggacaagaggagataagtggcgcactcccggtggcatcacctgcatcctcgaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggaggaaagccaagtatctgtgacttcagcagatccagtttttcaagtgccaatttcaaaggcagttcaacttactacgaatgatgccataaaaaccactctgctggtagaattggacatttcaaatacagacttttcctatcagcctggagatgccttcagcgtgatctgccctaacagtgattctgaggtacaaagcctactccaaagactgcagcttgaagataaaagagagcactgcgtccttttgaaaataaaggcagacacaaagaagaaaggagctaccttaccccagcatatacctgcgggatgttctctccagttcatttttacctggtgtcttgaaatccgagcaattcctaaaaaggcatttttgcgagcccttgtggactataccagtgacagtgctgaaaagcgcaggctacaggagctgtgcagtaaacaaggggcagccgattatagccgctttgtacgagatgcctgtgcctgcttgttggatctcctcctcgctttcccttcttgccagccaccactcagtctcctgctcgaacatcttcctaaacttcaacccagaccatattcgtgtgcaagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaagatatccatctctcctcgaacaacaaattctttccacttaccagatgacccctcaatccccatcataatggtgggtccaggaaccggcatagccccgtttattgggttcctacaacatagagagaaactccaagaacaacacccagatggaaattttggagcaatgtggttgttttttggctgcaggcataaggatagggattatctattcagaaaagagctcagacatttccttaagcatgggatcttaactcatctaaaggtttccttctcaagagatgctcctgttggggaggaggaagccccagcaaagtatgtacaagacaacatccagcttcatggccagcaggtggcgagaatcctcctccaggagaacggccatatttatgtgtgtggagatgcaaagaatatggccaaggatgtacatgatgcccttgtgcaaataataagcaaagaggttggagttgaaaaactagaagcaatgaaaaccctggccactttaaaagaagaaaaacgctaccttcaggatatttggtcataaaaccagaaattaaagaaagaggattaagcttttttgactgaaagtactaaaagtcagctttactagtgccaaacctttaaattttcaaaagaaaattttctttcaacatttcttgaaggacatggagtggagattggatcatttaacaatataacaaaacttcctgatttgattttacgtatcttctatctacgcccttcctgtgcctgtgactctccccaaattgccctgttgccttgagctcttctgagctaaggcagccttcagtccctatcagcgcctcctttacttcccagagaacttcacagagactctgtccttccatgcaaaggcttcctgaaatagggagactgactgagtagctcattcttgtgacttacagtgccaacatttaaaaaagtatgaaaatgatttatttttatatgatgtatacccataaagaatgctcatattaatgtacttaaattacacatgtagagcatatctgttatatgtttatgtaactatcaaatggttatttgttactaaagctatatttctgataaaaaatattttaggataattgcctacagagggatttatttttatgatgctggaaatatgaaatgtattttaaaatttcactctggcatatgatttatctatcaccattactttttttaaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactaagcagtgtgctggacctaaaatactgactttagttagtatccttggatttttagattcccagtgtctaattccctgttataatttgcacaaacaaaacaaaatgttatgataatctttctccactgttctaatatatattgtatttttatttgatagcttgggatttaaaacatctctgttgaaggcttttgatccttttgagaaataaagatctgaaagaaatggca

SEQ ID NO: 408482 - DNA, 2721 bp, Homo sapiens
  misc_feature (16)..(16): n is a, c, g, or t
  misc_feature (28)..(28): n is a, c, g, or t
  misc_feature (36)..(36): n is a, c, g, or t
  misc_feature (41)..(41): n is a, c, g, or t
  misc_feature (44)..(44): n is a, c, g, or t
ttgtctcttgaggatncacagcgagcangataccanctggnganggacaagaggagataagtggcgcactcccggtggcatcacctgcatcctcgaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggaggaaagccaagtatctgtgacttcagcagatccagtttttcaagtgccaatttcaaaggcagttcaacttactacgaatgatgccataaaaaccactctgctggtagaattggacatttcaaatacagacttttcctatcagcctggagatgccttcagcgtgatctgccctaacagtgattctgaggtacaaagcctactccaaagactgcagcttgaagataaaagagagcactgcgtccttttgaaaataaaggcagacacaaagaagaaaggagctaccttaccccagcatatacctgcgggatgttctctccagttcatttttacctggtgtcttgaaatccgagcaattcctaaaaaggcatttttgcgagcccttgtggactataccagtgacagtgctgaaaagcgcaggctacaggagctgtgcagtaaacaaggggcagccgattatagccgctttgtacgagatgcctgtgcctgcttgttggatctcctcctcgctttcccttcttgccagccaccactcagtctcctgctcgaacatcttcctaaacttcaacccagaccatattcgtgtgcaagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaagatatccatctctcctcgaacaacaaattctttccacttaccagatgacccctcaatccccatcataatggtgggtccaggaaccggcatagccccgtttattgggttcctacaacatagagagaaactccaagaacaacacccagatggaaattttggagcaatgtggttgttttttggctgcaggcataaggatagggattatctattcagaaaagagctcagacatttccttaagcatgggatcttaactcatctaaaggtttccttctcaagagatgctcctgttggggaggaggaagccccagcaaagtatgtacaagacaacatccagcttcatggccagcaggtggcgagaatcctcctccaggagaacggccatatttatgtgtgtggagatgcaaagaatatggccaaggatgtacatgatgcccttgtgcaaataataagcaaagaggttggagttgaaaaactagaagcaatgaaaaccctggccactttaaaagaagaaaaacgctaccttcaggatatttggtcataaaaccagaaattaaagaaagaggattaagcttttttgactgaaagtactaaaagtcagctttactagtgccaaacctttaaattttcaaaagaaaattttctttcaacatttcttgaaggacatggagtggagattggatcatttaacaatataacaaaacttcctgatttgattttacgtatcttctatctacgcccttcctgtgcctgtgactctccccaaattgccctgttgccttgagctcttctgagctaaggcagccttcagtccctatcagcgcctcctttacttcccagagaacttcacagagactctgtccttccatgcaaaggcttcctgaaatagggagactgactgagtagctcattcttgtgacttacagtgccaacatttaaaaaagtatgaaaatgatttatttttatatgatgtatacccataaagaatgctcatattaatgtacttaaattacacatgtagagcatatctgttatatgtttatgtaactatcaaatggttatttgttactaaagctatatttctgataaaaaatattttaggataattgcctacagagggatttatttttatgatgctggaaatatgaaatgtattttaaaatttcactctggcatatgatttatctatcaccattactttttttaaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactaagcagtgtgctggacctaaaatactgactttagttagtatccttggatttttagattcccagtgtctaattccctgttataatttgcacaaacaaaacaaaatgttatgataatctttctccactgttctaatatatattgtatttttatttgatagcttgggatttaaaacatctctgttgaaggcttttgatccttttgagaaataaagatctgaaagaaatggca

SEQ ID NO: 408483 - DNA, 2197 bp, Homo sapiens
gtggaatttttctaacaggtcaacattaaagcaaatggtaaattaaattccctcctcctgacaatagctcctagtggctttctcattttttcttgggtaattgggtgcatccctaggcagacatttaactgaatattctaatagctctacccacaaattgtgtcacaatttaaggcgggctcctttttgtaggcatttttgcgagcccttgtggactataccagtgacagtgctgaaaagcgcaggctacaggagctgtgcagtaaacaaggggcagccgattatagccgctttgtacgagatgcctgtgcctgcttgttggatctcctcctcgctttcccttcttgccagccaccactcagtctcctgctcgaacatcttcctaaacttcaacccagaccatattcgtgtgcaagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaagatatccatctctcctcgaacaacaaattctttccacttaccagatgacccctcaatccccatcataatggtgggtccaggaaccggcatagccccgtttattgggttcctacaacatagagagaaactccaagaacaacacccagatggaaattttggagcaatgtggttgttttttggctgcaggcataaggatagggattatctattcagaaaagagctcagacatttccttaagcatgggatcttaactcatctaaaggtttccttctcaagagatgctcctgttggggaggaggaagccccagcaaagtatgtacaagacaacatccagcttcatggccagcaggtggcgagaatcctcctccaggagaacggccatatttatgtgtgtggagatgcaaagaatatggccaaggatgtacatgatgcccttgtgcaaataataagcaaagaggttggagttgaaaaactagaagcaatgaaaaccctggccactttaaaagaagaaaaacgctaccttcaggatatttggtcataaaaccagaaattaaagaaagaggattaagcttttttgactgaaagtactaaaagtcagctttactagtgccaaacctttaaattttcaaaagaaaattttctttcaacatttcttgaaggacatggagtggagattggatcatttaacaatataacaaaacttcctgatttgattttacgtatcttctatctacgcccttcctgtgcctgtgactctccccaaattgccctgttgccttgagctcttctgagctaaggcagccttcagtccctatcagcgcctcctttacttcccagagaacttcacagagactctgtccttccatgcaaaggcttcctgaaatagggagactgactgagtagctcattcttgtgacttacagtgccaacatttaaaaaagtatgaaaatgatttatttttatatgatgtatacccataaagaatgctcatattaatgtacttaaattacacatgtagagcatatctgttatatgtttatgtaactatcaaatggttatttgttactaaagctatatttctgataaaaaatattttaggataattgcctacagagggatttatttttatgatgctggaaatatgaaatgtattttaaaatttcactctggcatatgatttatctatcaccattactttttttaaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactaagcagtgtgctggacctaaaatactgactttagttagtatccttggatttttagattcccagtgtctaattccctgttataatttgcacaaacaaaacaaaatgttatgataatctttctccactgttctaatatatattgtatttttatttgatagcttgggatttaaaacatctctgttgaaggcttttgatccttttgagaaataaagatctgaaagaaatggca

SEQ ID NO: 408484 - DNA, 1844 bp, Homo sapiens
ggagctttctattggtcctgggtaccgagcatgggcgctgcgtcagtgcgcgctggcgcaaggttggtggaagtcgcgttgtgcaggttcgtgcccggctggcgcggcgtggtttcactgttacatgccttgaagtgatgaggaggtttctgttactatatgctacacagcagggacaggcaaaggccatcgcagaagaaatgtgtgagcaagctgtggtacatggattttctgcagatcttcactgtattagtgaatccgataaggtctcggtgattcagaatacacctacttttgcaatggggggaagataattgataaacgacttcaagagcttggagcccggcatttctatgacactggacatgcagatgactgtgtaggtttagaacttgtggttgagccgtggattgctggactctggccagccctcagaaagcattttaggtcaagcagaggacaagaggagataagtggcgcactcccggtggcatcacctgcatcctcgaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggaggaaagccaagtatctgtgacttcagcagatccagtttttcaagtgccaatttcaaaggcagttcaacttactacgaatgatgccataaaaaccactctgctggtagaattggacatttcaaatacagacttttcctatcagcctggagatgccttcagcgtgatctgccctaacagtgattctgaggtacaaagcctactccaaagactgcagcttgaagataaaagagagcactgcgtccttttgaaaataaaggcagacacaaagaagaaaggagctaccttaccccagcatatacctgcgggatgttctctccagttcatttttacctggtgtcttgaaatccgagcaattcctaaaaaggcatttttgcgagcccttgtggactataccagtgacagtgctgaaaagcgcaggctacaggagctgtgcagtaaacaaggggcagccgattatagccgctttgtacgagatgcctgtgcctgcttgttggatctcctcctcgctttcccttcttgccagccaccactcagtctcctgctcgtgttttttccacttaggacctccccaaaatggtaagaccgtgttgctgaatgaggctgctcttctcaccatcctgtcctcaggctggccctctcaccctcttcagtgaagtcttcgagaaccatcagcaggaataggatgacagaacacaggaacatcttcctaaacttcaacccagaccatattcgtgtgcaagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaagattgtggacactttacacttggactcagtgacatctttttatgttttgatacggcactcagcagaatttcgagaccacgtgtgtaggcaacagtttaaagttgtccacaagaatggttgaaataaagcaacatttcaggctttatcatgaag

SEQ ID NO: 408485 - DNA, 1486 bp, Homo sapiens
ggagctttctattggtcctgggtaccgagcatgggcgctgcgtcagtgcgcgctggcgcaaggttggtggaagtcgcgttgtgcaggttcgtgcccggctggcgcggcgtggtttcactgttacatgccttgaagtgatgaggaggtttctgttactatatgctacacagcagggacaggcaaaggccatcgcagaagaaatgtgtgagcaagctgtggtacatggattttctgcagatcttcactgtattagtgaatccgataaggtctcggtgattcagaatacacctacttttgcaatggggggaagataattgataaacgacttcaagagcttggagcccggcatttctatgacactggacatgcagatgactgtgtaggtttagaacttgtggttgagccgtggattgctggactctggccagccctcagaaagcattttaggtcaagcagaggacaagaggagataagtggcgcactcccggtggcatcacctgcatcctcgaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggaggaaagccaagtatctgtgacttcagcagatccagtttttcaagtgccaatttcaaaggcagttcaacttactacgaatgatgccataaaaaccactctgctggtagaattggacatttcaaatacagacttttcctatcagcctggagatgccttcagcgtgatctgccctaacagtgattctgaggtacaaagcctactccaaagactgcagcttgaagataaaagagagcactgcgtccttttgaaaataaaggcagacacaaagaagaaaggagctaccttaccccagcatatacctgcgggatgttctctccagttcatttttacctggtgtcttgaaatccgagcaattcctaaaaaggtatttttttctgtcttcttcaggtaactattttaaaatatgcttagctttatttaggattgattaaacaaatttagaatatgccctttgcagtcttaaaaaatgtgatcttgatagcatgtttttaatattagttcccaagggtgtgtgctatcatcgtaactatcatctatgaatctttttatgttgtatttgcatttaaatttttgttttctattgaaatgagggcttaaatagggctttttcttagtctaaatagggctttttctttgtcttacttttactagttattaactacgtagcacattccacagtgatggaggtgactgcagttgaccttgtgttacccagctacac

SEQ ID NO: 408486 - DNA, 498 bp, Homo sapiens
agctcggtacctctatccacactggaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcagtgagtctttgtggtttgctttctgcagactgtgcaagctcccagctgttccttcttctgctgtccctagccaacaaacacagtggcatttacaacttttggcatatagaaattatatgtaaaaattcaggtagtactatttcttttagtcctgttagtctctttctctctatatatatatgtatctctggacatgcatctctggttatatcttgaggcttttgctgcaactaaagtgaattcctggtttccc

SEQ ID NO: 408487 - DNA, 7913 bp, Homo sapiens
tattgttcggtgttctgctctggcggcagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408488 - DNA, 7825 bp, Homo sapiens
tattgttcggtgttctgctctggcggcagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408489 - DNA, 7896 bp, Homo sapiens
cacgaggattccagtcccgttatgtttcagcagaaatcaaggtagacgaagtaacctcttgtcctgaattttcatagttgctcattcttaataatggcagcagaagcaacaatgagagcaactacctcctcagctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408490 - DNA, 8532 bp, Homo sapiens
tattgttcggtgttctgctctggcggcagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaaaaaaaaagcaaagtagaaacataaacaatgggaagtaataaacaatgttaaagatagaacctagcaagaaaaaattaatggaactttacgaaatgaataactgaataagcggatgaggctaataaaagactttggatcaaaggtatggtaagagagtgattcagaaggcactgaaagagatggaacagtacggagtggctagagaagaactcaaaggagcctgccatgttgtggaactcacatagagaaatcaacggatgtacagatgacatgtacgtggctgtagtgccaaaaatttcgtggccgggatagagcatggggtaacacactattagaagtcaagccgcttagaaaacactcgcaaagtaacactgggtcaaccaggtactaaacgggctagactaagccgcggatgaagaacacgaaacacgaacgcagtgagcgtatcacaccagatcacgatagcacagaacagagaactgaagcatcaacacaaaatacggcaggaacaaaacacagcggacttcgggacaacaacccactcgggaaaacggcaaaaaataaaagcgaggacacgacaccaagaacaaacacgacaacacaaaacacaagaagaaca

SEQ ID NO: 408491 - DNA, 7956 bp, Homo sapiens
acatactttgaaaataacagctcttttttgttccctcgtgtgtctcttcccaattgtatccctattgtattttctcatagtatgtttcagcagaaatcaaggtagacgaagtaacctcttgtcctgaattttcatagttgctcattcttaataatggcagcagaagcaacaatgagagcaactacctcctcagctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408492 - DNA, 7846 bp, Homo sapiens
gagagtgaggtgatggctgcgtttaagttggatttccttccagaaatgatggtggatcattgctctttgaattccagtcccgtctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408493 - DNA, 8011 bp, Homo sapiens
tattgttcggtgttctgctctggcggcagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaatctaaaactaggaacagcatctcaaggcagaagaatttttcttagtacagaacaaatggagtttcttatgtcttcttcttagcatagacacagtaacg

SEQ ID NO: 408494 - DNA, 8041 bp, Homo sapiens
tattgttcggtgttctgctctggcggcagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaatctcaaactaggtggagacattttccatatcgtcttggcaattaacatcttgactactggttacttatgcatatttctgcagcccgcgtgaatttctcccccagcaaatggatttttttttctaccac

SEQ ID NO: 408495 - DNA, 8008 bp, Homo sapiens
  misc_feature (7973)..(7973): n is a, c, g, or t
tattgttcggtgttctgctctggcggcagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaatctaaaactaggcattgctgcctgggggttctggttctatgtgctattgaaacttctaanactaggggtaccggctcgattcgatctgtcccggt

SEQ ID NO: 408496 - DNA, 7969 bp, Homo sapiens
  misc_feature (7934)..(7934): n is a, c, g, or t
tattgttcggtgttctgctctggcggcagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaatgtgctattgaaacttctaanactaggggtaccggctcgattcgatctgtcccggt

SEQ ID NO: 408497 - DNA, 7823 bp, Homo sapiens
tattgttcggtgttctgctctggcggcagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggtagacagactggccgagctc

SEQ ID NO: 408498 - DNA, 7741 bp, Homo sapiens
ggccggtatgagtcactgccagcccgcaatgtgagtgtgagaataaatcacgtggcgggggctgggggggaggtgcgaaggtttttctgacctcccacacaggcagccccagaagcagagggaatccccaggatgtaccattggacctggatgaataaatagactgtccatcttggaggagatgcaggggcaacagttcttacaggactggcacagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408499 - DNA, 7040 bp, Homo sapiens
atatgaagcacccttatctgctggctaatctcttgctttggatgttgtagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408500 - DNA, 7765 bp, Homo sapiens
tattgttcggtgttctgctctggcggcagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctcctaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408501 - DNA, 7295 bp, Homo sapiens
tattgttcggtgttctgctctggcggcagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaactcgtgccgaatcctgcagccc

SEQ ID NO: 408502 - DNA, 7299 bp, Homo sapiens
tattgttcggtgttctgctctggcggcagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaattcttactcgagactagttcgctctc

SEQ ID NO: 408503 - DNA, 6613 bp, Homo sapiens
acttccggatctttgcgaatcgtggtgctgctgcaagccagttaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408504 - DNA, 6278 bp, Homo sapiens
tattgttcggtgttctgctctggcggcagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408505 - DNA, 7275 bp, Homo sapiens
tattgttcggtgttctgctctggcggcagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctccactcccgggagtggagagagaaaggtggagagatgtagctaggggctggggagggggaggtggaagcgctattgagcatcctccacatcacccatctccact

SEQ ID NO: 408506 - DNA, 6661 bp, Homo sapiens
tattgttcggtgttctgctctggcggcagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408507 - DNA, 6848 bp, Homo sapiens
tattgttcggtgttctgctctggcggcagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgcagaaaggatcgaacgatacctcagggggtggttttaggactagctgtataacatgacggaaaagagatccctggagaaactaaattaggggatgtggaccccttatgatagtttatcagagcaatctaagaaatcatgtaggcctctaagaaagcatcaagaatcaatgcaatttgattaatggacttaaaata

SEQ ID NO: 408508 - DNA, 4323 bp, Homo sapiens
  misc_feature (14)..(14): n is a, c, g, or t
tcgatcgagctcgnaccgggagtggagagagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408509 - DNA, 4221 bp, Homo sapiens
ggacgcgtgggtcgaccacgcgtacgggaccgcaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408510 - DNA, 4789 bp, Homo sapiens
tattgttcggtgttctgctctggcggcagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtccagactgagtggcaagtgattgttccccgct

SEQ ID NO: 408511 - DNA, 3896 bp, Homo sapiens
taatcagctcgccctgtaacatctatggcaagtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408512 - DNA, 3296 bp, Homo sapiens
agacggtcagatctgagcctggattcgatgtacgatagactctagagcagtctcgacgatcccagaatttagcgtgaatcagcgagtctgcctgtagattttatgctcctttgacaaacttcgtgactggaaaacctctgcgcacgagtataatacactaaacaggtgtacgggacgagttcgtgatgtgaaacctgtaatatcgctatgtgccttccgctcctactgatggctttcagattggcatgaagcggcttaaagtgcagctcaaacgttcgaagaatgacagcaagccctactgagcgtgctcccctctgagactggagtgagagggtcttctgattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408513 - DNA, 3170 bp, Homo sapiens
gccgtttgcaaccagtactgccaaggggaaggtgtaatgctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408514 - DNA, 3270 bp, Homo sapiens
cacgaggattccagtcccgttatgtttcagcagaaatcaaggtagacgaagtaacctcttgtcctgaattttcatagttgctcattcttaataatggcagcagaagcaacaatgagagcaactacctcctcagctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408515 - DNA, 2109 bp, Homo sapiens
tgatacgatcgagccggtaccgaatctcgaaattttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408516 - DNA, 2078 bp, Homo sapiens
ccggccattcaaacgcgattctcatgctgacttacctaactgccaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408517 - DNA, 2003 bp, Homo sapiens
aacgctaggtagaggcggtggcggattaaagggttcaagagcgtttaatgtgtaggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408518 - DNA, 1425 bp, Homo sapiens
ctagaggacccctcggtctaccttgttttcagacctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408519 - DNA, 1201 bp, Homo sapiens
tcagtcggtccgcgtaatccgtacagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408520 - DNA, 1262 bp, Homo sapiens
cactcagtttacacaaactatagaaaacagagaggtgaaggtgatatatacgaaggtgtgaagaaacagcaggaaacatgcaaaacttttttctgggcatatcttagcaggaaaggaaaaaattcaaaacaaaaacacaaaaacaatacaaaaacaaaaacaacaacaaaaaaatcaaagcatcacattttgctgtggagactgttggaacaagcatggggcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408521 - DNA, 1259 bp, Homo sapiens
ggacgcgtgggtcgccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgtaggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgtaactgtctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408522 - DNA, 530 bp, Homo sapiens
ttcgagttcggtacccaatcagtttacacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408523 - DNA, 695 bp, Homo sapiens
cacgaggattccagtcccgttatgtttcagcagaaatcaaggtagacgaagtaacctcttgtcctgaattttcatagttgctcattcttaataatggcagcagaagcaacaatgagagcaactacctcctcagctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttcgacatttactaacaagagcatggacagacggcataaggcatgcacatagcagaccgggatctgtagagtcacctgagatgcaagtgactgtttat

SEQ ID NO: 408524 - DNA, 271 bp, Homo sapiens
aaggtaatggggagcacaacacccgcgtatggcatttcttaatgtccccattagcaaggcctggtgaatgtcctgaaatctagccagtcagatagtttcttctcagggagaaactaagagggagataaaggggagaactttggagttttccctcttctagatgtcccaagtagacttgtctttggcatcagtttagtctttctagtatattaatccttctcttcctccaaccaaggaatggctgctttaaatggtggcctgggcagcagtg

SEQ ID NO: 408525 - DNA, 410 bp, Homo sapiens
tgagaggggaaaagaaaggagaaagagaagagagtgttcaagaattttgaacaaatacatactttgaaaataacagctcttttttgttccctcgtgtgtctcttcccaattgtatccctattgtattttctcatagtatgtttcagcagaaatcaaggtagacgaagtaacctcttgtcctgaattttcatagttgctcattcttaataatggcagcagaagcaacaatgagagcaactacctcctcaggtattactattactgcttctgctgccagtagtagaaacataaaaagagagggggtaggtttcatccctttcccctaaaacacttgccactttctgatcttcctcctcttcacattcttgcaggccctgatttgcctttcttctatcctgttcccaggtcag

SEQ ID NO: 408526 - DNA, 4615 bp, Homo sapiens
tattgttcggtgttctgctctggcggcagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctgattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408527 - DNA, 5083 bp, Homo sapiens
acttccggatctttgcgaatcgtggtgctgctgcaagccagttaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggcacagcttgccctgaagactcggctactgccttctgtgggagtttcgcttcgtacagaggacaagtttgtgctttggtttccagtgttttactttggagtttaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408528 - DNA, 4209 bp, Homo sapiens
tattgttcggtgttctgctctggcggcagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgtctagggggatctctagatacc

SEQ ID NO: 408529 - DNA, 2965 bp, Homo sapiens
tattgttcggtgttctgctctggcggcagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 408530 - DNA, 1100 bp, Homo sapiens
tattgttcggtgttctgctctggcggcagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcagtgagtctttgtggtttgctttctgcagactgtgcaagctcccagctgttccttcttctgctgtccctagccaacaaacacagtggcatttacaacttttggcatatagaaattatatgtaaaaattcaggtagtactatttcttttagtcctgttagtctctttctctctatatatatatgtatctctggacatgcatctctggttatatcttgaggcttttgctgcaactaaagtgaattcctggtttccc

SEQ ID NO: 408531 - DNA, 706 bp, Homo sapiens
tcgtgccgaattcggcagagtcatggttatactcatgacagtcgggctgtgaagtttttgtttgagattctcagtagttttgataatgagcagcagaggttatttctccagtttgtgactggtagcccaagattgcctgttggaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtaggaaaaacggcttgcagattataaagagacatttggttgatattcattaatggccccatggacttaaagtgatcaggccctaaaacgttgttgtgatgaggtttctttagcaagttcttgtttaaattatcatttatttgatgagtgaagtttttaacatgctttgctgtgtgaaatttaaaaaagggatgtttttccaggctggaacaataaatgtggctgtgcagtttttaaaaaaaaagaaattcttcaat

SEQ ID NO: 408532 - DNA, 631 bp, Homo sapiens
gtaccatggggaaaactgcttattttgttaaaaaaatttttttccctttgttgttttacgtttttgttcatagtcttctttattccacgctcctcttccccttctcccagtgctgacttgggacaaaacagttcagcctttgtctcgacgcagataaaagcacctgtaagcaatgctgtccagtcattttatgtgctgatttctcaaatctgcaataatccatcaggttaatgtttttacctgaaaataaagaaagtttgcttcacctttttgtttatagttttgtgctgtatgcataactttcaattgtatagatgtatttcaatgcaaggaaatccacatatctccatgattcgggtcatggctgattttgctattcaaacaatttataatagcaacttgaagaaactaaaatgtgaagagaaaatgggaggagattccttcctaaggtccaaaactaggcctgtggcataaatttgaaggaattttccataattcatctccttgaaaataagagatgagctagtttttttttttaattgaactttgagaaatcaatttttttgactgttctgtaagttttaattaattgacacaaaagcccttttccctatcccaccacccaaaagaa

SEQ ID NO: 408533 - DNA, 704 bp, Homo sapiens
ggtcgatctctagcaggatccccaattccagaccaaagagagtctacagtatgcattagaaaccttgactatgaatggctgctcagttgaagatctaggactggatttcactctgccagggtttcccaatatcgaactgaagaaaggagggaaggatataccagtcactatccacaatttagaggagtatctaagagtatgtaactgtgtctttggggggtaggccagttgtgaagacggaggactttgcctgattgtaccttgcttctggctgcacacgctatggcttgagaccttccacatccccaggaccactgcatgaaggctgctttacaaggcactagcttctctttgctcttgagtgcacatatcagatatttcctgtcttatataaccttgaattatttctcctcaggcttgaatgctatctaattacaccacgttttcttagtttaaaaaacaagtgaaaagagacattatttgtgttctcactaaattgcatttttgcatttccatcaaggcagctagcttgacagaatttactccaggcaccgtgcagtgcacacttttatgtttggtgacacctttcaaattactaacttatgggcgaggtgcagtggctcacgcctgtaatcctcccagcactttgtgaggcagaagcaggaggattacttgaggccagtagttcaagaccagcctgggca

SEQ ID NO: 408534 - DNA, 309 bp, Homo sapiens
tcagaacctataaaacccaatgaaaacagtatgatttttattagttcccaaaagtgaaaaccaaaccaaacaggccagacataatgtgtttaagtgctcctcctaaccctcatctttcccctccaccccaagcctctagttctgttgcaggggctgttggcatgaccacctctggggagagtgaatcagatgattccgagatgggacgtttgcaaggtaaaaacagttattgagcctataagaaaccattaccatgagctacctgttaataccattctttattgaaattaatttagttaaattcatttg

SEQ ID NO: 408535 - DNA, 7698 bp, Homo sapiens
gtgctgcggctcagctgataattgaaggaacccggagccgccgccgccgcgccgctggggggggtggggggagctagtggaagttactgccgcgccaccgagtccggaccggagactttggggcctaactagtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaagaaaaaggacagagagttcttgtgtaaagagtggctccgggtctgaatcaactggtgcagaagagagatctgcgaaacctaccaagctggcttcaaaatcagccacctcagccaaagctgggtgtagcaccatcactgattcttcttctgctgcctctacttcctcctcgtcttctgctgtagcctcggcctcctccactgtaccaccaggtgccagagtgaaacaaggaaaagatcagaacaaggccaggcgttcccgttcagcgtccagtcccagccccagaagaagtagcagggaaaaggaacagagtaaaactggtggctcttcaaaatttgattgggctgctcgtttcagccctaaagttagccttcctaaaacaaaactgtctcttccagggtcttctaagtcagagacatcaaaacctggaccttctggattacaggccaaattagcaagtttaagaaaatctacgaagaaacgcagtgagtctccacctgctgagctccccagtttgaggcggagcacacgccaaaagaccacgggctcctgtgctagtaccagtcggcgaggctctggcctgggcaaaagaggagcagctgaagctcgtcgacaggagaaaatggcagaccctgaaagcaaccaggaggcagtaaattcttcagctgctcggacagatgaagctccccaaggagctgcaggggctgttggcatgaccacctctggggagagtgaatcagatgattccgagatgggacgtttgcaagctttgttagaggcaaggggtcttccccctcacctatttggtcctcttggtcctcggatgtcacagcttttccatagaacaattggaagtggagctagttctaaggcccagcagctactacaaggattgcaagccagtgatgaaagtcaacagcttcaggcagttattgagatgtgtcagttactggtcatgggaaatgaggagacactgggagggtttcctgtcaagagtgttgttccagctttgattacgttacttcagatggagcacaattttgatattatgaaccatgcttgtcgagccttaacatacatgatggaagcacttcctcgatcttctgctgttgtagtagatgctattcctgtctttttagaaaagctgcaagttattcagtgtattgatgtggcagagcaggccttgactgccttggagatgttgtcacggagacatagtaaagccattctacaggcgggtggtttggcagactgcttgctgtacctagaattcttcagcataaatgcccaaagaaatgcattagcaattgcagctaattgctgccagagtatcacgccagatgaatttcattttgtggcagattcactcccattgctaacccaaaggctaacacatcaggataaaaagtcagtagaaagcacttgcctttgttttgcacgcctagtggacaacttccagcatgaggagaatttactccagcaggttgcttccaaagatctgcttacaaatgttcaacagctgttggtagtgactccacccattttaagttctgggatgtttataatggtggttcgcatgttttctctgatgtgttccaactgtccaactttagctgttcaacttatgaaacaaaacattgcagaaacgcttcactttctcctgtgtggtgcctccaatggaagttgtcaggaacagattgatcttgttccacgaagccctcaagagttgtatgaactgacatctctgatttgtgaacttatgccatgtttaccaaaagaaggcatttttgcagttgataccatgttgaagaagggaaatgcacagaacacagatggtgcgatatggcagtggcgtgatgatcggggcctctggcatccatataacaggattgacagccggatcattgagcaaatcaatgaggacacgggaacagcacgtgccattcagagaaaacctaacccgttagccaatagtaacactagtggatattcagagtcaaagaaggatgatgctcgagcacagcttatgaaagaggatccggaactggctaagtcttttattaagacattatttggtgttctttatgaagtgtatagttcctcagcaggacctgcggtcagacataagtgccttagagcaattcttaggataatttattttgcggatgctgaacttctgaaggatgttctgaaaaatcatgctgtttcaagtcacattgcttccatgctgtcaagccaagacctgaagatagtagtgggagcacttcagatggcagaaattttaatgcagaagttacctgatatttttagtgtttacttcagaagagaaggtgtaatgcatcaagtaaaacacttagcagaatcagagtctttgttgacaagtccaccaaaggcatgtacgaatggatcgggatccatgggatccacaacttcagtcagcagtgggacagccacagctgccactcatgctgcagctgacttgggatcacccagcttgcagcacagcagggatgattctttagatctcagccctcaaggtcgattaagtgatgttctaaagagaaaacgactgccaaaacgagggccaagaaggccaaagtactcacctccaagagatgatgacaaagtagacaatcaagctaaaagccccaccactactcagtcacctaaatcttctttcctggcaagcttgaatccaaaaacatggggaaggttaagtacacagtccaacagcaacaacattgagccagcacggactgcgggaggtagtggccttgccagggctgcctcaaaggataccatctccaataatagagaaaaaattaaaggttggattaaggagcaggcacataaatttgtagaacgttatttcagttctgagaatatggatggaagcaaccctgcattgaatgtccttcagagactttgtgctgcaaccgaacaactcaacctccaggtggatggtggagctgagtgccttgtagaaatccgtagcatagtctcagagtcagatgtttcatcatttgaaatccaacatagtggatttgtgaagcagctgttgctttatttgacatctaaaagtgaaaaggatgctgtgagcagagagatcagattaaagcgatttcttcatgtatttttttcttctccacttcctggagaagagcccattggaagagtggaaccagtgggtaatgcacctttgttggcattagttcacaagatgaacaactgcctcagccagatggaacaatttccagtcaaagtacatgatttccctagtggaaatgggacaggaggcagcttttctctcaacagaggatcacaggctttaaaatttttcaacacacatcaattaaaatgccagttacaaaggcatccagactgtgcaaatgtgaagcagtggaagggtggacctgtcaagattgaccctctggctttggtacaagccatcgagagataccttgtagttagagggtatggaagagtaagagaagatgatgaagacagcgatgacgatggatcagatgaggaaatagatgagtctctggctgctcagttcctaaattcaggaaatgtaagacacaggctgcagttttatattggagaacatttgctgccgtataacatgactgtgtatcaggcagtacggcagtttagtatacaggctgaagatgaaagagaatccacagatgatgagagcaatcctctaggcagagctggtatttggacaaagactcatacaatatggtataaacctgtgagagaggatgaagaaagtaataaagattgtgttggtggtaaaagaggaagagcccaaacagctccaacgaaaacttcccctagaaatgcaaaaaagcatgatgagttatggcacgatggagtgtgcccatcagtatcaaatcctttagaagtttacctcattcccacaccacctgaaaatataacatttgaagacccgtcattagatgtgatccttcttttaagagttttacatgctatcagtcgatactggtattacttgtatgataatgcaatgtgcaaggaaattattccaactagtgaatttattaacagtaagttaacagcaaaagcaaataggcaacttcaagatcctttagtaatcatgacaggaaacatcccaacatggcttactgagctaggaaaaacctgcccatttttctttccttttgatacccggcaaatgcttttttatgtaactgcatttgatcgggaccgagcaatgcaaagattacttgataccaacccagaaatcaaccagtctgattctcaagatagcagagttgcacctagattggatagaaaaaaacgtactgtgaaccgagaggagctgctgaaacaggcggagtctgtgatgcaggacctcggcagctcacgggccatgttagaaatccagtatgaaaatgaggttggtacaggtcttgggcctacactggagttttatgcgcttgtatctcaggaactacagagagctgacttgggtctttggagaggtgaagaagtaactcttagcaatccaaaagggagccaagaagggaccaagtatattcaaaacctccagggcctgtttgcgcttccctttggtaggacagcaaagccagctcatatcgcaaaggttaagatgaagtttcgcttcttaggaaaattaatggccaaggctatcatggatttcagattggtggaccttccccttggcttacccttttataaatggatgctacggcaagaaacttcactgacatcacacgatttgtttgacatcgacccagttgtagccagatcagtttatcacctagaagacattgtcagacagaagaaaagacttgaacaagataaatcccagaccaaagagagtctacagtatgcattagaaaccttgactatgaatggctgctcagttgaagatctaggactggatttcactctgccagggtttcccaatatcgaactgaagaaaggagggaaggatataccagtcactatccacaatttagaggagtatctaagactggttatattctgggcactaaatgaaggcgtttctaggcaatttgattcgttcagagatggatttgaatcagtcttcccactcagtcatcttcagtacttctacccggaggaactggatcagctcctttgtggcagtaaagcagacacttgggatgcaaagacactgatggaatgctgtaggcctgatcatggttatactcatgacagtcgggctgtgaagtttttgtttgagattctcagtagttttgataatgagcagcagaggttatttctccagtttgtgactggtagcccaagattgcctgttggaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtaggaaaaacggcttgcagattataaagagacatttggttgatattcattaatggccccatggacttaaagtgatcaggccctaaaacgttgttgtgatgaggtttctttagcaagttcttgtttaaattatcatttatttgatgagtgaagtttttaacatgctttgctgtgtgaaatttaaaaaagggatgtttttccaggctggaacaataaatgtggctgtgcagtttaattctgggctgtgtgtatccatctagctaagtctgcagttttctttcctccaaagacaactcttgtacataagtacagaaatttaagctcacatgtatttgacaaatatagtttagtagactagctctatgtgcttttcactttcctctgattttctctccctgattcattattatctgtgcagctcacagttttttttttgtatacaactcacagttctcaaattttcgttacccatgggcttctgttgtcccatgttctctccagttaagatctaatttaaaattcattggattgaaatttattgaatataattcagcttttgtaactaggtagacttttcttatagtttagttttaatatagtttagggtattactggctttttcccaggtgacacactaaggactgtttacatggcaattccagcagcaacagcctctggaatgagacaaggaaagctcatttgtttcttttatgaaggttaagaagtctacagcttgggctggccggtatttattattctgtggccagaggattttaaattaatgtaaattttttaaacaaaataagcagttttccttccctgttggagtaaaaaaatttttttccctttgttgttttacgtttttgttcatagtcttctttattccacgctcctcttccccttctcccagtgctgacttgggacaaaacagttcagcctttgtctcgacgcagataaaagcacctgtaagcaatgctgtccagtcattttatgtgctgatttctcaaatctgcaataatccatcaggttaatgtttttacctgaaaataaagaaagtttgcttcacctttttgtttatagttttgtgctgtatgcataactttcaattgtatagatgtatttcaatgcaaggaaatccacatatctccatgattcgggtcatggctgattttgctattcaaacaatttataatagcaacttgaagaaactaaaatgtgaagagaaaatgggaggagattccttcctaaggtccaaaactaggcctgtggcataaatttgaaggaattttccataattcatctccttgaaaataagagatgagctagtttttttttttaattgaactttgagaaatcaatttttttgactgttctgtaagttttaattaattgacacaaaagcccttttccctatcccaccacccaaaagaa

SEQ ID NO: 408536 - DNA, 7785 bp, Homo sapiens
gcggccgcggccggagggaccggggcctggcgggaggtaggggtcgctgggtccctcctccggcttcccgcaatgaggagggcccttcacagaaccgggtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaaggtcacatttagggcaggcaaaacataagggatatagccctcctgagagtagaaaatctaattctaaggcacccaaagtgcagtctaatactacttctgaactgtcaaggggacacctttctaaaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaagaaaaaggacagagagttcttgtgtaaagagtggctccgggtctgaatcaactggtgcagaagagagatctgcgaaacctaccaagctggcttcaaaatcagccacctcagccaaagctgggtgtagcaccatcactgattcttcttctgctgcctctacttcctcctcgtcttctgctgtagcctcggcctcctccactgtaccaccaggtgccagagtgaaacaaggaaaagatcagaacaaggccaggcgttcccgttcagcgtccagtcccagccccagaagaagtagcagggaaaaggaacagaggtcttctaagtcagagacatcaaaacctggaccttctggattacaggccaaattagcaagtttaagaaaatctacgaagaaacgcagtgagtctccacctgctgagctccccagtttgaggcggagcacacgccaaaagaccacgggctcctgtgctagtaccagtcggcgaggctctggcctgggcaaaagaggagcagctgaagctcgtcgacaggagaaaatggcagaccctgaaagcaaccaggaggcagtaaattcttcagctgctcggacagatgaagctccccaaggagctgcaggggctgttggcatgaccacctctggggagagtgaatcagatgattccgagatgggacgtttgcaagctttgttagaggcaaggggtcttccccctcacctatttggtcctcttggtcctcggatgtcacagcttttccatagaacaattggaagtggagctagttctaaggcccagcagctactacaaggattgcaagccagtgatgaaagtcaacagcttcaggcagttattgagatgtgtcagttactggtcatgggaaatgaggagacactgggagggtttcctgtcaagagtgttgttccagctttgattacgttacttcagatggagcacaattttgatattatgaaccatgcttgtcgagccttaacatacatgatggaagcacttcctcgatcttctgctgttgtagtagatgctattcctgtctttttagaaaagctgcaagttattcagtgtattgatgtggcagagcaggccttgactgccttggagatgttgtcacggagacatagtaaagccattctacaggcgggtggtttggcagactgcttgctgtacctagaattcttcagcataaatgcccaaagaaatgcattagcaattgcagctaattgctgccagagtatcacgccagatgaatttcattttgtggcagattcactcccattgctaacccaaaggctaacacatcaggataaaaagtcagtagaaagcacttgcctttgttttgcacgcctagtggacaacttccagcatgaggagaatttactccagcaggttgcttccaaagatctgcttacaaatgttcaacagctgttggtagtgactccacccattttaagttctgggatgtttataatggtggttcgcatgttttctctgatgtgttccaactgtccaactttagctgttcaacttatgaaacaaaacattgcagaaacgcttcactttctcctgtgtggtgcctccaatggaagttgtcaggaacagattgatcttgttccacgaagccctcaagagttgtatgaactgacatctctgatttgtgaacttatgccatgtttaccaaaagaaggcatttttgcagttgataccatgttgaagaagggaaatgcacagaacacagatggtgcgatatggcagtggcgtgatgatcggggcctctggcatccatataacaggattgacagccggatcattgaggcagcccatcaggtcggtgaggatgagataagcttgtccactctgggacgagtttatactattgattttaattctatgcagcaaatcaatgaggacacgggaacagcacgtgccattcagagaaaacctaacccgttagccaatagtaacactagtggatattcagagtcaaagaaggatgatgctcgagcacagcttatgaaagaggatccggaactggctaagtcttttattaagacattatttggtgttctttatgaagtgtatagttcctcagcaggacctgcggtcagacataagtgccttagagcaattcttaggataatttattttgcggatgctgaacttctgaaggatgttctgaaaaatcatgctgtttcaagtcacattgcttccatgctgtcaagccaagacctgaagatagtagtgggagcacttcagatggcagaaattttaatgcagaagttacctgatatttttagtgtttacttcagaagagaaggtgtaatgcatcaagtaaaacacttagcagaatcagagtctttgttgacaagtccaccaaaggcatgtacgaatggatcgggatccatgggatccacaacttcagtcagcagtgggacagccacagctgccactcatgctgcagctgacttgggatcacccagcttgcagcacagcagggatgattctttagatctcagccctcaaggtcgattaagtgatgttctaaagagaaaacgactgccaaaacgagggccaagaaggccaaagtactcacctccaagagatgatgacaaagtagacaatcaagctaaaagccccaccactactcagtcacctaaatcttctttcctggcaagcttgaatccaaaaacatggggaaggttaagtacacagtccaacagcaacaacattgagccagcacggactgcgggaggtagtggccttgccagggctgcctcaaaggataccatctccaataatagagaaaaaattaaaggttggattaaggagcaggcacataaatttgtagaacgttatttcagttctgagaatatggatggaagcaaccctgcattgaatgtccttcagagactttgtgctgcaaccgaacaactcaacctccaggtggatggtggagctgagtgccttgtagaaatccgtagcatagtctcagagtcagatgtttcatcatttgaaatccaacatagtggatttgtgaagcagctgttgctttatttgacatctaaaagtgaaaaggatgctgtgagcagagagatcagattaaagcgatttcttcatgtatttttttcttctccacttcctggagaagagcccattggaagagtggaaccagtgggtaatgcacctttgttggcattagttcacaagatgaacaactgcctcagccagatggaacaatttccagtcaaagtacatgatttccctagtggaaatgggacaggaggcagcttttctctcaacagaggatcacaggctttaaaatttttcaacacacatcaattaaaatgccagttacaaaggcatccagactgtgcaaatgtgaagcagtggaagggtggacctgtcaagattgaccctctggctttggtacaagccatcgagagataccttgtagttagagggtatggaagagtaagagaagatgatgaagacagcgatgacgatggatcagatgaggaaatagatgagtctctggctgctcagttcctaaattcaggaaatgtaagacacaggctgcagttttatattggagaacatttgctgccgtataacatgactgtgtatcaggcagtacggcagtttagtatacaggctgaagatgaaagagaatccacagatgatgagagcaatcctctaggcagagctggtatttggacaaagactcatacaatatggtataaacctgtgagagaggatgaagaaagtaataaagattgtgttggtggtaaaagaggaagagcccaaacagctccaacgaaaacttcccctagaaatgcaaaaaagcatgatgagttatggcacgatggagtgtgcccatcagtatcaaatcctttagaagtttacctcattcccacaccacctgaaaatataacatttgaagacccgtcattagatgtgatccttcttttaagagttttacatgctatcagtcgatactggtattacttgtatgataatgcaatgtgcaaggaaattattccaactagtgaatttattaacagtaagttaacagcaaaagcaaataggcaacttcaagatcctttagtaatcatgacaggaaacatcccaacatggcttactgagctaggaaaaacctgcccatttttctttccttttgatacccggcaaatgcttttttatgtaactgcatttgatcgggaccgagcaatgcaaagattacttgataccaacccagaaatcaaccagtctgattctcaagatagcagagttgcacctagattggatagaaaaaaacgtactgtgaaccgagaggagctgctgaaacaggcggagtctgtgatgcaggacctcggcagctcacgggccatgttagaaatccagtatgaaaatgaggttggtacaggtcttgggcctacactggagttttatgcgcttgtatctcaggaactacagagagctgacttgggtctttggagaggtgaagaagtaactcttagcaatccaaaagggagccaagaagggaccaagtatattcaaaacctccagggcctgtttgcgcttccctttggtaggacagcaaagccagctcatatcgcaaaggttaagatgaagtttcgcttcttaggaaaattaatggccaaggctatcatggatttcagattggtggaccttccccttggcttacccttttataaatggatgctacggcaagaaacttcactgacatcacacgatttgtttgacatcgacccagttgtagccagatcagtttatcacctagaagacattgtcagacagaagaaaagacttgaacaagataaatcccagaccaaagagagtctacagtatgcattagaaaccttgactatgaatggctgctcagttgaagatctaggactggatttcactctgccagggtttcccaatatcgaactgaagaaaggagggaaggatataccagtcactatccacaatttagaggagtatctaagactggttatattctgggcactaaatgaaggcgtttctaggcaatttgattcgttcagagatggatttgaatcagtcttcccactcagtcatcttcagtacttctacccggaggaactggatcagctcctttgtggcagtaaagcagacacttgggatgcaaagacactgatggaatgctgtaggcctgatcatggttatactcatgacagtcgggctgtgaagtttttgtttgagattctcagtagttttgataatgagcagcagaggttatttctccagtttgtgactggtagcccaagattgcctgttggaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtaggaaaaacggcttgcagattataaagagacatttggttgatattcattaatggccccatggacttaaagtgatcaggccctaaaacgttgttgtgatgaggtttctttagcaagttcttgtttaaattatcatttatttgatgagtgaagtttttaacatgctttgctgtgtgaaatttaaaaaagggatgtttttccaggctggaacaataaatgtggctgtgcagtttaattctgggctgtgtgtatccatctagctaagtctgcagttttctttcctccaaagacaactcttgtacataagtacagaaatttaagctcacatgtatttgacaaatatagtttagtagactagctctatgtgcttttcactttcctctgattttctctccctgattcattattatctgtgcagctcacagttttttttttgtatacaactcacagttctcaaattttcgttacccatgggcttctgttgtcccatgttctctccagttaagatctaatttaaaattcattggattgaaatttattgaatataattcagcttttgtaactaggtagacttttcttatagtttagttttaatatagtttagggtattactggctttttcccaggtgacacactaaggactgtttacatggcaattccagcagcaacagcctctggaatgagacaaggaaagctcatttgtttcttttatgaaggttaagaagtctacagcttgggctggccggtatttattattctgtggccagaggattttaaattaatgtaaattttttaaacaaaataagcagttttccttccctgttggagtaaaaaaatttttttccctttgttgttttacgtttttgttcatagtcttctttattccacgctcctcttccccttctcccagtgctgacttgggacaaaacagttcagcctttgtctcgacgcagataaaagcacctgtaagcaatgctgtccagtcattttatgtgctgatttctcaaatctgcaataatccatcaggttaatgtttttacctgaaaataaagaaagtttgcttcacctttttgtttatagttttgtgctgtatgcataactttcaattgtatagatgtatttcaatgcaaggaaatccacatatctccatgattcgggtcatggctgattttgctattcaaacaatttataatagcaacttgaagaaactaaaatgtgaagagaaaatgggaggagattccttcctaaggtccaaaactaggcctgtggcataaatttgaaggaattttccataattcatctccttgaaaataagagatgagctagtttttttttttaattgaactttgagaaatcaatttttttgactgttctgtaagttttaattaattgacacaaaagcccttttccctatcccaccacccaaaagaa

SEQ ID NO: 408537 - DNA, 6261 bp, Homo sapiens
tggcctagcaggggagtggagaagactgtcagtgtcctgtgagttctgcttgcccgctgcccacacagagctgccttatcaagcgggaaatcacaatttgtattcacacaaagccagctggtgcatcagaaggcagggtctgaaaatatatctcatgaaccatgcttgtcgagccttaacatacatgatggaagcacttcctcgatcttctgctgttgtagtagatgctattcctgtctttttagaaaagctgcaagttattcagtgtattgatgtggcagagcaggccttgactgccttggagatgttgtcacggagacatagtaaagccattctacaggcgggtggtttggcagactgcttgctgtacctagaattcttcagcataaatgcccaaagaaatgcattagcaattgcagctaattgctgccagagtatcacgccagatgaatttcattttgtggcagattcactcccattgctaacccaaaggctaacacatcaggataaaaagtcagtagaaagcacttgcctttgttttgcacgcctagtggacaacttccagcatgaggagaatttactccagcaggttgcttccaaagatctgcttacaaatgttcaacagctgttggtagtgactccacccattttaagttctgggatgtttataatggtggttcgcatgttttctctgatgtgttccaactgtccaactttagctgttcaacttatgaaacaaaacattgcagaaacgcttcactttctcctgtgtggtgcctccaatggaagttgtcaggaacagattgatcttgttccacgaagccctcaagagttgtatgaactgacatctctgatttgtgaacttatgccatgtttaccaaaagaaggcatttttgcagttgataccatgttgaagaagggaaatgcacagaacacagatggtgcgatatggcagtggcgtgatgatcggggcctctggcatccatataacaggattgacagccggatcattgaggcagcccatcaggtcggtgaggatgagataagcttgtccactctgggacgagtttatactattgattttaattctatgcagcaaatcaatgaggacacgggaacagcacgtgccattcagagaaaacctaacccgttagccaatagtaacactagtggatattcagagtcaaagaaggatgatgctcgagcacagcttatgaaagaggatccggaactggctaagtcttttattaagacattatttggtgttctttatgaagtgtatagttcctcagcaggacctgcggtcagacataagtgccttagagcaattcttaggataatttattttgcggatgctgaacttctgaaggatgttctgaaaaatcatgctgtttcaagtcacattgcttccatgctgtcaagccaagacctgaagatagtagtgggagcacttcagatggcagaaattttaatgcagaagttacctgatatttttagtgtttacttcagaagagaaggtgtaatgcatcaagtaaaacacttagcagaatcagagtctttgttgacaagtccaccaaaggcatgtacgaatggatcgggatccatgggatccacaacttcagtcagcagtgggacagccacagctgccactcatgctgcagctgacttgggatcacccagcttgcagcacagcagggatgattctttagatctcagccctcaaggtcgattaagtgatgttctaaagagaaaacgactgccaaaacgagggccaagaaggccaaagtactcacctccaagagatgatgacaaagtagacaatcaagctaaaagccccaccactactcagtcacctaaatcttctttcctggcaagcttgaatccaaaaacatggggaaggttaagtacacagtccaacagcaacaacattgagccagcacggactgcgggaggtagtggccttgccagggctgcctcaaaggataccatctccaataatagagaaaaaattaaaggttggattaaggagcaggcacataaatttgtagaacgttatttcagttctgagaatatggatggaagcaaccctgcattgaatgtccttcagagactttgtgctgcaaccgaacaactcaacctccaggtggatggtggagctgagtgccttgtagaaatccgtagcatagtctcagagtcagatgtttcatcatttgaaatccaacatagtggatttgtgaagcagctgttgctttatttgacatctaaaagtgaaaaggatgctgtgagcagagagatcagattaaagcgatttcttcatgtatttttttcttctccacttcctggagaagagcccattggaagagtggaaccagtgggtaatgcacctttgttggcattagttcacaagatgaacaactgcctcagccagatggaacaatttccagtcaaagtacatgatttccctagtggaaatgggacaggaggcagcttttctctcaacagaggatcacaggctttaaaatttttcaacacacatcaattaaaatgccagttacaaaggcatccagactgtgcaaatgtgaagcagtggaagggtggacctgtcaagattgaccctctggctttggtacaagccatcgagagataccttgtagttagagggtatggaagagtaagagaagatgatgaagacagcgatgacgatggatcagatgaggaaatagatgagtctctggctgctcagttcctaaattcaggaaatgtaagacacaggctgcagttttatattggagaacatttgctgccgtataacatgactgtgtatcaggcagtacggcagtttagtatacaggctgaagatgaaagagaatccacagatgatgagagcaatcctctaggcagagctggtatttggacaaagactcatacaatatggtataaacctgtgagagaggatgaagaaagtaataaagattgtgttggtggtaaaagaggaagagcccaaacagctccaacgaaaacttcccctagaaatgcaaaaaagcatgatgagttatggcacgatggagtgtgcccatcagtatcaaatcctttagaagtttacctcattcccacaccacctgaaaatataacatttgaagacccgtcattagatgtgatccttcttttaagagttttacatgctatcagtcgatactggtattacttgtatgataatgcaatgtgcaaggaaattattccaactagtgaatttattaacagtaagttaacagcaaaagcaaataggcaacttcaagatcctttagtaatcatgacaggaaacatcccaacatggcttactgagctaggaaaaacctgcccatttttctttccttttgatacccggcaaatgcttttttatgtaactgcatttgatcgggaccgagcaatgcaaagattacttgataccaacccagaaatcaaccagtctgattctcaagatagcagagttgcacctagattggatagaaaaaaacgtactgtgaaccgagaggagctgctgaaacaggcggagtctgtgatgcaggacctcggcagctcacgggccatgttagaaatccagtatgaaaatgaggttggtacaggtcttgggcctacactggagttttatgcgcttgtatctcaggaactacagagagctgacttgggtctttggagaggtgaagaagtaactcttagcaatccaaaagggagccaagaagggaccaagtatattcaaaacctccagggcctgtttgcgcttccctttggtaggacagcaaagccagctcatatcgcaaaggttaagatgaagtttcgcttcttaggaaaattaatggccaaggctatcatggatttcagattggtggaccttccccttggcttacccttttataaatggatgctacggcaagaaacttcactgacatcacacgatttgtttgacatcgacccagttgtagccagatcagtttatcacctagaagacattgtcagacagaagaaaagacttgaacaagataaatcccagaccaaagagagtctacagtatgcattagaaaccttgactatgaatggctgctcagttgaagatctaggactggatttcactctgccagggtttcccaatatcgaactgaagaaaggagggaaggatataccagtcactatccacaatttagaggagtatctaagactggttatattctgggcactaaatgaaggcgtttctaggcaatttgattcgttcagagatggatttgaatcagtcttcccactcagtcatcttcagtacttctacccggaggaactggatcagctcctttgtggcagtaaagcagacacttgggatgcaaagacactgatggaatgctgtaggcctgatcatggttatactcatgacagtcgggctgtgaagtttttgtttgagattctcagtagttttgataatgagcagcagaggttatttctccagtttgtgactggtagcccaagattgcctgttggaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtaggaaaaacggcttgcagattataaagagacatttggttgatattcattaatggccccatggacttaaagtgatcaggccctaaaacgttgttgtgatgaggtttctttagcaagttcttgtttaaattatcatttatttgatgagtgaagtttttaacatgctttgctgtgtgaaatttaaaaaagggatgtttttccaggctggaacaataaatgtggctgtgcagtttaattctgggctgtgtgtatccatctagctaagtctgcagttttctttcctccaaagacaactcttgtacataagtacagaaatttaagctcacatgtatttgacaaatatagtttagtagactagctctatgtgcttttcactttcctctgattttctctccctgattcattattatctgtgcagctcacagttttttttttgtatacaactcacagttctcaaattttcgttacccatgggcttctgttgtcccatgttctctccagttaagatctaatttaaaattcattggattgaaatttattgaatataattcagcttttgtaactaggtagacttttcttatagtttagttttaatatagtttagggtattactggctttttcccaggtgacacactaaggactgtttacatggcaattccagcagcaacagcctctggaatgagacaaggaaagctcatttgtttcttttatgaaggttaagaagtctacagcttgggctggccggtatttattattctgtggccagaggattttaaattaatgtaaattttttaaacaaaataagcagttttccttccctgttggagtaaaaaaatttttttccctttgttgttttacgtttttgttcatagtcttctttattccacgctcctcttccccttctcccagtgctgacttgggacaaaacagttcagcctttgtctcgacgcagataaaagcacctgtaagcaatgctgtccagtcattttatgtgctgatttctcaaatctgcaataatccatcaggttaatgtttttacctgaaaataaagaaagtttgcttcacctttttgtttatagttttgtgctgtatgcataactttcaattgtatagatgtatttcaatgcaaggaaatccacatatctccatgattcgggtcatggctgattttgctattcaaacaatttataatagcaacttgaagaaactaaaatgtgaagagaaaatgggaggagattccttcctaaggtccaaaactaggcctgtggcataaatttgaaggaattttccataattcatctccttgaaaataagagatgagctagtttttttttttaattgaactttgagaaatcaatttttttgactgttctgtaagttttaattaattgacacaaaagcccttttccctatcccaccacccaaaagaa

SEQ ID NO: 408538 - DNA, 7136 bp, Homo sapiens
gtgctgcggctcagctgataattgaaggaacccggagccgccgccgccgcgccgctggggggggtggggggagctagtggaagttactgccgcgccaccgagtccggaccggagactttggggcctaactagtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaagaaaaaggacagagagttcttgtgtaaagagtggctccgggtctgaatcaactggtgcagaagagagatctgcgaaacctaccaagctggcttcaaaatcagccacctcagccaaagctgggtgtagcaccatcactgattcttcttctgctgcctctacttcctcctcgtcttctgctgtagcctcggcctcctccactgtaccaccaggtgccagagtgaaacaaggaaaagatcagaacaaggccaggcgttcccgttcagcgtccagtcccagccccagaagaagtagcagggaaaaggaacagaggtcttctaagtcagagacatcaaaacctggaccttctggattacaggccaaattagcaagtttaagaaaatctacgaagaaacgcagtgagtctccacctgctgagctccccagtttgaggcggagcacacgccaaaagaccacgggctcctgtgctagtaccagtcggcgaggctctggcctgggcaaaagaggagcagctgaagctcgtcgacaggagaaaatggcagaccctgaaagcaaccaggaggcagtaaattcttcagctgctcggacagatgaagctccccaaggagctgcaggggctgttggcatgaccacctctggggagagtgaatcagatgattccgagatgggacgtttgcaagctttgttagaggcaaggggtcttccccctcacctatttggtcctcttggtcctcggatgtcacagcttttccatagaacaattggaagtggagctagttctaaggcccagcagctactacaaggattgcaagccagtgatgaaagtcaacagcttcaggcagttattgagatgtgtcagttactggtcatgggaaatgaggagacactgggagggtttcctgtcaagagtgttgttccagctttgattacgttacttcagatggagcacaattttgatattatgaaccatgcttgtcgagccttaacatacatgatggaagcacttcctcgatcttctgctgttgtagtagatgctattcctgtctttttagaaaagctgcaagttattcagtgtattgatgtggcagagcaggccttgactgccttggagatgttgtcacggagacatagtaaagccattctacaggcgggtggtttggcagactgcttgctgtacctagaattcttcagcataaatgcccaaagaaatgcattagcaattgcagctaattgctgccagagtatcacgccagatgaatttcattttgtggcagattcactcccattgctaacccaaaggctaacacatcaggataaaaagtcagtagaaagcacttgcctttgttttgcacgcctagtggacaacttccagcatgaggagaatttactccagcaggttgcttccaaagatctgcttacaaatgttcaacagctgttggtagtgactccacccattttaagttctgggatgtttataatggtggttcgcatgttttctctgatgtgttccaactgtccaactttagctgttcaacttatgaaacaaaacattgcagaaacgcttcactttctcctgtgtggtgcctccaatggaagttgtcaggaacagattgatcttgttccacgaagccctcaagagttgtatgaactgacatctctgatttgtgaacttatgccatgtttaccaaaagaaggcatttttgcagttgataccatgttgaagaagggaaatgcacagaacacagatggtgcgatatggcagtggcgtgatgatcggggcctctggcatccatataacaggattgacagccggatcattgaggcagcccatcaggtcggtgaggatgagataagcttgtccactctgggacgagtttatactattgattttaattctatgcagcaaatcaatgaggacacgggaacagcacgtgccattcagagaaaacctaacccgttagccaatagtaacactagtggatattcagagtcaaagaaggatgatgctcgagcacagcttatgaaagaggatccggaactggctaagtcttttattaagacattatttggtgttctttatgaagtgtatagttcctcagcaggacctgcggtcagacataagtgccttagagcaattcttaggataatttattttgcggatgctgaacttctgaaggatgttctgaaaaatcatgctgtttcaagtcacattgcttccatgctgtcaagccaagacctgaagatagtagtgggagcacttcagatggcagaaattttaatgcagaagttacctgatatttttagtgtttacttcagaagagaaggtgtaatgcatcaagtaaaacacttagcagaatcagagtctttgttgacaagtccaccaaaggcatgtacgaatggatcgggatccatgggatccacaacttcagtcagcagtgggacagccacagctgccactcatgctgcagctgacttgggatcacccagcttgcagcacagcagggatgattctttagatctcagccctcaaggtcgattaagtgatgttctaaagagaaaacgactgccaaaacgagggccaagaagcttcctggagaagagcccattggaagagtggaaccagtgggtaatgcacctttgttggcattagttcacaagatgaacaactgcctcagccagatggaacaatttccagtcaaagtacatgatttccctagtggaaatgggacaggaggcagcttttctctcaacagaggatcacaggctttaaaatttttcaacacacatcaattaaaatgccagttacaaaggcatccagactgtgcaaatgtgaagcagtggaagggtggacctgtcaagattgaccctctggctttggtacaagccatcgagagataccttgtagttagagggtatggaagagtaagagaagatgatgaagacagcgatgacgatggatcagatgaggaaatagatgagtctctggctgctcagttcctaaattcaggaaatgtaagacacaggctgcagttttatattggagaacatttgctgccgtataacatgactgtgtatcaggcagtacggcagtttagtatacaggctgaagatgaaagagaatccacagatgatgagagcaatcctctaggcagagctggtatttggacaaagactcatacaatatggtataaacctgtgagagaggatgaagaaagtaataaagattgtgttggtggtaaaagaggaagagcccaaacagctccaacgaaaacttcccctagaaatgcaaaaaagcatgatgagttatggcacgatggagtgtgcccatcagtatcaaatcctttagaagtttacctcattcccacaccacctgaaaatataacatttgaagacccgtcattagatgtgatccttcttttaagagttttacatgctatcagtcgatactggtattacttgtatgataatgcaatgtgcaaggaaattattccaactagtgaatttattaacagtaagttaacagcaaaagcaaataggcaacttcaagatcctttagtaatcatgacaggaaacatcccaacatggcttactgagctaggaaaaacctgcccatttttctttccttttgatacccggcaaatgcttttttatgtaactgcatttgatcgggaccgagcaatgcaaagattacttgataccaacccagaaatcaaccagtctgattctcaagatagcagagttgcacctagattggatagaaaaaaacgtactgtgaaccgagaggagctgctgaaacaggcggagtctgtgatgcaggacctcggcagctcacgggccatgttagaaatccagtatgaaaatgaggttggtacaggtcttgggcctacactggagttttatgcgcttgtatctcaggaactacagagagctgacttgggtctttggagaggtgaagaagtaactcttagcaatccaaaagggagccaagaagggaccaagtatattcaaaacctccagggcctgtttgcgcttccctttggtaggacagcaaagccagctcatatcgcaaaggttaagatgaagtttcgcttcttaggaaaattaatggccaaggctatcatggatttcagattggtggaccttccccttggcttacccttttataaatggatgctacggcaagaaacttcactgacatcacacgatttgtttgacatcgacccagttgtagccagatcagtttatcacctagaagacattgtcagacagaagaaaagacttgaacaagataaatcccagaccaaagagagtctacagtatgcattagaaaccttgactatgaatggctgctcagttgaagatctaggactggatttcactctgccagggtttcccaatatcgaactgaagaaaggagggaaggatataccagtcactatccacaatttagaggagtatctaagactggttatattctgggcactaaatgaaggcgtttctaggcaatttgattcgttcagagatggatttgaatcagtcttcccactcagtcatcttcagtacttctacccggaggaactggatcagctcctttgtggcagtaaagcagacacttgggatgcaaagacactgatggaatgctgtaggcctgatcatggttatactcatgacagtcgggctgtgaagtttttgtttgagattctcagtagttttgataatgagcagcagaggttatttctccagtttgtgactggtagcccaagattgcctgttggaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtaggaaaaacggcttgcagattataaagagacatttggttgatattcattaatggccccatggacttaaagtgatcaggccctaaaacgttgttgtgatgaggtttctttagcaagttcttgtttaaattatcatttatttgatgagtgaagtttttaacatgctttgctgtgtgaaatttaaaaaagggatgtttttccaggctggaacaataaatgtggctgtgcagtttaattctgggctgtgtgtatccatctagctaagtctgcagttttctttcctccaaagacaactcttgtacataagtacagaaatttaagctcacatgtatttgacaaatatagtttagtagactagctctatgtgcttttcactttcctctgattttctctccctgattcattattatctgtgcagctcacagttttttttttgtatacaactcacagttctcaaattttcgttacccatgggcttctgttgtcccatgttctctccagttaagatctaatttaaaattcattggattgaaatttattgaatataattcagcttttgtaactaggtagacttttcttatagtttagttttaatatagtttagggtattactggctttttcccaggtgacacactaaggactgtttacatggcaattccagcagcaacagcctctggaatgagacaaggaaagctcatttgtttcttttatgaaggttaagaagtctacagcttgggctggccggtatttattattctgtggccagaggattttaaattaatgtaaattttttaaacaaaataagcagttttccttccctgttggagtaaaaaaatttttttccctttgttgttttacgtttttgttcatagtcttctttattccacgctcctcttccccttctcccagtgctgacttgggacaaaacagttcagcctttgtctcgacgcagataaaagcacctgtaagcaatgctgtccagtcattttatgtgctgatttctcaaatctgcaataatccatcaggttaatgtttttacctgaaaataaagaaagtttgcttcacctttttgtttatagttttgtgctgtatgcataactttcaattgtatagatgtatttcaatgcaaggaaatccacatatctccatgattcgggtcatggctgattttgctattcaaacaatttataatagcaacttgaagaaactaaaatgtgaagagaaaatgggaggagattccttcctaaggtccaaaactaggcctgtggcataaatttgaaggaattttccataattcatctccttgaaaataagagatgagctagtttttttttttaattgaactttgagaaatcaatttttttgactgttctgtaagttttaattaattgacacaaaagcccttttccctatcccaccacccaaaagaa

SEQ ID NO: 408539 - DNA, 3260 bp, Homo sapiens
atttgaagacccgtcattagatgttatattttcaggtggtgtgggaatgaggtaaacttctaaaggatttgatactgatgggcacactccatcgtgccataactcattcccacaccacctgaaaatataacatttgaagacccgtcattagatgtgatccttcttttaagagttttacatgctatcagtcgatactggtattacttgtatgataatgcaatgtgcaaggaaattattccaactagtgaatttattaacagtaagttaacagcaaaagcaaataggcaacttcaagatcctttagtaatcatgacaggaaacatcccaacatggcttactgagctaggaaaaacctgcccatttttctttccttttgatacccggcaaatgcttttttatgtaactgcatttgatcgggaccgagcaatgcaaagattacttgataccaacccagaaatcaaccagtctgattctcaagatagcagagttgcacctagattggatagaaaaaaacgtactgtgaaccgagaggagctgctgaaacaggcggagtctgtgatgcaggacctcggcagctcacgggccatgttagaaatccagtatgaaaatgaggttggtacaggtcttgggcctacactggagttttatgcgcttgtatctcaggaactacagagagctgacttgggtctttggagaggtgaagaagtaactcttagcaatccaaaagggagccaagaagggaccaagtatattcaaaacctccagggcctgtttgcgcttccctttggtaggacagcaaagccagctcatatcgcaaaggttaagatgaagtttcgcttcttaggaaaattaatggccaaggctatcatggatttcagattggtggaccttccccttggcttacccttttataaatggatgctacggcaagaaacttcactgacatcacacgatttgtttgacatcgacccagttgtagccagatcagtttatcacctagaagacattgtcagacagaagaaaagacttgaacaagataaatcccagaccaaagagagtctacagtatgcattagaaaccttgactatgaatggctgctcagttgaagatctaggactggatttcactctgccagggtttcccaatatcgaactgaagaaaggagggaaggatataccagtcactatccacaatttagaggagtatctaagactggttatattctgggcactaaatgaaggcgtttctaggcaatttgattcgttcagagatggatttgaatcagtcttcccactcagtcatcttcagtacttctacccggaggaactggatcagctcctttgtggcagtaaagcagacacttgggatgcaaagacactgatggaatgctgtaggcctgatcatggttatactcatgacagtcgggctgtgaagtttttgtttgagattctcagtagttttgataatgagcagcagaggttatttctccagtttgtgactggtagcccaagattgcctgttggaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtaggaaaaacggcttgcagattataaagagacatttggttgatattcattaatggccccatggacttaaagtgatcaggccctaaaacgttgttgtgatgaggtttctttagcaagttcttgtttaaattatcatttatttgatgagtgaagtttttaacatgctttgctgtgtgaaatttaaaaaagggatgtttttccaggctggaacaataaatgtggctgtgcagtttaattctgggctgtgtgtatccatctagctaagtctgcagttttctttcctccaaagacaactcttgtacataagtacagaaatttaagctcacatgtatttgacaaatatagtttagtagactagctctatgtgcttttcactttcctctgattttctctccctgattcattattatctgtgcagctcacagttttttttttgtatacaactcacagttctcaaattttcgttacccatgggcttctgttgtcccatgttctctccagttaagatctaatttaaaattcattggattgaaatttattgaatataattcagcttttgtaactaggtagacttttcttatagtttagttttaatatagtttagggtattactggctttttcccaggtgacacactaaggactgtttacatggcaattccagcagcaacagcctctggaatgagacaaggaaagctcatttgtttcttttatgaaggttaagaagtctacagcttgggctggccggtatttattattctgtggccagaggattttaaattaatgtaaattttttaaacaaaataagcagttttccttccctgttggagtaaaaaaatttttttccctttgttgttttacgtttttgttcatagtcttctttattccacgctcctcttccccttctcccagtgctgacttgggacaaaacagttcagcctttgtctcgacgcagataaaagcacctgtaagcaatgctgtccagtcattttatgtgctgatttctcaaatctgcaataatccatcaggttaatgtttttacctgaaaataaagaaagtttgcttcacctttttgtttatagttttgtgctgtatgcataactttcaattgtatagatgtatttcaatgcaaggaaatccacatatctccatgattcgggtcatggctgattttgctattcaaacaatttataatagcaacttgaagaaactaaaatgtgaagagaaaatgggaggagattccttcctaaggtccaaaactaggcctgtggcataaatttgaaggaattttccataattcatctccttgaaaataagagatgagctagtttttttttttaattgaactttgagaaatcaatttttttgactgttctgtaagttttaattaattgacacaaaagcccttttccctatcccaccacccaaaagaa

SEQ ID NO: 408540 - DNA, 3158 bp, Homo sapiens
gatacaagtaatacccagtatcgactgatagcatgtgatccttcttttaagagttttacatgctatcagtcgatacaagtaataccagtatcgactgatagcatgtatgataatgcaatgtgcaaggaaattattccaactagtgaatttattaacagtaagttaacagcaaaagcaaataggcaacttcaagatcctttagtaatcatgacaggaaacatcccaacatggcttactgagctaggaaaaacctgcccatttttctttccttttgatacccggcaaatgcttttttatgtaactgcatttgatcgggaccgagcaatgcaaagattacttgataccaacccagaaatcaaccagtctgattctcaagatagcagagttgcacctagattggatagaaaaaaacgtactgtgaaccgagaggagctgctgaaacaggcggagtctgtgatgcaggacctcggcagctcacgggccatgttagaaatccagtatgaaaatgaggttggtacaggtcttgggcctacactggagttttatgcgcttgtatctcaggaactacagagagctgacttgggtctttggagaggtgaagaagtaactcttagcaatccaaaagggagccaagaagggaccaagtatattcaaaacctccagggcctgtttgcgcttccctttggtaggacagcaaagccagctcatatcgcaaaggttaagatgaagtttcgcttcttaggaaaattaatggccaaggctatcatggatttcagattggtggaccttccccttggcttacccttttataaatggatgctacggcaagaaacttcactgacatcacacgatttgtttgacatcgacccagttgtagccagatcagtttatcacctagaagacattgtcagacagaagaaaagacttgaacaagataaatcccagaccaaagagagtctacagtatgcattagaaaccttgactatgaatggctgctcagttgaagatctaggactggatttcactctgccagggtttcccaatatcgaactgaagaaaggagggaaggatataccagtcactatccacaatttagaggagtatctaagactggttatattctgggcactaaatgaaggcgtttctaggcaatttgattcgttcagagatggatttgaatcagtcttcccactcagtcatcttcagtacttctacccggaggaactggatcagctcctttgtggcagtaaagcagacacttgggatgcaaagacactgatggaatgctgtaggcctgatcatggttatactcatgacagtcgggctgtgaagtttttgtttgagattctcagtagttttgataatgagcagcagaggttatttctccagtttgtgactggtagcccaagattgcctgttggaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtaggaaaaacggcttgcagattataaagagacatttggttgatattcattaatggccccatggacttaaagtgatcaggccctaaaacgttgttgtgatgaggtttctttagcaagttcttgtttaaattatcatttatttgatgagtgaagtttttaacatgctttgctgtgtgaaatttaaaaaagggatgtttttccaggctggaacaataaatgtggctgtgcagtttaattctgggctgtgtgtatccatctagctaagtctgcagttttctttcctccaaagacaactcttgtacataagtacagaaatttaagctcacatgtatttgacaaatatagtttagtagactagctctatgtgcttttcactttcctctgattttctctccctgattcattattatctgtgcagctcacagttttttttttgtatacaactcacagttctcaaattttcgttacccatgggcttctgttgtcccatgttctctccagttaagatctaatttaaaattcattggattgaaatttattgaatataattcagcttttgtaactaggtagacttttcttatagtttagttttaatatagtttagggtattactggctttttcccaggtgacacactaaggactgtttacatggcaattccagcagcaacagcctctggaatgagacaaggaaagctcatttgtttcttttatgaaggttaagaagtctacagcttgggctggccggtatttattattctgtggccagaggattttaaattaatgtaaattttttaaacaaaataagcagttttccttccctgttggagtaaaaaaatttttttccctttgttgttttacgtttttgttcatagtcttctttattccacgctcctcttccccttctcccagtgctgacttgggacaaaacagttcagcctttgtctcgacgcagataaaagcacctgtaagcaatgctgtccagtcattttatgtgctgatttctcaaatctgcaataatccatcaggttaatgtttttacctgaaaataaagaaagtttgcttcacctttttgtttatagttttgtgctgtatgcataactttcaattgtatagatgtatttcaatgcaaggaaatccacatatctccatgattcgggtcatggctgattttgctattcaaacaatttataatagcaacttgaagaaactaaaatgtgaagagaaaatgggaggagattccttcctaaggtccaaaactaggcctgtggcataaatttgaaggaattttccataattcatctccttgaaaataagagatgagctagtttttttttttaattgaactttgagaaatcaatttttttgactgttctgtaagttttaattaattgacacaaaagcccttttccctatcccaccacccaaaagaa

SEQ ID NO: 408541 - DNA, 7636 bp, Homo sapiens
gtgctgcggctcagctgataattgaaggaacccggagccgccgccgccgcgccgctggggggggtggggggagctagtggaagttactgccgcgccaccgagtccggaccggagactttggggcctaactagtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaagaaaaaggacagagagttcttgtgtaaagagtggctccgggtctgaatcaactggtgcagaagagagatctgcgaaacctaccaagctggcttcaaaatcagccacctcagccaaagctgggtgtagcaccatcactgattcttcttctgctgcctctacttcctcctcgtcttctgctgtagcctcggcctcctccactgtaccaccaggtgccagagtgaaacaaggaaaagatcagaacaaggccaggcgttcccgttcagcgtccagtcccagccccagaagaagtagcagggaaaaggaacagaggtcttctaagtcagagacatcaaaacctggaccttctggattacaggccaaattagcaagtttaagaaaatctacgaagaaacgcagtgagtctccacctgctgagctccccagtttgaggcggagcacacgccaaaagaccacgggctcctgtgctagtaccagtcggcgaggctctggcctgggcaaaagaggagcagctgaagctcgtcgacaggagaaaatggcagaccctgaaagcaaccaggaggcagtaaattcttcagctgctcggacagatgaagctccccaaggagctgcaggggctgttggcatgaccacctctggggagagtgaatcagatgattccgagatgggacgtttgcaagctttgttagaggcaaggggtcttccccctcacctatttggtcctcttggtcctcggatgtcacagcttttccatagaacaattggaagtggagctagttctaaggcccagcagctactacaaggattgcaagccagtgatgaaagtcaacagcttcaggcagttattgagatgtgtcagttactggtcatgggaaatgaggagacactgggagggtttcctgtcaagagtgttgttccagctttgattacgttacttcagatggagcacaattttgatattatgaaccatgcttgtcgagccttaacatacatgatggaagcacttcctcgatcttctgctgttgtagtagatgctattcctgtctttttagaaaagctgcaagttattcagtgtattgatgtggcagagcaggccttgactgccttggagatgttgtcacggagacatagtaaagccattctacaggcgggtggtttggcagactgcttgctgtacctagaattcttcagcataaatgcccaaagaaatgcattagcaattgcagctaattgctgccagagtatcacgccagatgaatttcattttgtggcagattcactcccattgctaacccaaaggctaacacatcaggataaaaagtcagtagaaagcacttgcctttgttttgcacgcctagtggacaacttccagcatgaggagaatttactccagcaggttgcttccaaagatctgcttacaaatgttcaacagctgttggtagtgactccacccattttaagttctgggatgtttataatggtggttcgcatgttttctctgatgtgttccaactgtccaactttagctgttcaacttatgaaacaaaacattgcagaaacgcttcactttctcctgtgtggtgcctccaatggaagttgtcaggaacagattgatcttgttccacgaagccctcaagagttgtatgaactgacatctctgatttgtgaacttatgccatgtttaccaaaagaaggcatttttgcagttgataccatgttgaagaagggaaatgcacagaacacagatggtgcgatatggcagtggcgtgatgatcggggcctctggcatccatataacaggattgacagccggatcattgaggcagcccatcaggtcggtgaggatgagataagcttgtccactctgggacgagtttatactattgattttaattctatgcagcaaatcaatgaggacacgggaacagcacgtgccattcagagaaaacctaacccgttagccaatagtaacactagtggatattcagagtcaaagaaggatgatgctcgagcacagcttatgaaagaggatccggaactggctaagtcttttattaagacattatttggtgttctttatgaagtgtatagttcctcagcaggacctgcggtcagacataagtgccttagagcaattcttaggataatttattttgcggatgctgaacttctgaaggatgttctgaaaaatcatgctgtttcaagtcacattgcttccatgctgtcaagccaagacctgaagatagtagtgggagcacttcagatggcagaaattttaatgcagaagttacctgatatttttagtgtttacttcagaagagaaggtgtaatgcatcaagtaaaacacttagcagaatcagagtctttgttgacaagtccaccaaaggcatgtacgaatggatcgggatccatgggatccacaacttcagtcagcagtgggacagccacagctgccactcatgctgcagctgacttgggatcacccagcttgcagcacagcagggatgattctttagatctcagccctcaaggtcgattaagtgatgttctaaagagaaaacgactgccaaaacgagggccaagaaggccaaagtactcacctccaagagatgatgacaaagtagacaatcaagctaaaagccccaccactactcagtcacctaaatcttctttcctggcaagcttgaatccaaaaacatggggaaggttaagtacacagtccaacagcaacaacattgagccagcacggactgcgggaggtagtggccttgccagggctgcctcaaaggataccatctccaataatagagaaaaaattaaaggttggattaaggagcaggcacataaatttgtagaacgttatttcagttctgagaatatggatggaagcaaccctgcattgaatgtccttcagagactttgtgctgcaaccgaacaactcaacctccaggtggatggtggagctgagtgccttgtagaaatccgtagcatagtctcagagtcagatgtttcatcatttgaaatccaacatagtggatttgtgaagcagctgttgctttatttgacatctaaaagtgaaaaggatgctgtgagcagagagatcagattaaagcgatttcttcatgtatttttttcttctccacttcctggagaagagcccattggaagagtggaaccagtgggtaatgcacctttgttggcattagttcacaagatgaacaactgcctcagccagatggaacaatttccagtcaaagtacatgatttccctagtggaaatgggacaggaggcagcttttctctcaacagaggatcacaggctttaaaatttttcaacacacatcaattaaaatgccagttacaaaggcatccagactgtgcaaatgtgaagcagtggaagggtggacctgtcaagattgaccctctggctttggtacaagccatcgagagataccttgtagttagagggtatggaagagtaagagaagatgatgaagacagcgatgacgatggatcagatgaggaaatagatgagtctctggctgctcagttcctaaattcaggaaatgtaagacacaggctgcagttttatattggagaacatttgctgccgtataacatgactgtgtatcaggcagtacggcagtttagtatacaggctgaagatgaaagagaatccacagatgatgagagcaatcctctaggcagagctggtatttggacaaagactcatacaatatggtataaacctgtgagagaggatgaagaaagtaataaagattgtgttggtggtaaaagaggaagagcccaaacagctccaacgaaaacttcccctagaaatgcaaaaaagcatgatgagttatggcacgatggagtgtgcccatcagtatcaaatcctttagaagtttacctcattcccacaccacctgaaaatataacatttgaagacccgtcattagatgtgatccttcttttaagagttttacatgctatcagtcgatactggtattacttgtatgataatgcaatgtgcaaggaaattattccaactagtgaatttattaacagtaagttaacagcaaaagcaaataggcaacttcaagatcctttagtaatcatgacaggaaacatcccaacatggcttactgagctaggaaaaacctgcccatttttctttccttttgatacccggcaaatgcttttttatgtaactgcatttgatcgggaccgagcaatgcaaagattacttgataccaacccagaaatcaaccagtctgattctcaagatagcagagttgcacctagattggatagaaaaaaacgtactgtgaaccgagaggagctgctgaaacaggcggagtctgtgatgcaggacctcggcagctcacgggccatgttagaaatccagtatgaaaatgaggttggtacaggtcttgggcctacactggagttttatgcgcttgtatctcaggaactacagagagctgacttgggtctttggagaggtgaagaagtaactcttagcaatccaaaagggagccaagaagggaccaagtatattcaaaacctccagggcctgtttgcgcttccctttggtaggacagcaaagccagctcatatcgcaaaggttaagatgaagtttcgcttcttaggaaaattaatggccaaggctatcatggatttcagattggtggaccttccccttggcttacccttttataaatggatgctacggcaagaaacttcactgacatcacacgatttgtttgacatcgacccagttgtagccagatcagtttatcacctagaagacattgtcagacagaagaaaagacttgaacaagataaatcccagaccaaagagagtctacagtatgcattagaaaccttgactatgaatggctgctcagttgaagatctaggactggatttcactctgccagggtttcccaatatcgaactgaagaaaggagggaaggatataccagtcactatccacaatttagaggagtatctaagactggttatattctgggcactaaatgaaggcgtttctaggcaatttgattcgttcagagatggatttgaatcagtcttcccactcagtcatcttcagtacttctacccggaggaactggatcagctcctttgtggcagtaaagcagacacttgggatgcaaagacactgatggaatgctgtaggcctgatcatggttatactcatgacagtcgggctgtgaagtttttgtttgagattctcagtagttttgataatgagcagcagaggttatttctccagtttgtgactggtagcccaagattgcctgttggaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtaggaaaaacggcttgcagattataaagagacatttggttgatattcattaatggccccatggacttaaagtgatcaggccatttgatgagtgaagtttttaacatgctttgctgtgtgaaatttaaaaaagggatgtttttccaggctggaacaataaatgtggctgtgcagtttaattctgggctgtgtgtatccatctagctaagtctgcagttttctttcctccaaagacaactcttgtacataagtacagaaatttaagctcacatgtatttgacaaatatagtttagtagactagctctatgtgcttttcactttcctctgattttctctccctgattcattattatctgtgcagctcacagttttttttttgtatacaactcacagttctcaaattttcgttacccatgggcttctgttgtcccatgttctctccagttaagatctaatttaaaattcattggattgaaatttattgaatataattcagcttttgtaactaggtagacttttcttatagtttagttttaatatagtttagggtattactggctttttcccaggtgacacactaaggactgtttacatggcaattccagcagcaacagcctctggaatgagacaaggaaagctcatttgtttcttttatgaaggttaagaagtctacagcttgggctggccggtatttattattctgtggccagaggattttaaattaatgtaaattttttaaacaaaataagcagttttccttccctgttggagtaaaaaaatttttttccctttgttgttttacgtttttgttcatagtcttctttattccacgctcctcttccccttctcccagtgctgacttgggacaaaacagttcagcctttgtctcgacgcagataaaagcacctgtaagcaatgctgtccagtcattttatgtgctgatttctcaaatctgcaataatccatcaggttaatgtttttacctgaaaataaagaaagtttgcttcacctttttgtttatagttttgtgctgtatgcataactttcaattgtatagatgtatttcaatgcaaggaaatccacatatctccatgattcgggtcatggctgattttgctattcaaacaatttataatagcaacttgaagaaactaaaatgtgaagagaaaatgggaggagattccttcctaaggtccaaaactaggcctgtggcataaatttgaaggaattttccataattcatctccttgaaaataagagatgagctagtttttttttttaattgaactttgagaaatcaatttttttgactgttctgtaagttttaattaattgacacaaaagcccttttccctatcccaccacccaaaagaa

SEQ ID NO: 408542 - DNA, 2243 bp, Homo sapiens
ggtaggggccccacattagatgttgacctgatgttttactcatgtagttttctagcagattattttaaagtcttaataacttgtttgttctttataaagtgatccagaagggtgtttcactgtactttgccacatattaaatagtaaagagatttgaaatcttgtcacagttttttgaaaactttctttttgcagctggttatattctgggcactaaatgaaggcgtttctaggcaatttgattcgttcagagatggatttgaatcagtcttcccactcagtcatcttcagtacttctacccggaggaactggatcagctcctttgtggcagtaaagcagacacttgggatgcaaagacactgatggaatgctgtaggcctgatcatggttatactcatgacagtcgggctgtgaagtttttgtttgagattctcagtagttttgataatgagcagcagaggttatttctccagtttgtgactggtagcccaagattgcctgttggaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtaggaaaaacggcttgcagattataaagagacatttggttgatattcattaatggccccatggacttaaagtgatcaggccctaaaacgttgttgtgatgaggtttctttagcaagttcttgtttaaattatcatttatttgatgagtgaagtttttaacatgctttgctgtgtgaaatttaaaaaagggatgtttttccaggctggaacaataaatgtggctgtgcagtttaattctgggctgtgtgtatccatctagctaagtctgcagttttctttcctccaaagacaactcttgtacataagtacagaaatttaagctcacatgtatttgacaaatatagtttagtagactagctctatgtgcttttcactttcctctgattttctctccctgattcattattatctgtgcagctcacagttttttttttgtatacaactcacagttctcaaattttcgttacccatgggcttctgttgtcccatgttctctccagttaagatctaatttaaaattcattggattgaaatttattgaatataattcagcttttgtaactaggtagacttttcttatagtttagttttaatatagtttagggtattactggctttttcccaggtgacacactaaggactgtttacatggcaattccagcagcaacagcctctggaatgagacaaggaaagctcatttgtttcttttatgaaggttaagaagtctacagcttgggctggccggtatttattattctgtggccagaggattttaaattaatgtaaattttttaaacaaaataagcagttttccttccctgttggagtaaaaaaatttttttccctttgttgttttacgtttttgttcatagtcttctttattccacgctcctcttccccttctcccagtgctgacttgggacaaaacagttcagcctttgtctcgacgcagataaaagcacctgtaagcaatgctgtccagtcattttatgtgctgatttctcaaatctgcaataatccatcaggttaatgtttttacctgaaaataaagaaagtttgcttcacctttttgtttatagttttgtgctgtatgcataactttcaattgtatagatgtatttcaatgcaaggaaatccacatatctccatgattcgggtcatggctgattttgctattcaaacaatttataatagcaacttgaagaaactaaaatgtgaagagaaaatgggaggagattccttcctaaggtccaaaactaggcctgtggcataaatttgaaggaattttccataattcatctccttgaaaataagagatgagctagtttttttttttaattgaactttgagaaatcaatttttttgactgttctgtaagttttaattaattgacacaaaagcccttttccctatcccaccacccaaaagaa

SEQ ID NO: 408543 - DNA, 1964 bp, Homo sapiens
caagtgtctgctttacatccacaaaggagctgatccagttcctccgggtagaagtactgaagatgactgagtgggaagacactgatggaatgctgtaggcctgatcatggttatactcatgacagtcgggctgtgaagtttttgtttgagattctcagtagttttgataatgagcagcagaggttatttctccagtttgtgactggtagcccaagattgcctgttggaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtaggaaaaacggcttgcagattataaagagacatttggttgatattcattaatggccccatggacttaaagtgatcaggccctaaaacgttgttgtgatgaggtttctttagcaagttcttgtttaaattatcatttatttgatgagtgaagtttttaacatgctttgctgtgtgaaatttaaaaaagggatgtttttccaggctggaacaataaatgtggctgtgcagtttaattctgggctgtgtgtatccatctagctaagtctgcagttttctttcctccaaagacaactcttgtacataagtacagaaatttaagctcacatgtatttgacaaatatagtttagtagactagctctatgtgcttttcactttcctctgattttctctccctgattcattattatctgtgcagctcacagttttttttttgtatacaactcacagttctcaaattttcgttacccatgggcttctgttgtcccatgttctctccagttaagatctaatttaaaattcattggattgaaatttattgaatataattcagcttttgtaactaggtagacttttcttatagtttagttttaatatagtttagggtattactggctttttcccaggtgacacactaaggactgtttacatggcaattccagcagcaacagcctctggaatgagacaaggaaagctcatttgtttcttttatgaaggttaagaagtctacagcttgggctggccggtatttattattctgtggccagaggattttaaattaatgtaaattttttaaacaaaataagcagttttccttccctgttggagtaaaaaaatttttttccctttgttgttttacgtttttgttcatagtcttctttattccacgctcctcttccccttctcccagtgctgacttgggacaaaacagttcagcctttgtctcgacgcagataaaagcacctgtaagcaatgctgtccagtcattttatgtgctgatttctcaaatctgcaataatccatcaggttaatgtttttacctgaaaataaagaaagtttgcttcacctttttgtttatagttttgtgctgtatgcataactttcaattgtatagatgtatttcaatgcaaggaaatccacatatctccatgattcgggtcatggctgattttgctattcaaacaatttataatagcaacttgaagaaactaaaatgtgaagagaaaatgggaggagattccttcctaaggtccaaaactaggcctgtggcataaatttgaaggaattttccataattcatctccttgaaaataagagatgagctagtttttttttttaattgaactttgagaaatcaatttttttgactgttctgtaagttttaattaattgacacaaaagcccttttccctatcccaccacccaaaagaa

SEQ ID NO: 408544 - DNA, 1880 bp, Homo sapiens
tcgtgccgaattcggcagagtcatggttatactcatgacagtcgggctgtgaagtttttgtttgagattctcagtagttttgataatgagcagcagaggttatttctccagtttgtgactggtagcccaagattgcctgttggaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtaggaaaaacggcttgcagattataaagagacatttggttgatattcattaatggccccatggacttaaagtgatcaggccctaaaacgttgttgtgatgaggtttctttagcaagttcttgtttaaattatcatttatttgatgagtgaagtttttaacatgctttgctgtgtgaaatttaaaaaagggatgtttttccaggctggaacaataaatgtggctgtgcagtttaattctgggctgtgtgtatccatctagctaagtctgcagttttctttcctccaaagacaactcttgtacataagtacagaaatttaagctcacatgtatttgacaaatatagtttagtagactagctctatgtgcttttcactttcctctgattttctctccctgattcattattatctgtgcagctcacagttttttttttgtatacaactcacagttctcaaattttcgttacccatgggcttctgttgtcccatgttctctccagttaagatctaatttaaaattcattggattgaaatttattgaatataattcagcttttgtaactaggtagacttttcttatagtttagttttaatatagtttagggtattactggctttttcccaggtgacacactaaggactgtttacatggcaattccagcagcaacagcctctggaatgagacaaggaaagctcatttgtttcttttatgaaggttaagaagtctacagcttgggctggccggtatttattattctgtggccagaggattttaaattaatgtaaattttttaaacaaaataagcagttttccttccctgttggagtaaaaaaatttttttccctttgttgttttacgtttttgttcatagtcttctttattccacgctcctcttccccttctcccagtgctgacttgggacaaaacagttcagcctttgtctcgacgcagataaaagcacctgtaagcaatgctgtccagtcattttatgtgctgatttctcaaatctgcaataatccatcaggttaatgtttttacctgaaaataaagaaagtttgcttcacctttttgtttatagttttgtgctgtatgcataactttcaattgtatagatgtatttcaatgcaaggaaatccacatatctccatgattcgggtcatggctgattttgctattcaaacaatttataatagcaacttgaagaaactaaaatgtgaagagaaaatgggaggagattccttcctaaggtccaaaactaggcctgtggcataaatttgaaggaattttccataattcatctccttgaaaataagagatgagctagtttttttttttaattgaactttgagaaatcaatttttttgactgttctgtaagttttaattaattgacacaaaagcccttttccctatcccaccacccaaaagaa

SEQ ID NO: 408545 - DNA, 5255 bp, Homo sapiens
gtgctgcggctcagctgataattgaaggaacccggagccgccgccgccgcgccgctggggggggtggggggagctagtggaagttactgccgcgccaccgagtccggaccggagactttggggcctaactagtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaagaaaaaggacagagagttcttgtgtaaagagtggctccgggtctgaatcaactggtgcagaagagagatctgcgaaacctaccaagctggcttcaaaatcagccacctcagccaaagctgggtgtagcaccatcactgattcttcttctgctgcctctacttcctcctcgtcttctgctgtagcctcggcctcctccactgtaccaccaggtgccagagtgaaacaaggaaaagatcagaacaaggccaggcgttcccgttcagcgtccagtcccagccccagaagaagtagcagggaaaaggaacagaggtcttctaagtcagagacatcaaaacctggaccttctggattacaggccaaattagcaagtttaagaaaatctacgaagaaacgcagtgagtctccacctgctgagctccccagtttgaggcggagcacacgccaaaagaccacgggctcctgtgctagtaccagtcggcgaggctctggcctgggcaaaagaggagcagctgaagctcgtcgacaggagaaaatggcagaccctgaaagcaaccaggaggcagtaaattcttcagctgctcggacagatgaagctccccaaggagctgcaggggctgttggcatgaccacctctggggagagtgaatcagatgattccgagatgggacgtttgcaagctttgttagaggcaaggggtcttccccctcacctatttggtcctcttggtcctcggatgtcacagcttttccatagaacaattggaagtggagctagttctaaggcccagcagctactacaaggattgcaagccagtgatgaaagtcaacagcttcaggcagttattgagatgtgtcagttactggtcatgggaaatgaggagacactgggagggtttcctgtcaagagtgttgttccagctttgattacgttacttcagatggagcacaattttgatattatgaaccatgcttgtcgagccttaacatacatgatggaagcacttcctcgatcttctgctgttgtagtagatgctattcctgtctttttagaaaagctgcaagttattcagtgtattgatgtggcagagcaggccttgactgccttggagatgttgtcacggagacatagtaaagccattctacaggcgggtggtttggcagactgcttgctgtacctagaattcttcagcataaatgcccaaagaaatgcattagcaattgcagctaattgctgccagagtatcacgccagatgaatttcattttgtggcagattcactcccattgctaacccaaaggctaacacatcaggataaaaagtcagtagaaagcacttgcctttgttttgcacgcctagtggacaacttccagcatgaggagaatttactccagcaggttgcttccaaagatctgcttacaaatgttcaacagctgttggtagtgactccacccattttaagttctgggatgtttataatggtggttcgcatgttttctctgatgtgttccaactgtccaactttagctgttcaacttatgaaacaaaacattgcagaaacgcttcactttctcctgtgtggtgcctccaatggaagttgtcaggaacagattgatcttgttccacgaagccctcaagagttgtatgaactgacatctctgatttgtgaacttatgccatgtttaccaaaagaaggcatttttgcagttgataccatgttgaagaagggaaatgcacagaacacagatggtgcgatatggcagtggcgtgatgatcggggcctctggcatccatataacaggattgacagccggatcattgaggcagcccatcaggtcggtgaggatgagataagcttgtccactctgggacgagtttatactattgattttaattctatgcagcaaatcaatgaggacacgggaacagcacgtgccattcagagaaaacctaacccgttagccaatagtaacactagtggatattcagagtcaaagaaggatgatgctcgagcacagcttatgaaagaggatccggaactggctaagtcttttattaagacattatttggtgttctttatgaagtgtatagttcctcagcaggacctgcggtcagacataagtgccttagagcaattcttaggataatttattttgcggatgctgaacttctgaaggatgttctgaaaaatcatgctgtttcaagtcacattgcttccatgctgtcaagccaagacctgaagatagtagtgggagcacttcagatggcagaaattttaatgcagaagttacctgatatttttagtgtttacttcagaagagaaggtgtaatgcatcaagtaaaacacttagcagaatcagagtctttgttgacaagtccaccaaaggcatgtacgaatggatcgggatccatgggatccacaacttcagtcagcagtgggacagccacagctgccactcatgctgcagctgacttgggatcacccagcttgcagcacagcagggatgattctttagatctcagccctcaaggtcgattaagtgatgttctaaagagaaaacgactgccaaaacgagggccaagaaggccaaagtactcacctccaagagatgatgacaaagtagacaatcaagctaaaagccccaccactactcagtcacctaaatcttctttcctggcaagcttgaatccaaaaacatggggaaggttaagtacacagtccaacagcaacaacattgagccagcacggactgcgggaggtagtggccttgccagggctgcctcaaaggataccatctccaataatagagaaaaaattaaaggttggattaaggagcaggcacataaatttgtagaacgttatttcagttctgagaatatggatggaagcaaccctgcattgaatgtccttcagagactttgtgctgcaaccgaacaactcaacctccaggtggatggtggagctgagtgccttgtagaaatccgtagcatagtctcagagtcagatgtttcatcatttgaaatccaacatagtggatttgtgaagcagctgttgctttatttgacatctaaaagtgaaaaggatgctgtgagcagagagatcagattaaagcgatttcttcatgtatttttttcttctccacttcctggagaagagcccattggaagagtggaaccagtgggtaatgcacctttgttggcattagttcacaagatgaacaactgcctcagccagatggaacaatttccagtcaaagtacatgatttccctagtggaaatgggacaggaggcagcttttctctcaacagaggatcacaggctttaaaatttttcaacacacatcaattaaaatgccagttacaaaggcatccagactgtgcaaatgtgaagcagtggaagggtggacctgtcaagattgaccctctggctttggtacaagccatcgagagataccttgtagttagagggtatggaagagtaagagaagatgatgaagacagcgatgacgatggatcagatgaggaaatagatgagtctctggctgctcagttcctaaattcaggaaatgtaagacacaggctgcagttttatattggagaacatttgctgccgtataacatgactgtgtatcaggcagtacggcagtttagtatacaggctgaagatgaaagagaatccacagatgatgagagcaatcctctaggcagagctggtatttggacaaagactcatacaatatggtataaacctgtgagagaggatgaagaaagtaataaagattgtgttggtggtaaaagaggaagagcccaaacagctccaacgaaaacttcccctagaaatgcaaaaaagcatgatgagttatggcacgatggagtgtgcccatcagtatcaaatcctttagaagtttacctcattcccacaccacctgaaaatataacatttgaagacccgtcattagatgtgatccttcttttaagagttttacatgctatcagtcgatactggtattacttgtatgataatgcaatgtgcaaggaaattattccaactagtgaatttattaacagtaagttaacagcaaaagcaaataggcaacttcaagatcctttagtaatcatgacaggaaacatcccaacatggcttactgagctaggaaaaacctgcccatttttctttccttttgatacccggcaaatgcttttttatgtaactgcatttgatcgggaccgagcaatgcaaagattacttgataccaacccagaaatcaaccagtctgattctcaagatagcagagttgcacctagattggatagaaaaaaacgtactgtgaaccgagaggagctgctgaaacaggcggagtctgtgatgcaggacctcggcagctcacgggccatgttagaaatccagtatgaaaatgaggttggtacaggtcttgggcctacactggagttttatgcgcttgtatctcaggaactacagagagctgacttgggtctttggagaggtgaagaagtaactcttagcaatccaaaagggagccaagaagggaccaagtatattcaaaacctccagggcctgtttgcgcttccctttggtaggagctttgcctgggatactctaggcacctcag

SEQ ID NO: 408546 - DNA, 4443 bp, Homo sapiens
gtgctgcggctcagctgataattgaaggaacccggagccgccgccgccgcgccgctggggggggtggggggagctagtggaagttactgccgcgccaccgagtccggaccggagactttggggcctaactagtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaagaaaaaggacagagagttcttgtgtaaagagtggctccgggtctgaatcaactggtgcagaagagagatctgcgaaacctaccaagctggcttcaaaatcagccacctcagccaaagctgggtgtagcaccatcactgattcttcttctgctgcctctacttcctcctcgtcttctgctgtagcctcggcctcctccactgtaccaccaggtgccagagtgaaacaaggaaaagatcagaacaaggccaggcgttcccgttcagcgtccagtcccagccccagaagaagtagcagggaaaaggaacagaggtcttctaagtcagagacatcaaaacctggaccttctggattacaggccaaattagcaagtttaagaaaatctacgaagaaacgcagtgagtctccacctgctgagctccccagtttgaggcggagcacacgccaaaagaccacgggctcctgtgctagtaccagtcggcgaggctctggcctgggcaaaagaggagcagctgaagctcgtcgacaggagaaaatggcagaccctgaaagcaaccaggaggcagtaaattcttcagctgctcggacagatgaagctccccaaggagctgcaggggctgttggcatgaccacctctggggagagtgaatcagatgattccgagatgggacgtttgcaagctttgttagaggcaaggggtcttccccctcacctatttggtcctcttggtcctcggatgtcacagcttttccatagaacaattggaagtggagctagttctaaggcccagcagctactacaaggattgcaagccagtgatgaaagtcaacagcttcaggcagttattgagatgtgtcagttactggtcatgggaaatgaggagacactgggagggtttcctgtcaagagtgttgttccagctttgattacgttacttcagatggagcacaattttgatattatgaaccatgcttgtcgagccttaacatacatgatggaagcacttcctcgatcttctgctgttgtagtagatgctattcctgtctttttagaaaagctgcaagttattcagtgtattgatgtggcagagcaggccttgactgccttggagatgttgtcacggagacatagtaaagccattctacaggcgggtggtttggcagactgcttgctgtacctagaattcttcagcataaatgcccaaagaaatgcattagcaattgcagctaattgctgccagagtatcacgccagatgaatttcattttgtggcagattcactcccattgctaacccaaaggctaacacatcaggataaaaagtcagtagaaagcacttgcctttgttttgcacgcctagtggacaacttccagcatgaggagaatttactccagcaggttgcttccaaagatctgcttacaaatgttcaacagctgttggtagtgactccacccattttaagttctgggatgtttataatggtggttcgcatgttttctctgatgtgttccaactgtccaactttagctgttcaacttatgaaacaaaacattgcagaaacgcttcactttctcctgtgtggtgcctccaatggaagttgtcaggaacagattgatcttgttccacgaagccctcaagagttgtatgaactgacatctctgatttgtgaacttatgccatgtttaccaaaagaaggcatttttgcagttgataccatgttgaagaagggaaatgcacagaacacagatggtgcgatatggcagtggcgtgatgatcggggcctctggcatccatataacaggattgacagccggatcattgaggcagcccatcaggtcggtgaggatgagataagcttgtccactctgggacgagtttatactattgattttaattctatgcagcaaatcaatgaggacacgggaacagcacgtgccattcagagaaaacctaacccgttagccaatagtaacactagtggatattcagagtcaaagaaggatgatgctcgagcacagcttatgaaagaggatccggaactggctaagtcttttattaagacattatttggtgttctttatgaagtgtatagttcctcagcaggacctgcggtcagacataagtgccttagagcaattcttaggataatttattttgcggatgctgaacttctgaaggatgttctgaaaaatcatgctgtttcaagtcacattgcttccatgctgtcaagccaagacctgaagatagtagtgggagcacttcagatggcagaaattttaatgcagaagttacctgatatttttagtgtttacttcagaagagaaggtgtaatgcatcaagtaaaacacttagcagaatcagagtctttgttgacaagtccaccaaaggcatgtacgaatggatcgggatccatgggatccacaacttcagtcagcagtgggacagccacagctgccactcatgctgcagctgacttgggatcacccagcttgcagcacagcagggatgattctttagatctcagccctcaaggtcgattaagtgatgttctaaagagaaaacgactgccaaaacgagggccaagaaggccaaagtactcacctccaagagatgatgacaaagtagacaatcaagctaaaagccccaccactactcagtcacctaaatcttctttcctggcaagcttgaatccaaaaacatggggaaggttaagtacacagtccaacagcaacaacattgagccagcacggactgcgggaggtagtggccttgccagggctgcctcaaaggataccatctccaataatagagaaaaaattaaaggttggattaaggagcaggcacataaatttgtagaacgttatttcagttctgagaatatggatggaagcaaccctgcattgaatgtccttcagagactttgtgctgcaaccgaacaactcaacctccaggtggatggtggagctgagtgccttgtagaaatccgtagcatagtctcagagtcagatgtttcatcatttgaaatccaacatagtggatttgtgaagcagctgttgctttatttgacatctaaaagtgaaaaggatgctgtgagcagagagatcagattaaagcgatttcttcatgtatttttttcttctccacttcctggagaagagcccattggaagagtggaaccagtgggtaatgcacctttgttggcattagttcacaagatgaacaactgcctcagccagatggaacaatttccagtcaaagtacatgatttccctagtggaaatgggacaggaggcagcttttctctcaacagaggatcacaggctttaaaatttttcaacacacatcaattaaaatgccagttacaaaggcatccagactgtgcaaatgtgaagcagtggaagggtggacctgtcaagattgaccctctggctttggtacaagccatcgagagataccttgtagttagagggtatggaagagtaagagaagatgatgaagacagcgatgacgatggatcagatgaggaaatagatgagtctctggctgctcagttcctaaattcaggaaatgtaagacacaggctgcagttttatattggagaacatttgctgccgtataacatgactgtgtatcaggcagtacggcagtttagtatacaggctgaagatgaaagagaatccacagatgatgagagcaatcctctaggcagagctggtatttggacaaagactcatacaatatggcaagtctgaaaattctttcttttgttttttcataaactttgaaactgttcttgtgttttagaattcacattaactta

SEQ ID NO: 408547 - DNA, 2484 bp, Homo sapiens
gtgctgcggctcagctgataattgaaggaacccggagccgccgccgccgcgccgctggggggggtggggggagctagtggaagttactgccgcgccaccgagtccggaccggagactttggggcctaactagtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaagaaaaaggacagagagttcttgtgtaaagagtggctccgggtctgaatcaactggtgcagaagagagatctgcgaaacctaccaagctggcttcaaaatcagccacctcagccaaagctgggtgtagcaccatcactgattcttcttctgctgcctctacttcctcctcgtcttctgctgtagcctcggcctcctccactgtaccaccaggtgccagagtgaaacaaggaaaagatcagaacaaggccaggcgttcccgttcagcgtccagtcccagccccagaagaagtagcagggaaaaggaacagaggtcttctaagtcagagacatcaaaacctggaccttctggattacaggccaaattagcaagtttaagaaaatctacgaagaaacgcagtgagtctccacctgctgagctccccagtttgaggcggagcacacgccaaaagaccacgggctcctgtgctagtaccagtcggcgaggctctggcctgggcaaaagaggagcagctgaagctcgtcgacaggagaaaatggcagaccctgaaagcaaccaggaggcagtaaattcttcagctgctcggacagatgaagctccccaaggagctgcaggggctgttggcatgaccacctctggggagagtgaatcagatgattccgagatgggacgtttgcaagctttgttagaggcaaggggtcttccccctcacctatttggtcctcttggtcctcggatgtcacagcttttccatagaacaattggaagtggagctagttctaaggcccagcagctactacaaggattgcaagccagtgatgaaagtcaacagcttcaggcagttattgagatgtgtcagttactggtcatgggaaatgaggagacactgggagggtttcctgtcaagagtgttgttccagctttgattacgttacttcagatggagcacaattttgatattatgaaccatgcttgtcgagccttaacatacatgatggaagcacttcctcgatcttctgctgttgtagtagatgctattcctgtctttttagaaaagctgcaagttattcagtgtattgatgtggcagagcaggccttgactgccttggagatgttgtcacggagacatagtaaagccattctacaggcgggtggtttggcagactgcttgctgtacctagaattcttcagcataaatgcccaaagaaatgcattagcaattgcagctaattgctgccagagtatcacgccagatgaatttcattttgtggcagattcactcccattgctaacccaaaggctaacacatcaggataaaaagtcagtagaaagcacttgcctttgttttgcacgcctagtggacaacttccagcatgaggagaatttactccagcaggttgcttccaaagatctgcttacaaatgttcaacagctgttggtagtgactccacccattttaagttctgggatgtttataatggtggttcgcatgttttctctgatgtgttccaactgtccaactttagctgttcaacttatgaaacaaaacattgcagaaacgcttcactttctcctgtgtggtgcctccaatggaagttgtcaggaacagattgatcttgttccacgaagccctcaagagttgtatgaactgacatctctgatttgtgaacttatgccatgtttaccaaaagaaggcatttttgcagttgataccatgttgaagaagggaaatgcacagaacacagatggtgcgatatggcagtggcgtgatgatcggggcctctggcatccatataacaggattgacagccggatcattgaggtagtagtttcatcgtaccgtttaaatgtgtctatttt

SEQ ID NO: 408548 - DNA, 630 bp, Homo sapiens
  misc_feature (630)..(630): n is a, c, g, or t
gcggccgcggccggagggaccggggcctggcgggaggtaggggtcgctgggtccctcctccggcttcccgcaatgaggagggcccttcacagaaccgggtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaaggtcacatttagggcaggcaaaacataagggatatagccctcctgagagtagaaaatctaattctaaggcacccaaagtgcagtctaatactacttctgaactgtcaaggggacacctttctaaaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctcccaaaagaaggcagaaaagaaggagcgcgagagaataaagcgagatcggccgaan

SEQ ID NO: 408549 - DNA, 346 bp, Homo sapiens
gtaagtaaaaatgttccttccctgaaatccctcaataattagccaactgctattgttacttgtaacctattgatgtaagtattaagaagtttttcatcaactttaacccatttttaaaaataaggctgtgtacaatcacaccttaaatacagctttcattgctgaattatccagattttgtagcgagattgattctgtttgaacaaaataagaataaagaatctcaaacaattacattgataattatggcacctgatggcatgttttgcatagatttgaatcttgagtttgtcataatgatgtatttgtcaaggtgagaggataaaatattaaacagtttgctagc

SEQ ID NO: 408550 - DNA, 7692 bp, Homo sapiens
gtgctgcggctcagctgataattgaaggaacccggagccgccgccgccgcgccgctggggggggtggggggagctagtggaagttactgccgcgccaccgagtccggaccggagactttggggcctaactagtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaagaaaaaggacagagagttcttgtgtaaagagtggctccgggtctgaatcaactggtgcagaagagagatctgcgaaacctaccaagctggcttcaaaatcagccacctcagccaaagctgggtgtagcaccatcactgattcttcttctgctgcctctacttcctcctcgtcttctgctgtagcctcggcctcctccactgtaccaccaggtgccagagtgaaacaaggaaaagatcagaacaaggccaggcgttcccgttcagcgtccagtcccagccccagaagaagtagcagggaaaaggaacagaggtcttctaagtcagagacatcaaaacctggaccttctggattacaggccaaattagcaagtttaagaaaatctacgaagaaacgcagtgagtctccacctgctgagctccccagtttgaggcggagcacacgccaaaagaccacgggctcctgtgctagtaccagtcggcgaggctctggcctgggcaaaagaggagcagctgaagctcgtcgacaggagaaaatggcagaccctgaaagcaaccaggaggcagtaaattcttcagctgctcggacagatgaagctccccaaggagctgcaggggctgttggcatgaccacctctggggagagtgaatcagatgattccgagatgggacgtttgcaagctttgttagaggcaaggggtcttccccctcacctatttggtcctcttggtcctcggatgtcacagcttttccatagaacaattggaagtggagctagttctaaggcccagcagctactacaaggattgcaagccagtgatgaaagtcaacagcttcaggcagttattgagatgtgtcagttactggtcatgggaaatgaggagacactgggagggtttcctgtcaagagtgttgttccagctttgattacgttacttcagatggagcacaattttgatattatgaaccatgcttgtcgagccttaacatacatgatggaagcacttcctcgatcttctgctgttgtagtagatgctattcctgtctttttagaaaagctgcaagttattcagtgtattgatgtggcagagcaggccttgactgccttggagatgttgtcacggagacatagtaaagccattctacaggcgggtggtttggcagactgcttgctgtacctagaattcttcagcataaatgcccaaagaaatgcattagcaattgcagctaattgctgccagagtatcacgccagatgaatttcattttgtggcagattcactcccattgctaacccaaaggctaacacatcaggataaaaagtcagtagaaagcacttgcctttgttttgcacgcctagtggacaacttccagcatgaggagaatttactccagcaggttgcttccaaagatctgcttacaaatgttcaacagctgttggtagtgactccacccattttaagttctgggatgtttataatggtggttcgcatgttttctctgatgtgttccaactgtccaactttagctgttcaacttatgaaacaaaacattgcagaaacgcttcactttctcctgtgtggtgcctccaatggaagttgtcaggaacagattgatcttgttccacgaagccctcaagagttgtatgaactgacatctctgatttgtgaacttatgccatgtttaccaaaagaaggcatttttgcagttgataccatgttgaagaagggaaatgcacagaacacagatggtgcgatatggcagtggcgtgatgatcggggcctctggcatccatataacaggattgacagccggatcattgaggcagcccatcaggtcggtgaggatgagataagcttgtccactctgggacgagtttatactattgattttaattctatgcagcaaatcaatgaggacacgggaacagcacgtgccattcagagaaaacctaacccgttagccaatagtaacactagtggatattcagagtcaaagaaggatgatgctcgagcacagcttatgaaagaggatccggaactggctaagtcttttattaagacattatttggtgttctttatgaagtgtatagttcctcagcaggacctgcggtcagacataagtgccttagagcaattcttaggataatttattttgcggatgctgaacttctgaaggatgttctgaaaaatcatgctgtttcaagtcacattgcttccatgctgtcaagccaagacctgaagatagtagtgggagcacttcagatggcagaaattttaatgcagaagttacctgatatttttagtgtttacttcagaagagaaggtgtaatgcatcaagtaaaacacttagcagaatcagagtctttgttgacaagtccaccaaaggcatgtacgaatggatcgggatccatgggatccacaacttcagtcagcagtgggacagccacagctgccactcatgctgcagctgacttgggatcacccagcttgcagcacagcagggatgattctttagatctcagccctcaaggtcgattaagtgatgttctaaagagaaaacgactgccaaaacgagggccaagaaggccaaagtactcacctccaagagatgatgacaaagtagacaatcaagctaaaagccccaccactactcagtcacctaaatcttctttcctggcaagcttgaatccaaaaacatggggaaggttaagtacacagtccaacagcaacaacattgagccagcacggactgcgggaggtagtggccttgccagggctgcctcaaaggataccatctccaataatagagaaaaaattaaaggttggattaaggagcaggcacataaatttgtagaacgttatttcagttctgagaatatggatggaagcaaccctgcattgaatgtccttcagagactttgtgctgcaaccgaacaactcaacctccaggtggatggtggagctgagtgccttgtagaaatccgtagcatagtctcagagtcagatgtttcatcatttgaaatccaacatagtggatttgtgaagcagctgttgctttatttgacatctaaaagtgaaaaggatgctgtgagcagagagatcagattaaagcgatttcttcatgtatttttttcttctccacttcctggagaagagcccattggaagagtggaaccagtgggtaatgcacctttgttggcattagttcacaagatgaacaactgcctcagccagatggaacaatttccagtcaaagtacatgatttccctagtggaaatgggacaggaggcagcttttctctcaacagaggatcacaggctttaaaatttttcaacacacatcaattaaaatgccagttacaaaggcatccagactgtgcaaatgtgaagcagtggaagggtggacctgtcaagattgaccctctggctttggtacaagccatcgagagataccttgtagttagagggtatggaagagtaagagaagatgatgaagacagcgatgacgatggatcagatgaggaaatagatgagtctctggctgctcagttcctaaattcaggaaatgtaagacacaggctgcagttttatattggagaacatttgctgccgtataacatgactgtgtatcaggcagtacggcagtttagtatacaggctgaagatgaaagagaatccacagatgatgagagcaatcctctaggcagagctggtatttggacaaagactcatacaatatggtataaacctgtgagagaggatgaagaaagtaataaagattgtgttggtggtaaaagaggaagagcccaaacagctccaacgaaaacttcccctagaaatgcaaaaaagcatgatgagttatggcacgatggagtgtgcccatcagtatcaaatcctttagaagtttacctcattcccacaccacctgaaaatataacatttgaagacccgtcattagatgtgatccttcttttaagagttttacatgctatcagtcgatactggtattacttgtatgataatgcaatgtgcaaggaaattattccaactagtgaatttattaacagtaagttaacagcaaaagcaaataggcaacttcaagatcctttagtaatcatgacaggaaacatcccaacatggcttactgagctaggaaaaacctgcccatttttctttccttttgatacccggcaaatgcttttttatgtaactgcatttgatcgggaccgagcaatgcaaagattacttgataccaacccagaaatcaaccagtctgattctcaagatagcagagttgcacctagattggatagaaaaaaacgtactgtgaaccgagaggagctgctgaaacaggcggagtctgtgatgcaggacctcggcagctcacgggccatgttagaaatccagtatgaaaatgaggttggtacaggtcttgggcctacactggagttttatgcgcttgtatctcaggaactacagagagctgacttgggtctttggagaggtgaagaagtaactcttagcaatccaaaagggagccaagaagggaccaagtatattcaaaacctccagggcctgtttgcgcttccctttggtaggacagcaaagccagctcatatcgcaaaggttaagatgaagtttcgcttcttaggaaaattaatggccaaggctatcatggatttcagattggtggaccttccccttggcttacccttttataaatggatgctacggcaagaaacttcactgacatcacacgatttgtttgacatcgacccagttgtagccagatcagtttatcacctagaagacattgtcagacagaagaaaagacttgaacaagataaatcccagaccaaagagagtctacagtatgcattagaaaccttgactatgaatggctgctcagttgaagatctaggactggatttcactctgccagggtttcccaatatcgaactgaagaaaggagggaaggatataccagtcactatccacaatttagaggagtatctaagactggttatattctgggcactaaatgaaggcgtttctaggcaatttgattcgttcagagatggatttgaatcagtcttcccactcagtcatcttcagtacttctacccggaggaactggatcagctcctttgtggcagtaaagcagacacttgggatgcaaagacactgatggaatgctgtaggcctgatcatggttatactcatgacagtcgggctgtgaagtttttgtttgagattctcagtagttttgataatgagcagcagaggttatttctccagtttgtgactggtagcccaagattgcctgttggaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtaggaaaaacggcttgcagattataaagagacatttggttgatattcattaatggccccatggacttaaagtgatcaggccctaaaacgttgttgtgatgaggtttctttagcaagttcttgtttaaattatcatttatttgatgagtgaagtttttaacatgctttgctgtgtgaaatttaaaaaagggatgtttttccaggctggaacaataaatgtggctgtgcagtttaattctgggctgtgtgtatccatctagctaagtctgcagttttctttcctccaaagacaactcttgtacataagtacagaaatttaagctcacatgtatttgacaaatatagtttagtagactagctctatgtgcttttcactttcctctgattttctctccctgattcattattatctgtgcagctcacagttttttttttgtatacaactcacagttctcaaattttcgttacccatgggcttctgttgtcccatgttctctccagttaagatctaatttaaaattcattggattgaaatttattgaatataattcagcttttgtaactaggtagacttttcttatagtttagttttaatatagtttagggtattactggctttttcccaggtgacacactaaggactgtttacatggcaattccagcagcaacagcctctggaatgagacaaggaaagctcatttgtttcttttatgaaggttaagaagtctacagcttgggctggccggtatttattattctgtggccagaggattttaaattaatgtaaattttttaaacaaaataagcagttttccttccctgttggagtaaaaaaatttttttccctttgttgttttacgtttttgttcatagtcttctttattccacgctcctcttccccttctcccagtgctgacttgggacaaaacagttcagcctttgtctcgacgcagataaaagcacctgtaagcaatgctgtccagtcattttatgtgctgatttctcaaatctgcaataatccatcaggttaatgtttttacctgaaaataaagaaagtttgcttcacctttttgtttatagttttgtgctgtatgcataactttcaattgtatagatgtatttcaatgcaaggaaatccacatatctccatgattcgggtcatggctgattttgctattcaaacaatttataatagcaacttgaagaaactaaaatgtgaagagaaaatgggaggagattccttcctaaggtccaaaactaggcctgtggcataaatttgaaggaattttccataattcatctccttgaaaataagagatgagctagtttttttttttaattgaactttgagaaatcaatttttttgactgttctgtaagttttaattaattgacacaaaagcccttttccctatcccaccacccaaaagaa

SEQ ID NO: 408551 - DNA, 7659 bp, Homo sapiens
gcggccgcggccggagggaccggggcctggcgggaggtaggggtcgctgggtccctcctccggcttcccgcaatgaggagggcccttcacagaaccgggtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaagaaaaaggacagagagttcttgtgtaaagagtggctccgggtctgaatcaactggtgcagaagagagatctgcgaaacctaccaagctggcttcaaaatcagccacctcagccaaagctgggtgtagcaccatcactgattcttcttctgctgcctctacttcctcctcgtcttctgctgtagcctcggcctcctccactgtaccaccaggtgccagagtgaaacaaggaaaagatcagaacaaggccaggcgttcccgttcagcgtccagtcccagccccagaagaagtagcagggaaaaggaacagaggtcttctaagtcagagacatcaaaacctggaccttctggattacaggccaaattagcaagtttaagaaaatctacgaagaaacgcagtgagtctccacctgctgagctccccagtttgaggcggagcacacgccaaaagaccacgggctcctgtgctagtaccagtcggcgaggctctggcctgggcaaaagaggagcagctgaagctcgtcgacaggagaaaatggcagaccctgaaagcaaccaggaggcagtaaattcttcagctgctcggacagatgaagctccccaaggagctgcaggggctgttggcatgaccacctctggggagagtgaatcagatgattccgagatgggacgtttgcaagctttgttagaggcaaggggtcttccccctcacctatttggtcctcttggtcctcggatgtcacagcttttccatagaacaattggaagtggagctagttctaaggcccagcagctactacaaggattgcaagccagtgatgaaagtcaacagcttcaggcagttattgagatgtgtcagttactggtcatgggaaatgaggagacactgggagggtttcctgtcaagagtgttgttccagctttgattacgttacttcagatggagcacaattttgatattatgaaccatgcttgtcgagccttaacatacatgatggaagcacttcctcgatcttctgctgttgtagtagatgctattcctgtctttttagaaaagctgcaagttattcagtgtattgatgtggcagagcaggccttgactgccttggagatgttgtcacggagacatagtaaagccattctacaggcgggtggtttggcagactgcttgctgtacctagaattcttcagcataaatgcccaaagaaatgcattagcaattgcagctaattgctgccagagtatcacgccagatgaatttcattttgtggcagattcactcccattgctaacccaaaggctaacacatcaggataaaaagtcagtagaaagcacttgcctttgttttgcacgcctagtggacaacttccagcatgaggagaatttactccagcaggttgcttccaaagatctgcttacaaatgttcaacagctgttggtagtgactccacccattttaagttctgggatgtttataatggtggttcgcatgttttctctgatgtgttccaactgtccaactttagctgttcaacttatgaaacaaaacattgcagaaacgcttcactttctcctgtgtggtgcctccaatggaagttgtcaggaacagattgatcttgttccacgaagccctcaagagttgtatgaactgacatctctgatttgtgaacttatgccatgtttaccaaaagaaggcatttttgcagttgataccatgttgaagaagggaaatgcacagaacacagatggtgcgatatggcagtggcgtgatgatcggggcctctggcatccatataacaggattgacagccggatcattgaggcagcccatcaggtcggtgaggatgagataagcttgtccactctgggacgagtttatactattgattttaattctatgcagcaaatcaatgaggacacgggaacagcacgtgccattcagagaaaacctaacccgttagccaatagtaacactagtggatattcagagtcaaagaaggatgatgctcgagcacagcttatgaaagaggatccggaactggctaagtcttttattaagacattatttggtgttctttatgaagtgtatagttcctcagcaggacctgcggtcagacataagtgccttagagcaattcttaggataatttattttgcggatgctgaacttctgaaggatgttctgaaaaatcatgctgtttcaagtcacattgcttccatgctgtcaagccaagacctgaagatagtagtgggagcacttcagatggcagaaattttaatgcagaagttacctgatatttttagtgtttacttcagaagagaaggtgtaatgcatcaagtaaaacacttagcagaatcagagtctttgttgacaagtccaccaaaggcatgtacgaatggatcgggatccatgggatccacaacttcagtcagcagtgggacagccacagctgccactcatgctgcagctgacttgggatcacccagcttgcagcacagcagggatgattctttagatctcagccctcaaggtcgattaagtgatgttctaaagagaaaacgactgccaaaacgagggccaagaaggccaaagtactcacctccaagagatgatgacaaagtagacaatcaagctaaaagccccaccactactcagtcacctaaatcttctttcctggcaagcttgaatccaaaaacatggggaaggttaagtacacagtccaacagcaacaacattgagccagcacggactgcgggaggtagtggccttgccagggctgcctcaaaggataccatctccaataatagagaaaaaattaaaggttggattaaggagcaggcacataaatttgtagaacgttatttcagttctgagaatatggatggaagcaaccctgcattgaatgtccttcagagactttgtgctgcaaccgaacaactcaacctccaggtggatggtggagctgagtgccttgtagaaatccgtagcatagtctcagagtcagatgtttcatcatttgaaatccaacatagtggatttgtgaagcagctgttgctttatttgacatctaaaagtgaaaaggatgctgtgagcagagagatcagattaaagcgatttcttcatgtatttttttcttctccacttcctggagaagagcccattggaagagtggaaccagtgggtaatgcacctttgttggcattagttcacaagatgaacaactgcctcagccagatggaacaatttccagtcaaagtacatgatttccctagtggaaatgggacaggaggcagcttttctctcaacagaggatcacaggctttaaaatttttcaacacacatcaattaaaatgccagttacaaaggcatccagactgtgcaaatgtgaagcagtggaagggtggacctgtcaagattgaccctctggctttggtacaagccatcgagagataccttgtagttagagggtatggaagagtaagagaagatgatgaagacagcgatgacgatggatcagatgaggaaatagatgagtctctggctgctcagttcctaaattcaggaaatgtaagacacaggctgcagttttatattggagaacatttgctgccgtataacatgactgtgtatcaggcagtacggcagtttagtatacaggctgaagatgaaagagaatccacagatgatgagagcaatcctctaggcagagctggtatttggacaaagactcatacaatatggtataaacctgtgagagaggatgaagaaagtaataaagattgtgttggtggtaaaagaggaagagcccaaacagctccaacgaaaacttcccctagaaatgcaaaaaagcatgatgagttatggcacgatggagtgtgcccatcagtatcaaatcctttagaagtttacctcattcccacaccacctgaaaatataacatttgaagacccgtcattagatgtgatccttcttttaagagttttacatgctatcagtcgatactggtattacttgtatgataatgcaatgtgcaaggaaattattccaactagtgaatttattaacagtaagttaacagcaaaagcaaataggcaacttcaagatcctttagtaatcatgacaggaaacatcccaacatggcttactgagctaggaaaaacctgcccatttttctttccttttgatacccggcaaatgcttttttatgtaactgcatttgatcgggaccgagcaatgcaaagattacttgataccaacccagaaatcaaccagtctgattctcaagatagcagagttgcacctagattggatagaaaaaaacgtactgtgaaccgagaggagctgctgaaacaggcggagtctgtgatgcaggacctcggcagctcacgggccatgttagaaatccagtatgaaaatgaggttggtacaggtcttgggcctacactggagttttatgcgcttgtatctcaggaactacagagagctgacttgggtctttggagaggtgaagaagtaactcttagcaatccaaaagggagccaagaagggaccaagtatattcaaaacctccagggcctgtttgcgcttccctttggtaggacagcaaagccagctcatatcgcaaaggttaagatgaagtttcgcttcttaggaaaattaatggccaaggctatcatggatttcagattggtggaccttccccttggcttacccttttataaatggatgctacggcaagaaacttcactgacatcacacgatttgtttgacatcgacccagttgtagccagatcagtttatcacctagaagacattgtcagacagaagaaaagacttgaacaagataaatcccagaccaaagagagtctacagtatgcattagaaaccttgactatgaatggctgctcagttgaagatctaggactggatttcactctgccagggtttcccaatatcgaactgaagaaaggagggaaggatataccagtcactatccacaatttagaggagtatctaagactggttatattctgggcactaaatgaaggcgtttctaggcaatttgattcgttcagagatggatttgaatcagtcttcccactcagtcatcttcagtacttctacccggaggaactggatcagctcctttgtggcagtaaagcagacacttgggatgcaaagacactgatggaatgctgtaggcctgatcatggttatactcatgacagtcgggctgtgaagtttttgtttgagattctcagtagttttgataatgagcagcagaggttatttctccagtttgtgactggtagcccaagattgcctgttggaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtaggaaaaacggcttgcagattataaagagacatttggttgatattcattaatggccccatggacttaaagtgatcaggccctaaaacgttgttgtgatgaggtttctttagcaagttcttgtttaaattatcatttatttgatgagtgaagtttttaacatgctttgctgtgtgaaatttaaaaaagggatgtttttccaggctggaacaataaatgtggctgtgcagtttaattctgggctgtgtgtatccatctagctaagtctgcagttttctttcctccaaagacaactcttgtacataagtacagaaatttaagctcacatgtatttgacaaatatagtttagtagactagctctatgtgcttttcactttcctctgattttctctccctgattcattattatctgtgcagctcacagttttttttttgtatacaactcacagttctcaaattttcgttacccatgggcttctgttgtcccatgttctctccagttaagatctaatttaaaattcattggattgaaatttattgaatataattcagcttttgtaactaggtagacttttcttatagtttagttttaatatagtttagggtattactggctttttcccaggtgacacactaaggactgtttacatggcaattccagcagcaacagcctctggaatgagacaaggaaagctcatttgtttcttttatgaaggttaagaagtctacagcttgggctggccggtatttattattctgtggccagaggattttaaattaatgtaaattttttaaacaaaataagcagttttccttccctgttggagtaaaaaaatttttttccctttgttgttttacgtttttgttcatagtcttctttattccacgctcctcttccccttctcccagtgctgacttgggacaaaacagttcagcctttgtctcgacgcagataaaagcacctgtaagcaatgctgtccagtcattttatgtgctgatttctcaaatctgcaataatccatcaggttaatgtttttacctgaaaataaagaaagtttgcttcacctttttgtttatagttttgtgctgtatgcataactttcaattgtatagatgtatttcaatgcaaggaaatccacatatctccatgattcgggtcatggctgattttgctattcaaacaatttataatagcaacttgaagaaactaaaatgtgaagagaaaatgggaggagattccttcctaaggtccaaaactaggcctgtggcataaatttgaaggaattttccataattcatctccttgaaaataagagatgagctagtttttttttttaattgaactttgagaaatcaatttttttgactgttctgtaagttttaattaattgacacaaaagcccttttccctatcccaccacccaaaagaa

SEQ ID NO: 408552 - DNA, 4803 bp, Homo sapiens
catgtggggcatcacgggcagagtacctgatatttttagtatttacttcagaagagaaggtgtaatgcatcaagtaaaacacttagcagaatcagagtctttgttgacaagtccaccaaaggcatgtacgaatggatcgggatccatgggatccacaacttcagtcagcagtgggacagccacagctgccactcatgctgcagctgacttgggatcacccagcttgcagcacagcagggatgattctttagatctcagccctcaaggtcgattaagtgatgttctaaagagaaaacgactgccaaaacgagggccaagaaggccaaagtactcacctccaagagatgatgacaaagtagacaatcaagctaaaagccccaccactactcagtcacctaaatcttctttcctggcaagcttgaatccaaaaacatggggaaggttaagtacacagtccaacagcaacaacattgagccagcacggactgcgggaggtagtggccttgccagggctgcctcaaaggataccatctccaataatagagaaaaaattaaaggttggattaaggagcaggcacataaatttgtagaacgttatttcagttctgagaatatggatggaagcaaccctgcattgaatgtccttcagagactttgtgctgcaaccgaacaactcaacctccaggtggatggtggagctgagtgccttgtagaaatccgtagcatagtctcagagtcagatgtttcatcatttgaaatccaacatagtggatttgtgaagcagctgttgctttatttgacatctaaaagtgaaaaggatgctgtgagcagagagatcagattaaagcgatttcttcatgtatttttttcttctccacttcctggagaagagcccattggaagagtggaaccagtgggtaatgcacctttgttggcattagttcacaagatgaacaactgcctcagccagatggaacaatttccagtcaaagtacatgatttccctagtggaaatgggacaggaggcagcttttctctcaacagaggatcacaggctttaaaatttttcaacacacatcaattaaaatgccagttacaaaggcatccagactgtgcaaatgtgaagcagtggaagggtggacctgtcaagattgaccctctggctttggtacaagccatcgagagataccttgtagttagagggtatggaagagtaagagaagatgatgaagacagcgatgacgatggatcagatgaggaaatagatgagtctctggctgctcagttcctaaattcaggaaatgtaagacacaggctgcagttttatattggagaacatttgctgccgtataacatgactgtgtatcaggcagtacggcagtttagtatacaggctgaagatgaaagagaatccacagatgatgagagcaatcctctaggcagagctggtatttggacaaagactcatacaatatggtataaacctgtgagagaggatgaagaaagtaataaagattgtgttggtggtaaaagaggaagagcccaaacagctccaacgaaaacttcccctagaaatgcaaaaaagcatgatgagttatggcacgatggagtgtgcccatcagtatcaaatcctttagaagtttacctcattcccacaccacctgaaaatataacatttgaagacccgtcattagatgtgatccttcttttaagagttttacatgctatcagtcgatactggtattacttgtatgataatgcaatgtgcaaggaaattattccaactagtgaatttattaacagtaagttaacagcaaaagcaaataggcaacttcaagatcctttagtaatcatgacaggaaacatcccaacatggcttactgagctaggaaaaacctgcccatttttctttccttttgatacccggcaaatgcttttttatgtaactgcatttgatcgggaccgagcaatgcaaagattacttgataccaacccagaaatcaaccagtctgattctcaagatagcagagttgcacctagattggatagaaaaaaacgtactgtgaaccgagaggagctgctgaaacaggcggagtctgtgatgcaggacctcggcagctcacgggccatgttagaaatccagtatgaaaatgaggttggtacaggtcttgggcctacactggagttttatgcgcttgtatctcaggaactacagagagctgacttgggtctttggagaggtgaagaagtaactcttagcaatccaaaagggagccaagaagggaccaagtatattcaaaacctccagggcctgtttgcgcttccctttggtaggacagcaaagccagctcatatcgcaaaggttaagatgaagtttcgcttcttaggaaaattaatggccaaggctatcatggatttcagattggtggaccttccccttggcttacccttttataaatggatgctacggcaagaaacttcactgacatcacacgatttgtttgacatcgacccagttgtagccagatcagtttatcacctagaagacattgtcagacagaagaaaagacttgaacaagataaatcccagaccaaagagagtctacagtatgcattagaaaccttgactatgaatggctgctcagttgaagatctaggactggatttcactctgccagggtttcccaatatcgaactgaagaaaggagggaaggatataccagtcactatccacaatttagaggagtatctaagactggttatattctgggcactaaatgaaggcgtttctaggcaatttgattcgttcagagatggatttgaatcagtcttcccactcagtcatcttcagtacttctacccggaggaactggatcagctcctttgtggcagtaaagcagacacttgggatgcaaagacactgatggaatgctgtaggcctgatcatggttatactcatgacagtcgggctgtgaagtttttgtttgagattctcagtagttttgataatgagcagcagaggttatttctccagtttgtgactggtagcccaagattgcctgttggaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtaggaaaaacggcttgcagattataaagagacatttggttgatattcattaatggccccatggacttaaagtgatcaggccctaaaacgttgttgtgatgaggtttctttagcaagttcttgtttaaattatcatttatttgatgagtgaagtttttaacatgctttgctgtgtgaaatttaaaaaagggatgtttttccaggctggaacaataaatgtggctgtgcagtttaattctgggctgtgtgtatccatctagctaagtctgcagttttctttcctccaaagacaactcttgtacataagtacagaaatttaagctcacatgtatttgacaaatatagtttagtagactagctctatgtgcttttcactttcctctgattttctctccctgattcattattatctgtgcagctcacagttttttttttgtatacaactcacagttctcaaattttcgttacccatgggcttctgttgtcccatgttctctccagttaagatctaatttaaaattcattggattgaaatttattgaatataattcagcttttgtaactaggtagacttttcttatagtttagttttaatatagtttagggtattactggctttttcccaggtgacacactaaggactgtttacatggcaattccagcagcaacagcctctggaatgagacaaggaaagctcatttgtttcttttatgaaggttaagaagtctacagcttgggctggccggtatttattattctgtggccagaggattttaaattaatgtaaattttttaaacaaaataagcagttttccttccctgttggagtaaaaaaatttttttccctttgttgttttacgtttttgttcatagtcttctttattccacgctcctcttccccttctcccagtgctgacttgggacaaaacagttcagcctttgtctcgacgcagataaaagcacctgtaagcaatgctgtccagtcattttatgtgctgatttctcaaatctgcaataatccatcaggttaatgtttttacctgaaaataaagaaagtttgcttcacctttttgtttatagttttgtgctgtatgcataactttcaattgtatagatgtatttcaatgcaaggaaatccacatatctccatgattcgggtcatggctgattttgctattcaaacaatttataatagcaacttgaagaaactaaaatgtgaagagaaaatgggaggagattccttcctaaggtccaaaactaggcctgtggcataaatttgaaggaattttccataattcatctccttgaaaataagagatgagctagtttttttttttaattgaactttgagaaatcaatttttttgactgttctgtaagttttaattaattgacacaaaagcccttttccctatcccaccacccaaaagaa

SEQ ID NO: 408553 - DNA, 7527 bp, Homo sapiens
gtgctgcggctcagctgataattgaaggaacccggagccgccgccgccgcgccgctggggggggtggggggagctagtggaagttactgccgcgccaccgagtccggaccggagactttggggcctaactagtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaagaaaaaggacagagagttcttgtgtaaagagtggctccgggtctgaatcaactggtgcagaagagagatctgcgaaacctaccaagctggcttcaaaatcagccacctcagccaaagctgggtgtagcaccatcactgattcttcttctgctgcctctacttcctcctcgtcttctgctgtagcctcggcctcctccactgtaccaccaggtgccagagtgaaacaaggaaaagatcagaacaaggccaggcgttcccgttcagcgtccagtcccagccccagaagaagtagcagggaaaaggaacagaggtcttctaagtcagagacatcaaaacctggaccttctggattacaggccaaattagcaagtttaagaaaatctacgaagaaacgcagtgagtctccacctgctgagctccccagtttgaggcggagcacacgccaaaagaccacgggctcctgtgctagtaccagtcggcgaggctctggcctgggcaaaagaggagcagctgaagctcgtcgacaggagaaaatggcagaccctgaaagcaaccaggaggcagtaaattcttcagctgctcggacagatgaagctccccaaggagctgcaggggctgttggcatgaccacctctggggagagtgaatcagatgattccgagatgggacgtttgcaagctttgttagaggcaaggggtcttccccctcacctatttggtcctcttggtcctcggatgtcacagcttttccatagaacaattggaagtggagctagttctaaggcccagcagctactacaaggattgcaagccagtgatgaaagtcaacagcttcaggcagttattgagatgtgtcagttactggtcatgggaaatgaggagacactgggagggtttcctgtcaagagtgttgttccagctttgattacgttacttcagatggagcacaattttgatattatgaaccatgcttgtcgagccttaacatacatgatggaagcacttcctcgatcttctgctgttgtagtagatgctattcctgtctttttagaaaagctgcaagttattcagtgtattgatgtggcagagcaggccttgactgccttggagatgttgtcacggagacatagtaaagccattctacaggcgggtggtttggcagactgcttgctgtacctagaattcttcagcataaatgcccaaagaaatgcattagcaattgcagctaattgctgccagagtatcacgccagatgaatttcattttgtggcagattcactcccattgctaacccaaaggctaacacatcaggataaaaagtcagtagaaagcacttgcctttgttttgcacgcctagtggacaacttccagcatgaggagaatttactccagcaggttgcttccaaagatctgcttacaaatgttcaacagctgttggtagtgactccacccattttaagttctgggatgtttataatggtggttcgcatgttttctctgatgtgttccaactgtccaactttagctgttcaacttatgaaacaaaacattgcagaaacgcttcactttctcctgtgtggtgcctccaatggaagttgtcaggaacagattgatcttgttccacgaagccctcaagagttgtatgaactgacatctctgatttgtgaacttatgccatgtttaccaaaagaaggcatttttgcagttgataccatgttgaagaagggaaatgcacagaacacagatggtgcgatatggcagtggcgtgatgatcggggcctctggcatccatataacaggattgacagccggatcattgaggcagcccatcaggtcggtgaggatgagataagcttgtccactctgggacgagtttatactattgattttaattctatgcagcaaatcaatgaggacacgggaacagcacgtgccattcagagaaaacctaacccgttagccaatagtaacactagtggatattcagagtcaaagaaggatgatgctcgagcacagcttatgaaagaggatccggaactggctaagtcttttattaagacattatttggtgttctttatgaagtgtatagttcctcagcaggacctgcggtcagacataagtgccttagagcaattcttaggataatttattttgcggatgctgaacttctgaaggatgttctgaaaaatcatgctgtttcaagtcacattgcttccatgctgtcaagccaagacctgaagatagtagtgggagcacttcagatggcagaaattttaatgcagaagttacctgatatttttagtgtttacttcagaagagaaggtgtaatgcatcaagtaaaacacttagcagaatcagagtctttgttgacaagtccaccaaaggcatgtacgaatggatcgggatccatgggatccacaacttcagtcagcagtgggacagccacagctgccactcatgctgcagctgacttgggatcacccagcttgcagcacagcagggatgattctttagatctcagccctcaaggtcgattaagtgatgttctaaagagaaaacgactgccaaaacgagggccaagaaggccaaagtactcacctccaagagatgatgacaaagtagacaatcaagctaaaagccccaccactactcagtcacctaaatcttctttcctggcaagcttgaatccaaaaacatggggaaggttaagtacacagtccaacagcaacaacattgagccagcacggactgcgggaggtagtggccttgccagggctgcctcaaaggataccatctccaataatagagaaaaaattaaaggttggattaaggagcaggcacataaatttgtagaacgttatttcagttctgagaatatggatggaagcaaccctgcattgaatgtccttcagagactttgtgctgcaaccgaacaactcaacctccaggtggatggtggagctgagtgccttgtagaaatccgtagcatagtctcagagtcagatgtttcatcatttgaaatccaacatagtggatttgtgaagcagctgttgctttatttgacatctaaaagtgaaaaggatgctgtgagcagagagatcagattaaagcgatttcttcatgtatttttttcttctccacttcctggagaagagcccattggaagagtggaaccagtgggtaatgcacctttgttggcattagttcacaagatgaacaactgcctcagccagatggaacaatttccagtcaaagtacatgatttccctagtggaaatgggacaggaggcagcttttctctcaacagaggatcacaggctttaaaatttttcaacacacatcaattaaaatgccagttacaaaggcatccagactgtgcaaatgtgaagcagtggaagggtggacctgtcaagattgaccctctggctttggtacaagccatcgagagataccttgtagttagagggtatggaagagtaagagaagatgatgaagacagcgatgacgatggatcagatgaggaaatagatgagtctctggctgctcagttcctaaattcaggaaatgtaagacacaggctgcagttttatattggagaacatttgctgccgtataacatgactgtgtatcaggcagtacggcagtttagtatacaggctgaagatgaaagagaatccacagatgatgagagcaatcctctaggcagagctggtatttggacaaagactcatacaatatggtataaacctgtgagagaggatgaagaaagtaataaagattgtgttggtggtaaaagaggaagagcccaaacagctccaacgaaaacttcccctagaaatgcaaaaaagcatgatgagttatggcacgatggagtgtgcccatcagtatcaaatcctttagaagtttacctcattcccacaccacctgaaaatataacatttgaagacccgtcattagatgtgatccttcttttaagagttttacatgctatcagtcgatactggtattacttgtatgataatgcaatgtgcaaggaaattattccaactagtgaatttattaacagtaagttaacagcaaaagcaaataggcaacttcaagatcctttagtaatcatgacaggaaacatcccaacatggcttactgagctaggaaaaacctgcccatttttctttccttttgatacccggcaaatgcttttttatgtaactgcatttgatcgggaccgagcaatgcaaagattacttgataccaacccagaaatcaaccagtctgattctcaagatagcagagttgcacctagattggatagaaaaaaacgtactgtgaaccgagaggagctgctgaaacaggcggagtctgtgatgcaggacctcggcagctcacgggccatgttagaaatccagtatgaaaatgaggttggtacaggtcttgggcctacactggagttttatgcgcttgtatctcaggaactacagagagctgacttgggtctttggagaggtgaagaagtaactcttagcaatccaaaagggagccaagaagggaccaagtatattcaaaacctccagggcctgtttgcgcttccctttggtaggacagcaaagccagctcatatcgcaaaggttaagatgaagtttcgcttcttaggaaaattaatggccaaggctatcatggatttcagattggtggaccttccccttggcttacccttttataaatggatgctacggcaagaaacttcactgacatcacacgatttgtttgacatcgacccagttgtagccagatcagtttatcacctagaagacattgtcagacagaagaaaagacttgaacaagataaatcccagctggttatattctgggcactaaatgaaggcgtttctaggcaatttgattcgttcagagatggatttgaatcagtcttcccactcagtcatcttcagtacttctacccggaggaactggatcagctcctttgtggcagtaaagcagacacttgggatgcaaagacactgatggaatgctgtaggcctgatcatggttatactcatgacagtcgggctgtgaagtttttgtttgagattctcagtagttttgataatgagcagcagaggttatttctccagtttgtgactggtagcccaagattgcctgttggaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtaggaaaaacggcttgcagattataaagagacatttggttgatattcattaatggccccatggacttaaagtgatcaggccctaaaacgttgttgtgatgaggtttctttagcaagttcttgtttaaattatcatttatttgatgagtgaagtttttaacatgctttgctgtgtgaaatttaaaaaagggatgtttttccaggctggaacaataaatgtggctgtgcagtttaattctgggctgtgtgtatccatctagctaagtctgcagttttctttcctccaaagacaactcttgtacataagtacagaaatttaagctcacatgtatttgacaaatatagtttagtagactagctctatgtgcttttcactttcctctgattttctctccctgattcattattatctgtgcagctcacagttttttttttgtatacaactcacagttctcaaattttcgttacccatgggcttctgttgtcccatgttctctccagttaagatctaatttaaaattcattggattgaaatttattgaatataattcagcttttgtaactaggtagacttttcttatagtttagttttaatatagtttagggtattactggctttttcccaggtgacacactaaggactgtttacatggcaattccagcagcaacagcctctggaatgagacaaggaaagctcatttgtttcttttatgaaggttaagaagtctacagcttgggctggccggtatttattattctgtggccagaggattttaaattaatgtaaattttttaaacaaaataagcagttttccttccctgttggagtaaaaaaatttttttccctttgttgttttacgtttttgttcatagtcttctttattccacgctcctcttccccttctcccagtgctgacttgggacaaaacagttcagcctttgtctcgacgcagataaaagcacctgtaagcaatgctgtccagtcattttatgtgctgatttctcaaatctgcaataatccatcaggttaatgtttttacctgaaaataaagaaagtttgcttcacctttttgtttatagttttgtgctgtatgcataactttcaattgtatagatgtatttcaatgcaaggaaatccacatatctccatgattcgggtcatggctgattttgctattcaaacaatttataatagcaacttgaagaaactaaaatgtgaagagaaaatgggaggagattccttcctaaggtccaaaactaggcctgtggcataaatttgaaggaattttccataattcatctccttgaaaataagagatgagctagtttttttttttaattgaactttgagaaatcaatttttttgactgttctgtaagttttaattaattgacacaaaagcccttttccctatcccaccacccaaaagaa

SEQ ID NO: 408554 - DNA, 2440 bp, Homo sapiens
gttcagaggatcccttcgatggcgggcacttaatggccaaggctatcatggatgtcagataggtggaccttccccttggcttacccttttataaatggatgctacggcaagaaacttcactgacatcacacgatttgtttgacatcgacccagttgtagccagatcagtttatcacctagaagacattgtcagacagaagaaaagacttgaacaagataaatcccagaccaaagagagtctacagtatgcattagaaaccttgactatgaatggctgctcagttgaagatctaggactggatttcactctgccagggtttcccaatatcgaactgaagaaaggagggaaggatataccagtcactatccacaatttagaggagtatctaagactggttatattctgggcactaaatgaaggcgtttctaggcaatttgattcgttcagagatggatttgaatcagtcttcccactcagtcatcttcagtacttctacccggaggaactggatcagctcctttgtggcagtaaagcagacacttgggatgcaaagacactgatggaatgctgtaggcctgatcatggttatactcatgacagtcgggctgtgaagtttttgtttgagattctcagtagttttgataatgagcagcagaggttatttctccagtttgtgactggtagcccaagattgcctgttggaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtaggaaaaacggcttgcagattataaagagacatttggttgatattcattaatggccccatggacttaaagtgatcaggccctaaaacgttgttgtgatgaggtttctttagcaagttcttgtttaaattatcatttatttgatgagtgaagtttttaacatgctttgctgtgtgaaatttaaaaaagggatgtttttccaggctggaacaataaatgtggctgtgcagtttaattctgggctgtgtgtatccatctagctaagtctgcagttttctttcctccaaagacaactcttgtacataagtacagaaatttaagctcacatgtatttgacaaatatagtttagtagactagctctatgtgcttttcactttcctctgattttctctccctgattcattattatctgtgcagctcacagttttttttttgtatacaactcacagttctcaaattttcgttacccatgggcttctgttgtcccatgttctctccagttaagatctaatttaaaattcattggattgaaatttattgaatataattcagcttttgtaactaggtagacttttcttatagtttagttttaatatagtttagggtattactggctttttcccaggtgacacactaaggactgtttacatggcaattccagcagcaacagcctctggaatgagacaaggaaagctcatttgtttcttttatgaaggttaagaagtctacagcttgggctggccggtatttattattctgtggccagaggattttaaattaatgtaaattttttaaacaaaataagcagttttccttccctgttggagtaaaaaaatttttttccctttgttgttttacgtttttgttcatagtcttctttattccacgctcctcttccccttctcccagtgctgacttgggacaaaacagttcagcctttgtctcgacgcagataaaagcacctgtaagcaatgctgtccagtcattttatgtgctgatttctcaaatctgcaataatccatcaggttaatgtttttacctgaaaataaagaaagtttgcttcacctttttgtttatagttttgtgctgtatgcataactttcaattgtatagatgtatttcaatgcaaggaaatccacatatctccatgattcgggtcatggctgattttgctattcaaacaatttataatagcaacttgaagaaactaaaatgtgaagagaaaatgggaggagattccttcctaaggtccaaaactaggcctgtggcataaatttgaaggaattttccataattcatctccttgaaaataagagatgagctagtttttttttttaattgaactttgagaaatcaatttttttgactgttctgtaagttttaattaattgacacaaaagcccttttccctatcccaccacccaaaagaa

SEQ ID NO: 408555 - DNA, 2717 bp, Homo sapiens
gattacttgataccaacccagaaatctttgcatgctcggtcccgagcaatgcaaagattacttgataccaacccagaaatcaaccagtctgattctcaagatagcagagttgcacctagattggatagaaaaaaacgtactgtgaaccgagaggagctgctgaaacaggcggagtctgtgatgcaggacctcggcagctcacgggccatgttagaaatccagtatgaaaatgaggttggtacaggtcttgggcctacactggagttttatgcgcttgtatctcaggaactacagagagctgacttgggtctttggagaggtgaagaagtaactcttagcaatccaaaagggagccaagaagggaccaagtatattcaaaacctccagggcctgtttgcgcttccctttggtaggacagcaaagccagctcatatcgcaaaggttaagatgaagtttcgcttcttaggaaaattaatggccaaggctatcatggatttcagattggtggaccttccccttggcttacccttttataaatggatgctacggcaagaaacttcactgacatcacacgatttgtttgacatcgacccagttgtagccagatcagtttatcacctagaagacattgtcagacagaagaaaagacttgaacaagataaatcccagctggttatattctgggcactaaatgaaggcgtttctaggcaatttgattcgttcagagatggatttgaatcagtcttcccactcagtcatcttcagtacttctacccggaggaactggatcagctcctttgtggcagtaaagcagacacttgggatgcaaagacactgatggaatgctgtaggcctgatcatggttatactcatgacagtcgggctgtgaagtttttgtttgagattctcagtagttttgataatgagcagcagaggttatttctccagtttgtgactggtagcccaagattgcctgttggaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtaggaaaaacggcttgcagattataaagagacatttggttgatattcattaatggccccatggacttaaagtgatcaggccctaaaacgttgttgtgatgaggtttctttagcaagttcttgtttaaattatcatttatttgatgagtgaagtttttaacatgctttgctgtgtgaaatttaaaaaagggatgtttttccaggctggaacaataaatgtggctgtgcagtttaattctgggctgtgtgtatccatctagctaagtctgcagttttctttcctccaaagacaactcttgtacataagtacagaaatttaagctcacatgtatttgacaaatatagtttagtagactagctctatgtgcttttcactttcctctgattttctctccctgattcattattatctgtgcagctcacagttttttttttgtatacaactcacagttctcaaattttcgttacccatgggcttctgttgtcccatgttctctccagttaagatctaatttaaaattcattggattgaaatttattgaatataattcagcttttgtaactaggtagacttttcttatagtttagttttaatatagtttagggtattactggctttttcccaggtgacacactaaggactgtttacatggcaattccagcagcaacagcctctggaatgagacaaggaaagctcatttgtttcttttatgaaggttaagaagtctacagcttgggctggccggtatttattattctgtggccagaggattttaaattaatgtaaattttttaaacaaaataagcagttttccttccctgttggagtaaaaaaatttttttccctttgttgttttacgtttttgttcatagtcttctttattccacgctcctcttccccttctcccagtgctgacttgggacaaaacagttcagcctttgtctcgacgcagataaaagcacctgtaagcaatgctgtccagtcattttatgtgctgatttctcaaatctgcaataatccatcaggttaatgtttttacctgaaaataaagaaagtttgcttcacctttttgtttatagttttgtgctgtatgcataactttcaattgtatagatgtatttcaatgcaaggaaatccacatatctccatgattcgggtcatggctgattttgctattcaaacaatttataatagcaacttgaagaaactaaaatgtgaagagaaaatgggaggagattccttcctaaggtccaaaactaggcctgtggcataaatttgaaggaattttccataattcatctccttgaaaataagagatgagctagtttttttttttaattgaactttgagaaatcaatttttttgactgttctgtaagttttaattaattgacacaaaagcccttttccctatcccaccacccaaaagaa

SEQ ID NO: 408556 - DNA, 6152 bp, Homo sapiens
gtgctgcggctcagctgataattgaaggaacccggagccgccgccgccgcgccgctggggggggtggggggagctagtggaagttactgccgcgccaccgagtccggaccggagactttggggcctaactagtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaagaaaaaggacagagagttcttgtgtaaagagtggctccgggtctgaatcaactggtgcagaagagagatctgcgaaacctaccaagctggcttcaaaatcagccacctcagccaaagctgggtgtagcaccatcactgattcttcttctgctgcctctacttcctcctcgtcttctgctgtagcctcggcctcctccactgtaccaccaggtgccagagtgaaacaaggaaaagatcagaacaaggccaggcgttcccgttcagcgtccagtcccagccccagaagaagtagcagggaaaaggaacagaggtcttctaagtcagagacatcaaaacctggaccttctggattacaggccaaattagcaagtttaagaaaatctacgaagaaacgcagtgagtctccacctgctgagctccccagtttgaggcggagcacacgccaaaagaccacgggctcctgtgctagtaccagtcggcgaggctctggcctgggcaaaagaggagcagctgaagctcgtcgacaggagaaaatggcagaccctgaaagcaaccaggaggcagtaaattcttcagctgctcggacagatgaagctccccaaggagctgcaggggctgttggcatgaccacctctggggagagtgaatcagatgattccgagatgggacgtttgcaagctttgttagaggcaaggggtcttccccctcacctatttggtcctcttggtcctcggatgtcacagcttttccatagaacaattggaagtggagctagttctaaggcccagcagctactacaaggattgcaagccagtgatgaaagtcaacagcttcaggcagttattgagatgtgtcagttactggtcatgggaaatgaggagacactgggagggtttcctgtcaagagtgttgttccagctttgattacgttacttcagatggagcacaattttgatattatgaaccatgcttgtcgagccttaacatacatgatggaagcacttcctcgatcttctgctgttgtagtagatgctattcctgtctttttagaaaagctgcaagttattcagtgtattgatgtggcagagcaggccttgactgccttggagatgttgtcacggagacatagtaaagccattctacaggcgggtggtttggcagactgcttgctgtacctagaattcttcagcataaatgcccaaagaaatgcattagcaattgcagctaattgctgccagagtatcacgccagatgaatttcattttgtggcagattcactcccattgctaacccaaaggctaacacatcaggataaaaagtcagtagaaagcacttgcctttgttttgcacgcctagtggacaacttccagcatgaggagaatttactccagcaggttgcttccaaagatctgcttacaaatgttcaacagctgttggtagtgactccacccattttaagttctgggatgtttataatggtggttcgcatgttttctctgatgtgttccaactgtccaactttagctgttcaacttatgaaacaaaacattgcagaaacgcttcactttctcctgtgtggtgcctccaatggaagttgtcaggaacagattgatcttgttccacgaagccctcaagagttgtatgaactgacatctctgatttgtgaacttatgccatgtttaccaaaagaaggcatttttgcagttgataccatgttgaagaagggaaatgcacagaacacagatggtgcgatatggcagtggcgtgatgatcggggcctctggcatccatataacaggattgacagccggatcattgaggcagcccatcaggtcggtgaggatgagataagcttgtccactctgggacgagtttatactattgattttaattctatgcagcaaatcaatgaggacacgggaacagcacgtgccattcagagaaaacctaacccgttagccaatagtaacactagtggatattcagagtcaaagaaggatgatgctcgagcacagcttatgaaagaggatccggaactggctaagtcttttattaagacattatttggtgttctttatgaagtgtatagttcctcagcaggacctgcggtcagacataagtgccttagagcaattcttaggataatttattttgcggatgctgaacttctgaaggatgttctgaaaaatcatgctgtttcaagtcacattgcttccatgctgtcaagccaagacctgaagatagtagtgggagcacttcagatggcagaaattttaatgcagaagttacctgatatttttagtgtttacttcagaagagaaggtgtaatgcatcaagtaaaacacttagcagaatcagagtctttgttgacaagtccaccaaaggcatgtacgaatggatcgggatccatgggatccacaacttcagtcagcagtgggacagccacagctgccactcatgctgcagctgacttgggatcacccagcttgcagcacagcagggatgattctttagatctcagccctcaaggtcgattaagtgatgttctaaagagaaaacgactgccaaaacgagggccaagaaggccaaagtactcacctccaagagatgatgacaaagtagacaatcaagctaaaagccccaccactactcagtcacctaaatcttctttcctggcaagcttgaatccaaaaacatggggaaggttaagtacacagtccaacagcaacaacattgagccagcacggactgcgggaggtagtggccttgccagggctgcctcaaaggataccatctccaataatagagaaaaaattaaaggttggattaaggagcaggcacataaatttgtagaacgttatttcagttctgagaatatggatggaagcaaccctgcattgaatgtccttcagagactttgtgctgcaaccgaacaactcaacctccaggtggatggtggagctgagtgccttgtagaaatccgtagcatagtctcagagtcagatgtttcatcatttgaaatccaacatagtggatttgtgaagcagctgttgctttatttgacatctaaaagtgaaaaggatgctgtgagcagagagatcagattaaagcgatttcttcatgtatttttttcttctccacttcctggagaagagcccattggaagagtggaaccagtgggtaatgcacctttgttggcattagttcacaagatgaacaactgcctcagccagatggaacaatttccagtcaaagtacatgatttccctagtggaaatgggacaggaggcagcttttctctcaacagaggatcacaggctttaaaatttttcaacacacatcaattaaaatgccagttacaaaggcatccagactgtgcaaatgtgaagcagtggaagggtggacctgtcaagattgaccctctggctttggtacaagccatcgagagataccttgtagttagagggtatggaagagtaagagaagatgatgaagacagcgatgacgatggatcagatgaggaaatagatgagtctctggctgctcagttcctaaattcaggaaatgtaagacacaggctgcagttttatattggagaacatttgctgccgtataacatgactgtgtatcaggcagtacggcagtttagtatacaggctgaagatgaaagagaatccacagatgatgagagcaatcctctaggcagagctggtatttggacaaagactcatacaatatggtataaacctgtgagagaggatgaagaaagtaataaagattgtgttggtggtaaaagaggaagagcccaaacagctccaacgaaaacttcccctagaaatgcaaaaaagcatgatgagttatggcacgatggagtgtgcccatcagtatcaaatcctttagaagtttacctcattcccacaccacctgaaaatataacatttgaagacccgtcattagatgtgatccttcttttaagagttttacatgctatcagtcgatactggtattacttgtatgataatgcaatgtgcaaggaaattattccaactagtgaatttattaacagtaagttaacagcaaaagcaaataggcaacttcaagatcctttagtaatcatgacaggaaacatcccaacatggcttactgagctaggaaaaacctgcccatttttctttccttttgatacccggcaaatgcttttttatgtaactgcatttgatcgggaccgagcaatgcaaagattacttgataccaacccagaaatcaaccagtctgattctcaagatagcagagttgcacctagattggatagaaaaaaacgtactgtgaaccgagaggagctgctgaaacaggcggagtctgtgatgcaggacctcggcagctcacgggccatgttagaaatccagtatgaaaatgaggttggtacaggtcttgggcctacactggagttttatgcgcttgtatctcaggaactacagagagctgacttgggtctttggagaggtgaagaagtaactcttagcaatccaaaagggagccaagaagggaccaagtatattcaaaacctccagggcctgtttgcgcttccctttggtaggacagcaaagccagctcatatcgcaaaggttaagatgaagtttcgcttcttaggaaaattaatggccaaggctatcatggatttcagattggtggaccttccccttggcttacccttttataaatggatgctacggcaagaaacttcactgacatcacacgatttgtttgacatcgacccagttgtagccagatcagtttatcacctagaagacattgtcagacagaagaaaagacttgaacaagataaatcccagaccaaagagagtctacagtatgcattagaaaccttgactatgaatggctgctcagttgaagatctaggactggatttcactctgccagggtttcccaatatcgaactgaagaaaggagggaaggatataccagtcactatccacaatttagaggagtatctaagagtatgtaactgtgtctttggggggtaggccagttgtgaagacggaggactttgcctgattgtaccttgcttctggctgcacacgctatggcttgagaccttccacatccccaggaccactgcatgaaggctgctttacaaggcactagcttctctttgctcttgagtgcacatatcagatatttcctgtcttatataaccttgaattatttctcctcaggcttgaatgctatctaattacaccacgttttcttagtttaaaaaacaagtgaaaagagacattatttgtgttctcactaaattgcatttttgcatttccatcaaggcagctagcttgacagaatttactccaggcaccgtgcagtgcacacttttatgtttggtgacacctttcaaattactaacttatgggcgaggtgcagtggctcacgcctgtaatcctcccagcactttgtgaggcagaagcaggaggattacttgaggccagtagttcaagaccagcctgggca

SEQ ID NO: 408557 - DNA, 4970 bp, Homo sapiens
  misc_feature (4955)..(4955): n is a, c, g, or t
gtgctgcggctcagctgataattgaaggaacccggagccgccgccgccgcgccgctggggggggtggggggagctagtggaagttactgccgcgccaccgagtccggaccggagactttggggcctaactagtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaagaaaaaggacagagagttcttgtgtaaagagtggctccgggtctgaatcaactggtgcagaagagagatctgcgaaacctaccaagctggcttcaaaatcagccacctcagccaaagctgggtgtagcaccatcactgattcttcttctgctgcctctacttcctcctcgtcttctgctgtagcctcggcctcctccactgtaccaccaggtgccagagtgaaacaaggaaaagatcagaacaaggccaggcgttcccgttcagcgtccagtcccagccccagaagaagtagcagggaaaaggaacagaggtcttctaagtcagagacatcaaaacctggaccttctggattacaggccaaattagcaagtttaagaaaatctacgaagaaacgcagtgagtctccacctgctgagctccccagtttgaggcggagcacacgccaaaagaccacgggctcctgtgctagtaccagtcggcgaggctctggcctgggcaaaagaggagcagctgaagctcgtcgacaggagaaaatggcagaccctgaaagcaaccaggaggcagtaaattcttcagctgctcggacagatgaagctccccaaggagctgcaggggctgttggcatgaccacctctggggagagtgaatcagatgattccgagatgggacgtttgcaagctttgttagaggcaaggggtcttccccctcacctatttggtcctcttggtcctcggatgtcacagcttttccatagaacaattggaagtggagctagttctaaggcccagcagctactacaaggattgcaagccagtgatgaaagtcaacagcttcaggcagttattgagatgtgtcagttactggtcatgggaaatgaggagacactgggagggtttcctgtcaagagtgttgttccagctttgattacgttacttcagatggagcacaattttgatattatgaaccatgcttgtcgagccttaacatacatgatggaagcacttcctcgatcttctgctgttgtagtagatgctattcctgtctttttagaaaagctgcaagttattcagtgtattgatgtggcagagcaggccttgactgccttggagatgttgtcacggagacatagtaaagccattctacaggcgggtggtttggcagactgcttgctgtacctagaattcttcagcataaatgcccaaagaaatgcattagcaattgcagctaattgctgccagagtatcacgccagatgaatttcattttgtggcagattcactcccattgctaacccaaaggctaacacatcaggataaaaagtcagtagaaagcacttgcctttgttttgcacgcctagtggacaacttccagcatgaggagaatttactccagcaggttgcttccaaagatctgcttacaaatgttcaacagctgttggtagtgactccacccattttaagttctgggatgtttataatggtggttcgcatgttttctctgatgtgttccaactgtccaactttagctgttcaacttatgaaacaaaacattgcagaaacgcttcactttctcctgtgtggtgcctccaatggaagttgtcaggaacagattgatcttgttccacgaagccctcaagagttgtatgaactgacatctctgatttgtgaacttatgccatgtttaccaaaagaaggcatttttgcagttgataccatgttgaagaagggaaatgcacagaacacagatggtgcgatatggcagtggcgtgatgatcggggcctctggcatccatataacaggattgacagccggatcattgaggcagcccatcaggtcggtgaggatgagataagcttgtccactctgggacgagtttatactattgattttaattctatgcagcaaatcaatgaggacacgggaacagcacgtgccattcagagaaaacctaacccgttagccaatagtaacactagtggatattcagagtcaaagaaggatgatgctcgagcacagcttatgaaagaggatccggaactggctaagtcttttattaagacattatttggtgttctttatgaagtgtatagttcctcagcaggacctgcggtcagacataagtgccttagagcaattcttaggataatttattttgcggatgctgaacttctgaaggatgttctgaaaaatcatgctgtttcaagtcacattgcttccatgctgtcaagccaagacctgaagatagtagtgggagcacttcagatggcagaaattttaatgcagaagttacctgatatttttagtgtttacttcagaagagaaggtgtaatgcatcaagtaaaacacttagcagaatcagagtctttgttgacaagtccaccaaaggcatgtacgaatggatcgggatccatgggatccacaacttcagtcagcagtgggacagccacagctgccactcatgctgcagctgacttgggatcacccagcttgcagcacagcagggatgattctttagatctcagccctcaaggtcgattaagtgatgttctaaagagaaaacgactgccaaaacgagggccaagaaggccaaagtactcacctccaagagatgatgacaaagtagacaatcaagctaaaagccccaccactactcagtcacctaaatcttctttcctggcaagcttgaatccaaaaacatggggaaggttaagtacacagtccaacagcaacaacattgagccagcacggactgcgggaggtagtggccttgccagggctgcctcaaaggataccatctccaataatagagaaaaaattaaaggttggattaaggagcaggcacataaatttgtagaacgttatttcagttctgagaatatggatggaagcaaccctgcattgaatgtccttcagagactttgtgctgcaaccgaacaactcaacctccaggtggatggtggagctgagtgccttgtagaaatccgtagcatagtctcagagtcagatgtttcatcatttgaaatccaacatagtggatttgtgaagcagctgttgctttatttgacatctaaaagtgaaaaggatgctgtgagcagagagatcagattaaagcgatttcttcatgtatttttttcttctccacttcctggagaagagcccattggaagagtggaaccagtgggtaatgcacctttgttggcattagttcacaagatgaacaactgcctcagccagatggaacaatttccagtcaaagtacatgatttccctagtggaaatgggacaggaggcagcttttctctcaacagaggatcacaggctttaaaatttttcaacacacatcaattaaaatgccagttacaaaggcatccagactgtgcaaatgtgaagcagtggaagggtggacctgtcaagattgaccctctggctttggtacaagccatcgagagataccttgtagttagagggtatggaagagtaagagaagatgatgaagacagcgatgacgatggatcagatgaggaaatagatgagtctctggctgctcagttcctaaattcaggaaatgtaagacacaggctgcagttttatattggagaacatttgctgccgtataacatgactgtgtatcaggcagtacggcagtttagtatacaggctgaagatgaaagagaatccacagatgatgagagcaatcctctaggcagagctggtatttggacaaagactcatacaatatggtataaacctgtgagagaggatgaagaaagtaataaagattgtgttggtggtaaaagaggaagagcccaaacagctccaacgaaaacttcccctagaaatgcaaaaaagcatgatgagttatggcacgatggagtgtgcccatcagtatcaaatcctttagaagtttacctcattcccacaccacctgaaaatataacatttgaagacccgtcattagatgtgatccttcttttaagagttttacatgctatcagtcgatactggtattacttgtatgataatgcaatgtgcaaggaaattattccaactagtgaatttattaacagtaagttaacagcaaaagcaaataggcaacttcaagatcctttagtaatcatgacaggaaacatcccaacatggcttactgagctaggaaaaacctgcccatttttctttccttttgatacccggcaaatgcttttttatgtaactgcatttgatcgggaccgagcaatgcaaagattacttgataccaacccagaaatcaaccagtctgattctcaagatagcagagttgcacctagattggatagaaaaaaactgtgaccgnagactgtgacagcga

SEQ ID NO: 408558 - DNA, 2025 bp, Homo sapiens
gtgctgcggctcagctgataattgaaggaacccggagccgccgccgccgcgccgctggggggggtggggggagctagtggaagttactgccgcgccaccgagtccggaccggagactttggggcctaactagtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaagaaaaaggacagagagttcttgtgtaaagagtggctccgggtctgaatcaactggtgcagaagagagatctgcgaaacctaccaagctggcttcaaaatcagccacctcagccaaagctgggtgtagcaccatcactgattcttcttctgctgcctctacttcctcctcgtcttctgctgtagcctcggcctcctccactgtaccaccaggtgccagagtgaaacaaggaaaagatcagaacaaggccaggcgttcccgttcagcgtccagtcccagccccagaagaagtagcagggaaaaggaacagaggtcttctaagtcagagacatcaaaacctggaccttctggattacaggccaaattagcaagtttaagaaaatctacgaagaaacgcagtgagtctccacctgctgagctccccagtttgaggcggagcacacgccaaaagaccacgggctcctgtgctagtaccagtcggcgaggctctggcctgggcaaaagaggagcagctgaagctcgtcgacaggagaaaatggcagaccctgaaagcaaccaggaggcagtaaattcttcagctgctcggacagatgaagctccccaaggagctgcaggggctgttggcatgaccacctctggggagagtgaatcagatgattccgagatgggacgtttgcaagctttgttagaggcaaggggtcttccccctcacctatttggtcctcttggtcctcggatgtcacagcttttccatagaacaattggaagtggagctagttctaaggcccagcagctactacaaggattgcaagccagtgatgaaagtcaacagcttcaggcagttattgagatgtgtcagttactggtcatgggaaatgaggagacactgggagggtttcctgtcaagagtgttgttccagctttgattacgttacttcagatggagcacaattttgatattatgaaccatgcttgtcgagccttaacatacatgatggaagcacttcctcgatcttctgctgttgtagtagatgctattcctgtctttttagaaaaggtgatcctacttttaccccgtttgttcaaaagcaggcatagggagtcaagtttcaaactcttgaattttagctttcattttctaaataaagtatattttttagcccgagaaatgttttatgtccagcagatcaatagtttgaaggtgaagataaatcattgatagaatcagcctagttttgtaatttttagtaataattagcacattaatataataactttcagagaagaactttaaagtacttgattaaaaataatctcatttctagaaaacatgccagtgaggttgatagctactttataccctcattatgtagctgagaaagttgatcagtgggaacatcc

SEQ ID NO: 408559 - DNA, 704 bp, Homo sapiens
aacacccttctgtagtcccctcccacactgcgtcagagattatctgtgtgaccagtagattatggcagaagtgatggtgtacaaactctgagacttagtcatataggcatttcaggttttgccttgttctcttggagtactcaccatgggaaatcagcaaccattgagaagactctcacaaagccctgtggcggggcactgaggtctcctctcagcagccagcacccacctgccagatgtggatgtgcccctcttgagttctcggcaataatgagtgattattgttatttttagccagtaagtttcagaataatttgttactcagcaatagataatacattgtttgagcagtttttaaaaacggcttcagaatgtggctctgagctaaatagaagtctgtgaaacatgttttcaacaaatccatgatttatagaacagattacctagttatatacctacctcctcagagactcaaattgttctgtctcaaattgctgtattaacactaaggaagaaggtctaggaggtacaaaaaaatcagcttctgccttacaagagtaagttcccctaggacaggactaccttaatcacttagtttaaatgttttttaagcacctaccttctctcagttgctgaggatacatcactgaattagttggacaagatctctgctctgctagagacttcatttcatttggggaggt

SEQ ID NO: 408560 - DNA, 716 bp, Homo sapiens
ttccaccctctgggcctgctctccttacaggcattaggccttcaaaagacaattttctccctgtttctcctccttgcccaatctctccttctaaaccctcttccacctgtactcacattctccaggaagccttctctgatgggactcctgtgactctaaggttgctactacagcatccaacatcccagccccttgggccctggcaactgccacctgggatggccttgtgcctgttgccgttactatgttaaatgtagatgtgtgtgtctacttcaccctcagattcagtgctcactagaagtaggaaccaagtgtccccatcagacctgaagctctgcccctgctttgggtacaagacactcacttgcactgacacacacactcgtacacactgcctatcaggctgggagtgcccaaggacaggtcctgtgtccttttctctgccggctcacctttgcctacccacagcctcagcttggcacacagagatggttgtcccccaggtcggtaaggtgggggtggcagtgagggaccatgagcctggagccctccaggattccaagcccagatccctctatcctgatgaagggctgttcccaccttgttcctgccgcccccgccccctacttcctctgagcaagaatctgaatgtcagaaccagggagggccgtgggggacttttgacagcaagtccaagtgagccaaggttgcccaat

SEQ ID NO: 408561 - DNA, 495 bp, Homo sapiens
attattatttttagatggagtcttggtctgtcgcccaggctggagtgcagtggtgcgatcttagcttactgcaatctccgcctcccgggttcaagtgattctcatgccttcagcctcccgagtaccctgggattacagggtgcccgccaccatgccctggctaatttttgtatttttagtagagacggggtttcaccatgttggccaggctggtctcgaactcctgacctcaggtgatccacctgcgtcggcctcccaaagtgctgggattacaggtgtgagtcactgcgcctggcctatgtgtagattatttatgaaagtaaatgcagcaacttggtagcaaggcaacattggttgctttcaggaatgggaatggggggcaggagagaaacttactgtattccctattatctcttttgaatataaacgattgaatgtatttcctattttaaaaataacgaaatgaatgttaaatttgacaaggggactagcaaa

SEQ ID NO: 408562 - DNA, 439 bp, Homo sapiens
aataggaaaaaacagaatattacctaaacttagttgataaagcagtggtaagagtttgagaggattgactccaattttgaaagaaattccactgtgtgtaaaaggctatcaaacatcattgcataaaggacagatctttcatttatgaaacagaatcagtgtagcaaacttaattgttgccctatcttaagaatttgcgtcagccaccccaaccttcagcaaccaccatactgatgagtcagcagccatcaacatcaaagataagtccctctaccagcaaaaagattatgactcactgaagggtcagataattgttagcattcattagcaataaaatattctttaatgaaggtacttttttatgcatatgctattgtacacttaataaacaatagtatagtaaaaacataatttttatatgcactggaaaccaaaaaat

SEQ ID NO: 408563 - DNA, 720 bp, Homo sapiens
ggggattctgtgtccctgcatccagaaaagggacagatatagaaagggaggatgcggtctcaccgggccataaacatatatgaatccttcttggaaggaatcagaaatactcgcaggccttctagtttctgggtaaactgatagaacacaggctctttaactggacagtcaaaccacaatgccccctggtggtgaaatcatgcatatacacatgtcatcacagataggaaattctccaataaggtcaacacgacaaggacatctgcagtgatctttctacatgctctgccaacttggcactcatctataactttagaagaggaggcagaacatcagtgatgactgcaaacatatgcttgatttttttaagcaacgggaaaatgaaaaatgaacgggaggagggaacactgctgccttctgaggacagaagtcgtgtttcaagtagtcaggagtgatggggaggtgggacgagaatgaagacttaggggaatctgaacaaaacaaggtggtgtatggggaatgagggcagtcagtaaagccaaatagtaccaggtggaaaaatagcctaaaagaagtacaagtctaatcatccaaaaattctaaagcaaaactaaaactccatagttcagcaaaagacaccctttcaggtgtttagaagactgtggttatccgtttaaagatgttcctctctcaaggaatctctgagaactataaatgtgt

SEQ ID NO: 408564 - DNA, 607 bp, Homo sapiens
gcaaaactgggtcacatggctattcccacaccgatacctagtaagggaaggagagtcatggtgattggctcaggtgttgtaacaaagagggggcatgatttctaggatggtacaaacactggttcatgagctcccgcacacggttcctgagattatgaatcccaaacactgagcacggcgtctaacacatggcagttgccttatccatattgcttccccctttctctgattccctctaagaacacaagactcccagcctggcctctcctgagccagccttccacccctcaatcctggggcttgggtctccaccagtcagtgcctctcccatcctgacctctggctccatcactgccctccctcttatttctatctcaaaagcttggggatgaacaaagatcacttcgttgtcctcagtgacactgggattcctaaagaataaaagataggagatgctagattcttatataaatgctttcaccaggggagccaaaaattaataacagcatgaacagaaggcctggagtttttaaccactccattcagacaactgaaatgatccgagtacaccgttatctgggcgaggtgcggggactgactgccgact

SEQ ID NO: 408565 - DNA, 6318 bp, Homo sapiens
  misc_feature (2460)..(2460): n is a, c, g, or t
  misc_feature (6036)..(6036): n is a, c, g, or t
agcgggctgggcctgtgatcgctgaggggcgagcagttgcgaccctgggctcctggggacctgagcgttatgtctttccgcgacctccgcaatttcacagagatgatgagagccctgggataccctcgacatatttctatggaaaatttccgtacacccaattttggacttgtatctgaagtgcttctctggcttgtgaaaagatatgagccccagactgacatcccgcctgacgtggatactgaacaggaccgagttttcttcattaaggcaattgcccagttcatggccaccaaggcacatataaaactcaacactaagaagctttatcaagcagatgggtatgcggtaaaagagctgctgaagatcacatctgtcctttataatgctatgaagaccaaggggatggagggctctgaaatagtagaggaagatgtcaacaagttcaagtttgatcttggctcaaagattgcagatttgaaggcagccaggcagcttgcgtctgaaatcacctccaaaggagcatctctgtatgacttgctcggcatggaagtagagttgagggaaatgagaacagaagccattgccagacctctggaaataaacgagactgaaaaagtgatgagaattgcaataaaagagattttgacacaggttcagaagactaaagacctgctcaataatgtggcctctgatgaagctaatttagaagccaaaatcgaaaagagaaaattagaactggaaagaaatcggaagcgactagagactctgcagagtgtcaggccatgttttatggatgagtatgagaagactgaggaagaattacaaaagcagtatgacacttatctggagaaatttcaaaatctgacttatctggaacaacagcttgaagaccatcataggatggagcaagaaaggtttgaggaagctaaaaacactctctgcctgatacagaacaagctcaaggaggaagagaagcgcctgctcaagagtggaagtaacgatgactcggacatagacatccaggaggacgatgaatccgacagtgagttggaagaaaggcggctgcccaagccacagacagccatggagatgctcatgcaaggaagacctggcaaacgcattgtgggcacgatgcaaggtggagactccgatgacaatgtaagtcccccgctcccctcagtggttctgtgcactctgggtttggctgtccccatagatgggagtggctgagttgctgtcagcagccagggagccgtctatggtcagcccggccgtgcctcgatgcgtggcagggtttggcctcatgaggctctggactcttcgttgctcgtggatggctcatctcttttcaagtgaatgtgcttgctctgctttttttgccttctcactgttctttccattctcgctttccaaagatggaagcagcaccagctctcttaggtaaatgcaagacttccagctccaagaagcaggttggttttctgttctgcctcatgtgtttgtgggtgtctgtcagccctcccggggccagccaggggcctctccctaggagtgatgcttcctctctcctgggcaaaaaggccactcaaaagagatcctgtggtgacagcgggatcactgaaggcccctgtgctaaagtggaggcgcaggcacggagcctggaggcggggaaagctcaggccgggccatcctcaggccctgggccgccacctagaaatgaaggaggacgccgagggccgggctcaggaccaacccccctccctgttctgtgctggggacggaatggtgaagcagcactgtccccagaccaggccctcgaggtgccaggcatgaggctgagacataagctgccttgagctttactgagtggataactccctggagcacttaagcaaaaggggattctaggggtcctcagtgaggtccagtcatcagggctctgccgcccattgctcaagcctacgttctttgttgcgtccctggcagtgctgctcggcccacacagcaaagggcgactcaacagagactgaccccaggctgcctccatgtgccctgaatttacagggcacagtctgtagagaagcagagagagcaactggaaaataattttcctaacaagctcgggtgtggatggtatacagcgtctctccgtcttgcccacccaagacagaagcagagggagtgtggcgtgggtgctggcaatgctgaggcagcaccgcctgcctcttctccagggtttgccttctctctcctcagagcgaatgcattagtcgcagctgagctttatgcctggtggtcacttgtttatttcaaggaggctgtgtccatgccgccctccaggcacagggttccatgctttacgtgttcaggcatccaacacgtgtctgttgagtgcctgccacatgccagtgctgtcgtggattatggggaacgcagcaggggcagaggcaagccccngcttcatggctcacaccccagcaataatgatggattgtcggatcagggctcatggtgttaacaggaggaataacagcttcaggggacagggagtgacagggaacaaggagggggtggcgtcttctgcgaggtcagtgaaggcccctgacgtggtggtgtttgagcagggcctgagtggagggagcgagcgcatgggttggcggcacctgggcatgtggaatgcactcctcgcatcgaggagcagaggcagctggtgtgattgtgggtgagtgcgagaggcagcaggggccatgcagagctttgcagggtgagatgaagactctgttttctctgagtgtgaggggaaggccctgaagaatcatgagcccagaagggtcaagagctgatgatccctgtttgagagaagccagttaggaggcgcctgcacccgtggaggtcagaggtgacggtgcttggccgaaggtgtggcagcagaggtgttgagaaatggtcaggtcctgggtctctctaagaaccatcaggttttgtgaattgattggacataggctgttagagaaagagaaaaatgagggtgcctgggcttggtctaatcagcagaaagcagagtttcattttctgagatggggccgacttgacaaaggggcttggaaggcagatcgaaagtttgattttggacattctgaatgtgacagccacatgctagggttgagtagccaggtggaatttaagtctggagttcaagggccacgtctgggctagagattgaattttgggagccacccttatttggttggtatctaagccacaaggatagatgtgactgcctagggagagcaagtagaatgagaagagaggcgacccaaggtcctgagctgcatctgccctgcagaggtccgggaggaaggggcaggcagaggaggctgaggggcgtcagcagtgaggaagggggacctggactagagaaggggccctgggggatggagaagatgggttttaaggatgaaggggtgattccacagctcaagcaggatgaggcctgagaatcgatcccagtccgttgaatgtttccttcttgacaggagcagtgctggggtcagtaggtgagagcccgggggaactgaagcagtcgtgaggggcacaggtgtggacagtgagttcaacgactcgctcaggagctttgtgtgaggggagagagacagggcagagcagctggagaggaaggtgggattacctttggggttttttttcaagaaggaaattacagcatgagtgtgcaccgacaggaatgatctagatagaacgaccagccatcctggtttacatgggacgcaggaactgccgttttaaagctgggctgagttggtcaccctggagccctggatccgatgaggagagagagggtgtgtctttcactttgctccctttttttcttttttttcttttttttttgagatggagtcttgctttggagtgcagtggtgcaatctcggctcactgcacctctgcctcccaggttcaagcgattcttctgcctcagtctccggagtagctgggattcactttgctccttataccaatgtctatgttgctttccatccacaatctacaaaaagccaaaacaggcctcccttccctctctccaagcccctgtccttcttgccatctgtagggggagtctctaggtccagtggccctcagcgcagatgcagagtgcttcttagacgctgcgggaaagccagcccctgcagcaccacacccagatgcacctgcagtttggaggattctggttggatgataaattccagctggcagtacatagcctcagtcccatctgtatgccctcccacagcctgcttgccactctgccagcctcttccttcacacagggatgctgctatagaaagggaggcagagagtcttaggacaagatgtcaggaatgaggcaggatcccccgttgcatctgccatttttttcctataggaggactcggaggagagtgaaattgacatggaagatgatgatgacgaggatgacgatttggaagacgagagcatttctctctcaccaaccaagcccaatcgaagggtccggaaatctgaacccctggatgagagtgacaatgacttctgacccttttgccaagggaccctggcagattaaaaccctcagacttgtaggtaaatgggaacttagaaggttaggaaggtaacccctgttttgtttactaagctggctggactcatgatcactgaagcaatacttatttctgctttagcctcctatgtttgcattccatgaagcttaaataagaattgaagcaaatccctaagatttatttttttccaccttatttatcttctaaaacttgaggaatgcatgtgttcttagtgattcacatccacgggacaaaaactcaagaagaaataagagctgacgccacacaagtcttggctgcttttgttactatacattttctctgagactccagcagagttggggctggaacttggcactggggactcatgtttggaatcgtaggggaacatctggctgttaatcacttgcacagttgagaacatttcctatacatcggcttttaattctagctcttatttcattttgtaatcttattttctttcgtctgcatgttcacaataccaagcattaaatgtattttaataactaaacttttctgaaagaaggttagctaaagttaaatgaaaacttggtttctttgaaaatcaggcaatagagacaggctccagatgaggaatcctccattttctgtccgaagctgacattcctctggcagtccagttcaccttggattacagccaccttcatgtttccacggttggtactaaatctggaaactctggtgacctgggctgccctctcagaaactccagactcccatggcaatgacagccgggacacttttcttccctccagccagggtttctctaaaggagctttgttttgtctaaagtgtggcaagacatagtgcacaacacagggacaaaggcaggtttcctgcagctcgctacctaagtgtttctgtaggggaaggagccaattaagaaaaagtgttggtacagattcatgtttctgatttaaaaaaacaacaacacaggattgaattaagtagagtaatagcactagaagaatttttctgttgtgaaattagaagtggagttggtttttttcttttttcttcttctttttttttaatatgaaaagtacttagctgggagtggtggcaagcgcccttgggtccagctactcaggaggccaaggtgggaggatcacttgagcccaggagttttagactagcctggacaactaagtgagactccatctctacaaaaaattaaaaaattagccaggtgtggaggggcatgcctgtggtctcagctattcaggaggctgaggcaggagaatcacttgagaccaggaagttgaggctgcaatgagccgtgatcatgccactgcactccagcctgggtgacagagtgagaccctgtctttaaaaaaaagaaaaagaaaagcacgctgcttgtaaaaagcgtacagtnggtcaggcgtggtggctcatgcctgtaatcctagcactttgagaggctgaggtgggtagatcacctgaggtcaggggtttgagaccagcctggccaacatggcgaaaccccacctctactaaaaatacaaaaattagccgggcgtggtagcgcatgcctgtaaccccagctactggggaggctgaggcaggagaatcgcttgaacctaggaggcggaggttgcagtgagccgagatggcgccactgcactccagcctgggcagcagagtgagactccatctc

SEQ ID NO: 408566 - DNA, 2988 bp, Homo sapiens
  misc_feature (2706)..(2706): n is a, c, g, or t
cagacatcctgaactccatctgcatcctttctgcagggctgatttcacagagatgatgagagccctgggataccctcgacatatttctatggaaaatttccgtacacccaattttggacttgtatctgaagtgcttctctggcttgtgaaaagatatgagccccagactgacatcccgcctgacgtggatactgaacaggaccgagttttcttcattaaggcaattgcccagttcatggccaccaaggcacatataaaactcaacactaagaagctttatcaagcagatgggtatgcggtaaaagagctgctgaagatcacatctgtcctttataatgctatgaagaccaaggggatggagggctctgaaatagtagaggaagatgtcaacaagttcaagtttgatcttggctcaaagattgcagatttgaaggcagccaggcagcttgcgtctgaaatcacctccaaaggagcatctctgtatgacttgctcggcatggaagtagagttgagggaaatgagaacagaagccattgccagacctctggaaataaacgagactgaaaaagtgatgagaattgcaataaaagagattttgacacaggttcagaagactaaagacctgctcaataatgtggcctctgatgaagctaatttagaagccaaaatcgaaaagagaaaattagaactggaaagaaatcggaagcgactagagactctgcagagtgtcaggccatgttttatggatgagtatgagaagactgaggaagaattacaaaagcagtatgacacttatctggagaaatttcaaaatctgacttatctggaacaacagcttgaagaccatcataggatggagcaagaaaggtttgaggaagctaaaaacactctctgcctgatacagaacaagctcaaggaggaagagaagcgcctgctcaagagtggaagtaacgatgactcggacatagacatccaggaggacgatgaatccgacagtgagttggaagaaaggcggctgcccaagccacagacagccatggagatgctcatgcaaggaagacctggcaaacgcattgtgggcacgatgcaaggtggagactccgatgacaatgaggactcggaggagagtgaaattgacatggaagatgatgatgacgaggatgacgatttggaagacgagagcatttctctctcaccaaccaagcccaatcgaagggtccggaaatctgaacccctggatgagagtgacaatgacttctgacccttttgccaagggaccctggcagattaaaaccctcagacttgtaggtaaatgggaacttagaaggttaggaaggtaacccctgttttgtttactaagctggctggactcatgatcactgaagcaatacttatttctgctttagcctcctatgtttgcattccatgaagcttaaataagaattgaagcaaatccctaagatttatttttttccaccttatttatcttctaaaacttgaggaatgcatgtgttcttagtgattcacatccacgggacaaaaactcaagaagaaataagagctgacgccacacaagtcttggctgcttttgttactatacattttctctgagactccagcagagttggggctggaacttggcactggggactcatgtttggaatcgtaggggaacatctggctgttaatcacttgcacagttgagaacatttcctatacatcggcttttaattctagctcttatttcattttgtaatcttattttctttcgtctgcatgttcacaataccaagcattaaatgtattttaataactaaacttttctgaaagaaggttagctaaagttaaatgaaaacttggtttctttgaaaatcaggcaatagagacaggctccagatgaggaatcctccattttctgtccgaagctgacattcctctggcagtccagttcaccttggattacagccaccttcatgtttccacggttggtactaaatctggaaactctggtgacctgggctgccctctcagaaactccagactcccatggcaatgacagccgggacacttttcttccctccagccagggtttctctaaaggagctttgttttgtctaaagtgtggcaagacatagtgcacaacacagggacaaaggcaggtttcctgcagctcgctacctaagtgtttctgtaggggaaggagccaattaagaaaaagtgttggtacagattcatgtttctgatttaaaaaaacaacaacacaggattgaattaagtagagtaatagcactagaagaatttttctgttgtgaaattagaagtggagttggtttttttcttttttcttcttctttttttttaatatgaaaagtacttagctgggagtggtggcaagcgcccttgggtccagctactcaggaggccaaggtgggaggatcacttgagcccaggagttttagactagcctggacaactaagtgagactccatctctacaaaaaattaaaaaattagccaggtgtggaggggcatgcctgtggtctcagctattcaggaggctgaggcaggagaatcacttgagaccaggaagttgaggctgcaatgagccgtgatcatgccactgcactccagcctgggtgacagagtgagaccctgtctttaaaaaaaagaaaaagaaaagcacgctgcttgtaaaaagcgtacagtnggtcaggcgtggtggctcatgcctgtaatcctagcactttgagaggctgaggtgggtagatcacctgaggtcaggggtttgagaccagcctggccaacatggcgaaaccccacctctactaaaaatacaaaaattagccgggcgtggtagcgcatgcctgtaaccccagctactggggaggctgaggcaggagaatcgcttgaacctaggaggcggaggttgcagtgagccgagatggcgccactgcactccagcctgggcagcagagtgagactccatctc

SEQ ID NO: 408567 - DNA, 2926 bp, Homo sapiens
  misc_feature (2644)..(2644): n is a, c, g, or t
agcgggctgggcctgtgatcgctgaggggcgagcagttgcgaccctgggctcctggggacctgagcgttatgtctttccgcgacctccgcaatatgagccccagactgacatcccgcctgacgtggatactgaacaggaccgagttttcttcattaaggcaattgcccagttcatggccaccaaggcacatataaaactcaacactaagaagctttatcaagcagatgggtatgcggtaaaagagctgctgaagatcacatctgtcctttataatgctatgaagaccaaggggatggagggctctgaaatagtagaggaagatgtcaacaagttcaagtttgatcttggctcaaagattgcagatttgaaggcagccaggcagcttgcgtctgaaatcacctccaaaggagcatctctgtatgacttgctcggcatggaagtagagttgagggaaatgagaacagaagccattgccagacctctggaaataaacgagactgaaaaagtgatgagaattgcaataaaagagattttgacacaggttcagaagactaaagacctgctcaataatgtggcctctgatgaagctaatttagaagccaaaatcgaaaagagaaaattagaactggaaagaaatcggaagcgactagagactctgcagagtgtcaggccatgttttatggatgagtatgagaagactgaggaagaattacaaaagcagtatgacacttatctggagaaatttcaaaatctgacttatctggaacaacagcttgaagaccatcataggatggagcaagaaaggtttgaggaagctaaaaacactctctgcctgatacagaacaagctcaaggaggaagagaagcgcctgctcaagagtggaagtaacgatgactcggacatagacatccaggaggacgatgaatccgacagtgagttggaagaaaggcggctgcccaagccacagacagccatggagatgctcatgcaaggaagacctggcaaacgcattgtgggcacgatgcaaggtggagactccgatgacaatgaggactcggaggagagtgaaattgacatggaagatgatgatgacgaggatgacgatttggaagacgagagcatttctctctcaccaaccaagcccaatcgaagggtccggaaatctgaacccctggatgagagtgacaatgacttctgacccttttgccaagggaccctggcagattaaaaccctcagacttgtaggtaaatgggaacttagaaggttaggaaggtaacccctgttttgtttactaagctggctggactcatgatcactgaagcaatacttatttctgctttagcctcctatgtttgcattccatgaagcttaaataagaattgaagcaaatccctaagatttatttttttccaccttatttatcttctaaaacttgaggaatgcatgtgttcttagtgattcacatccacgggacaaaaactcaagaagaaataagagctgacgccacacaagtcttggctgcttttgttactatacattttctctgagactccagcagagttggggctggaacttggcactggggactcatgtttggaatcgtaggggaacatctggctgttaatcacttgcacagttgagaacatttcctatacatcggcttttaattctagctcttatttcattttgtaatcttattttctttcgtctgcatgttcacaataccaagcattaaatgtattttaataactaaacttttctgaaagaaggttagctaaagttaaatgaaaacttggtttctttgaaaatcaggcaatagagacaggctccagatgaggaatcctccattttctgtccgaagctgacattcctctggcagtccagttcaccttggattacagccaccttcatgtttccacggttggtactaaatctggaaactctggtgacctgggctgccctctcagaaactccagactcccatggcaatgacagccgggacacttttcttccctccagccagggtttctctaaaggagctttgttttgtctaaagtgtggcaagacatagtgcacaacacagggacaaaggcaggtttcctgcagctcgctacctaagtgtttctgtaggggaaggagccaattaagaaaaagtgttggtacagattcatgtttctgatttaaaaaaacaacaacacaggattgaattaagtagagtaatagcactagaagaatttttctgttgtgaaattagaagtggagttggtttttttcttttttcttcttctttttttttaatatgaaaagtacttagctgggagtggtggcaagcgcccttgggtccagctactcaggaggccaaggtgggaggatcacttgagcccaggagttttagactagcctggacaactaagtgagactccatctctacaaaaaattaaaaaattagccaggtgtggaggggcatgcctgtggtctcagctattcaggaggctgaggcaggagaatcacttgagaccaggaagttgaggctgcaatgagccgtgatcatgccactgcactccagcctgggtgacagagtgagaccctgtctttaaaaaaaagaaaaagaaaagcacgctgcttgtaaaaagcgtacagtnggtcaggcgtggtggctcatgcctgtaatcctagcactttgagaggctgaggtgggtagatcacctgaggtcaggggtttgagaccagcctggccaacatggcgaaaccccacctctactaaaaatacaaaaattagccgggcgtggtagcgcatgcctgtaaccccagctactggggaggctgaggcaggagaatcgcttgaacctaggaggcggaggttgcagtgagccgagatggcgccactgcactccagcctgggcagcagagtgagactccatctc

SEQ ID NO: 408568 - DNA, 1778 bp, Homo sapiens
agcgggctgggcctgtgatcgctgaggggcgagcagttgcgaccctgggctcctggggacctgagcgttatgtctttccgcgacctccgcaatttcacagagatgatgagagccctgggataccctcgacatatttctatggaaaatttccgtacacccaattttggacttgtatctgaagtgcttctctggcttgtgaaaagatatgagccccagactgacatcccgcctgacgtggatactgaacaggaccgagttttcttcattaaggcaattgcccagttcatggccaccaaggcacatataaaactcaacactaagaagctttatcaagcagatgggtatgcggtaaaagagctgctgaagatcacatctgtcctttataatgctatgaagaccaaggggatggagggctctgaaatagtagaggaagatgtcaacaagttcaagtttgatcttggctcaaagattgcagatttgaaggcagccaggcagcttgcgtctgaaatcacctccaaaggagcatctctgtatgacttgctcggcatggaagtagagttgagggaaatgagaacagaagccattgccagacctctggaaataaacgagactgaaaaagtgatgagaattgcaataaaagagattttgacacaggttcagaagactaaagacctgctcaataatgtggcctctgatgaagctaatttagaagccaaaatcgaaaagagaaaattagaactggaaagaaatcggaagcgactagagactctgcagagtgtcaggccatgttttatggatgagtatgagaagactgaggaagaattacaaaagcagtatgacacttatctggagaaatttcaaaatctgacttatctggaacaacagcttgaagaccatcataggatggagcaagaaaggtttgaggaagctaaaaacactctctgcctgatacagaacaagctcaaggaggaagagaagcgcctgctcaagagtggaagtaacgatgactcggacatagacatccaggaggacgatgaatccgacagtgagttggaagaaaggcggctgcccaagccacagacagccatggagatgctcatgcaaggaagacctggcaaacgcattgtgggcacgatgcaaggtggagactccgatgacaatgaggactcggaggagagtgaaattgacatggaagatgatgatgacgaggatgacgatttggaagacgagagcatttctctctcaccaaccaagcccaatcgaagggtccggaaatctgaacccctggatgagagtgacaatgacttctgacccttttgccaagggaccctggcagattaaaaccctcagacttgtaggtaaatgggaacttagaaggttaggaaggtaacccctgttttgtttactaagctggctggactcatgatcactgaagcaatacttatttctgctttagcctcctatgtttgcattccatgaagcttaaataagaattgaagcaaatccctaagatttatttttttccaccttatttatcttctaaaacttgaggaatgcatgtgttcttagtgattcacatcctccatggtgctatcagcaccatggaggatgtgcacgctagactggagaccgttaacagtccactatgggaccaggagaaatcaaacaacagctttgtgaggaaaagatctgtatcctcatgtcatggatgtgaagacagaaagccagagaggtggcgtgatttccatagaacaaagctggttggggtctctcatatt

SEQ ID NO: 408569 - DNA, 557 bp, Homo sapiens
agattataaaatttcttggtatatttaattttttttttaaatgcattcctatctatatttatgcatagaaaagtctggaaggatgtatgtcaactatcaagcgcttatacctggtgatgggattatcagtaatttttacgtcattcttcatactttcaggattatttcaagtttttacaaagagcacatcttatttatgatgaaaaagaagtatgttcattttggggggagaaagcagaaaagggaaaatatttttaagcattacaagaatgaaggaccttctctaattaagggtttccagagaaagccaccatggaatctgaaactgtgaatacccatttcaaactactgcatataattcacctttcctttttatttcatttgcttcttttaggccatgttttatggatgagtatgagaagactgaggaagaattacaaaagcagtatgacacttatctggagaaatttcaaaatctgacttatctggaacaacagcttgaagaccatcataggatggagcaagaaaggtttgaggtgagctgagcctgtcctctg

SEQ ID NO: 408570 - DNA, 2550 bp, Homo sapiens
  misc_feature (2268)..(2268): n is a, c, g, or t
cttggctcgctgcgcctctgcctcccaggttcaagagattcttctgcctcagcctcctaagtagctgggattacaggaaatgagaacagaagccattgccagacctctggaaataaacgagactgaaaaagtgatgagaattgcaataaaagagattttgacacaggttcagaagactaaagacctgctcaataatgtggcctctgatgaagctaatttagaagccaaaatcgaaaagagaaaattagaactggaaagaaatcggaagcgactagagactctgcagagtgtcaggccatgttttatggatgagtatgagaagactgaggaagaattacaaaagcagtatgacacttatctggagaaatttcaaaatctgacttatctggaacaacagcttgaagaccatcataggatggagcaagaaaggtttgaggaagctaaaaacactctctgcctgatacagaacaagctcaaggaggaagagaagcgcctgctcaagagtggaagtaacgatgactcggacatagacatccaggaggacgatgaatccgacagtgagttggaagaaaggcggctgcccaagccacagacagccatggagatgctcatgcaaggaagacctggcaaacgcattgtgggcacgatgcaaggtggagactccgatgacaatgaggactcggaggagagtgaaattgacatggaagatgatgatgacgaggatgacgatttggaagacgagagcatttctctctcaccaaccaagcccaatcgaagggtccggaaatctgaacccctggatgagagtgacaatgacttctgacccttttgccaagggaccctggcagattaaaaccctcagacttgtaggtaaatgggaacttagaaggttaggaaggtaacccctgttttgtttactaagctggctggactcatgatcactgaagcaatacttatttctgctttagcctcctatgtttgcattccatgaagcttaaataagaattgaagcaaatccctaagatttatttttttccaccttatttatcttctaaaacttgaggaatgcatgtgttcttagtgattcacatccacgggacaaaaactcaagaagaaataagagctgacgccacacaagtcttggctgcttttgttactatacattttctctgagactccagcagagttggggctggaacttggcactggggactcatgtttggaatcgtaggggaacatctggctgttaatcacttgcacagttgagaacatttcctatacatcggcttttaattctagctcttatttcattttgtaatcttattttctttcgtctgcatgttcacaataccaagcattaaatgtattttaataactaaacttttctgaaagaaggttagctaaagttaaatgaaaacttggtttctttgaaaatcaggcaatagagacaggctccagatgaggaatcctccattttctgtccgaagctgacattcctctggcagtccagttcaccttggattacagccaccttcatgtttccacggttggtactaaatctggaaactctggtgacctgggctgccctctcagaaactccagactcccatggcaatgacagccgggacacttttcttccctccagccagggtttctctaaaggagctttgttttgtctaaagtgtggcaagacatagtgcacaacacagggacaaaggcaggtttcctgcagctcgctacctaagtgtttctgtaggggaaggagccaattaagaaaaagtgttggtacagattcatgtttctgatttaaaaaaacaacaacacaggattgaattaagtagagtaatagcactagaagaatttttctgttgtgaaattagaagtggagttggtttttttcttttttcttcttctttttttttaatatgaaaagtacttagctgggagtggtggcaagcgcccttgggtccagctactcaggaggccaaggtgggaggatcacttgagcccaggagttttagactagcctggacaactaagtgagactccatctctacaaaaaattaaaaaattagccaggtgtggaggggcatgcctgtggtctcagctattcaggaggctgaggcaggagaatcacttgagaccaggaagttgaggctgcaatgagccgtgatcatgccactgcactccagcctgggtgacagagtgagaccctgtctttaaaaaaaagaaaaagaaaagcacgctgcttgtaaaaagcgtacagtnggtcaggcgtggtggctcatgcctgtaatcctagcactttgagaggctgaggtgggtagatcacctgaggtcaggggtttgagaccagcctggccaacatggcgaaaccccacctctactaaaaatacaaaaattagccgggcgtggtagcgcatgcctgtaaccccagctactggggaggctgaggcaggagaatcgcttgaacctaggaggcggaggttgcagtgagccgagatggcgccactgcactccagcctgggcagcagagtgagactccatctc

SEQ ID NO: 408571 - DNA, 333 bp, Homo sapiens
tcctggcttgctcaggtctggaagtagagttgagggaaatgagaacagaagccattgccagacctctggaaataaacgagactgaaaaagtgatgagaattgcaataaaagagattttgacacaggttcagaagactaaagacctgctcaataatgtggcctctgatgaagctaatttagaagccaaaatcgaaaagagaaaattagaactggaaagaaatcggaagcgactagagactctgcagagtgtcaggccatgttttatggatgagtatgagaagacctgaggaagccaggagacctgagcaattgtggagacctgagcaagccagg

SEQ ID NO: 408572 - DNA, 2746 bp, Homo sapiens
  misc_feature (2464)..(2464): n is a, c, g, or t
agcgggctgggcctgtgatcgctgaggggcgagcagttgcgaccctgggctcctggggacctgagcgttatgtctttccgcgacctccgcaatatgagccccagactgacatcccgcctgacgtggatactgaacaggaccgagttttcttcattaaggcaattgcccagttcatgattgcagatttgaaggcagccaggcagcttgcgtctgaaatcacctccaaaggagcatctctgtatgacttgctcggcatggaagtagagttgagggaaatgagaacagaagccattgccagacctctggaaataaacgagactgaaaaagtgatgagaattgcaataaaagagattttgacacaggttcagaagactaaagacctgctcaataatgtggcctctgatgaagctaatttagaagccaaaatcgaaaagagaaaattagaactggaaagaaatcggaagcgactagagactctgcagagtgtcaggccatgttttatggatgagtatgagaagactgaggaagaattacaaaagcagtatgacacttatctggagaaatttcaaaatctgacttatctggaacaacagcttgaagaccatcataggatggagcaagaaaggtttgaggaagctaaaaacactctctgcctgatacagaacaagctcaaggaggaagagaagcgcctgctcaagagtggaagtaacgatgactcggacatagacatccaggaggacgatgaatccgacagtgagttggaagaaaggcggctgcccaagccacagacagccatggagatgctcatgcaaggaagacctggcaaacgcattgtgggcacgatgcaaggtggagactccgatgacaatgaggactcggaggagagtgaaattgacatggaagatgatgatgacgaggatgacgatttggaagacgagagcatttctctctcaccaaccaagcccaatcgaagggtccggaaatctgaacccctggatgagagtgacaatgacttctgacccttttgccaagggaccctggcagattaaaaccctcagacttgtaggtaaatgggaacttagaaggttaggaaggtaacccctgttttgtttactaagctggctggactcatgatcactgaagcaatacttatttctgctttagcctcctatgtttgcattccatgaagcttaaataagaattgaagcaaatccctaagatttatttttttccaccttatttatcttctaaaacttgaggaatgcatgtgttcttagtgattcacatccacgggacaaaaactcaagaagaaataagagctgacgccacacaagtcttggctgcttttgttactatacattttctctgagactccagcagagttggggctggaacttggcactggggactcatgtttggaatcgtaggggaacatctggctgttaatcacttgcacagttgagaacatttcctatacatcggcttttaattctagctcttatttcattttgtaatcttattttctttcgtctgcatgttcacaataccaagcattaaatgtattttaataactaaacttttctgaaagaaggttagctaaagttaaatgaaaacttggtttctttgaaaatcaggcaatagagacaggctccagatgaggaatcctccattttctgtccgaagctgacattcctctggcagtccagttcaccttggattacagccaccttcatgtttccacggttggtactaaatctggaaactctggtgacctgggctgccctctcagaaactccagactcccatggcaatgacagccgggacacttttcttccctccagccagggtttctctaaaggagctttgttttgtctaaagtgtggcaagacatagtgcacaacacagggacaaaggcaggtttcctgcagctcgctacctaagtgtttctgtaggggaaggagccaattaagaaaaagtgttggtacagattcatgtttctgatttaaaaaaacaacaacacaggattgaattaagtagagtaatagcactagaagaatttttctgttgtgaaattagaagtggagttggtttttttcttttttcttcttctttttttttaatatgaaaagtacttagctgggagtggtggcaagcgcccttgggtccagctactcaggaggccaaggtgggaggatcacttgagcccaggagttttagactagcctggacaactaagtgagactccatctctacaaaaaattaaaaaattagccaggtgtggaggggcatgcctgtggtctcagctattcaggaggctgaggcaggagaatcacttgagaccaggaagttgaggctgcaatgagccgtgatcatgccactgcactccagcctgggtgacagagtgagaccctgtctttaaaaaaaagaaaaagaaaagcacgctgcttgtaaaaagcgtacagtnggtcaggcgtggtggctcatgcctgtaatcctagcactttgagaggctgaggtgggtagatcacctgaggtcaggggtttgagaccagcctggccaacatggcgaaaccccacctctactaaaaatacaaaaattagccgggcgtggtagcgcatgcctgtaaccccagctactggggaggctgaggcaggagaatcgcttgaacctaggaggcggaggttgcagtgagccgagatggcgccactgcactccagcctgggcagcagagtgagactccatctc

SEQ ID NO: 408573 - DNA, 3095 bp, Homo sapiens
  misc_feature (2813)..(2813): n is a, c, g, or t
agcgggctgggcctgtgatcgctgaggggcgagcagttgcgaccctgggctcctggggacctgagcgttatgtctttccgcgacctccgcaatttcacagagatgatgagagccctgggataccctcgacatatttctatggaaaatttccgtacacccaattttggacttgtatctgaagtgcttctctggcttgtgaaaagatatgagccccagactgacatcccgcctgacgtggatactgaacaggaccgagttttcttcattaaggcaattgcccagttcatggccaccaaggcacatataaaactcaacactaagaagctttatcaagcagatgggtatgcggtaaaagagctgctgaagatcacatctgtcctttataatgctatgaagaccaaggggatggagggctctgaaatagtagaggaagatgtcaacaagttcaagtttgatcttggctcaaagattgcagatttgaaggcagccaggcagcttgcgtctgaaatcacctccaaaggagcatctctgtatgacttgctcggcatggaagtagagttgagggaaatgagaacagaagccattgccagacctctggaaataaacgagactgaaaaagtgatgagaattgcaataaaagagattttgacacaggttcagaagactaaagacctgctcaataatgtggcctctgatgaagctaatttagaagccaaaatcgaaaagagaaaattagaactggaaagaaatcggaagcgactagagactctgcagagtgtcaggccatgttttatggatgagtatgagaagactgaggaagaattacaaaagcagtatgacacttatctggagaaatttcaaaatctgacttatctggaacaacagcttgaagaccatcataggatggagcaagaaaggtttgaggaagctaaaaacactctctgcctgatacagaacaagctcaaggaggaagagaagcgcctgctcaagagtggaagtaacgatgactcggacatagacatccaggaggacgatgaatccgacagtgagttggaagaaaggcggctgcccaagccacagacagccatggagatgctcatgcaaggaagacctggcaaacgcattgtgggcacgatgcaaggtggagactccgatgacaatatggaagcagcaccagctctcttaggtaaatgcaagacttccagctccaagaagcaggaggactcggaggagagtgaaattgacatggaagatgatgatgacgaggatgacgatttggaagacgagagcatttctctctcaccaaccaagcccaatcgaagggtccggaaatctgaacccctggatgagagtgacaatgacttctgacccttttgccaagggaccctggcagattaaaaccctcagacttgtaggtaaatgggaacttagaaggttaggaaggtaacccctgttttgtttactaagctggctggactcatgatcactgaagcaatacttatttctgctttagcctcctatgtttgcattccatgaagcttaaataagaattgaagcaaatccctaagatttatttttttccaccttatttatcttctaaaacttgaggaatgcatgtgttcttagtgattcacatccacgggacaaaaactcaagaagaaataagagctgacgccacacaagtcttggctgcttttgttactatacattttctctgagactccagcagagttggggctggaacttggcactggggactcatgtttggaatcgtaggggaacatctggctgttaatcacttgcacagttgagaacatttcctatacatcggcttttaattctagctcttatttcattttgtaatcttattttctttcgtctgcatgttcacaataccaagcattaaatgtattttaataactaaacttttctgaaagaaggttagctaaagttaaatgaaaacttggtttctttgaaaatcaggcaatagagacaggctccagatgaggaatcctccattttctgtccgaagctgacattcctctggcagtccagttcaccttggattacagccaccttcatgtttccacggttggtactaaatctggaaactctggtgacctgggctgccctctcagaaactccagactcccatggcaatgacagccgggacacttttcttccctccagccagggtttctctaaaggagctttgttttgtctaaagtgtggcaagacatagtgcacaacacagggacaaaggcaggtttcctgcagctcgctacctaagtgtttctgtaggggaaggagccaattaagaaaaagtgttggtacagattcatgtttctgatttaaaaaaacaacaacacaggattgaattaagtagagtaatagcactagaagaatttttctgttgtgaaattagaagtggagttggtttttttcttttttcttcttctttttttttaatatgaaaagtacttagctgggagtggtggcaagcgcccttgggtccagctactcaggaggccaaggtgggaggatcacttgagcccaggagttttagactagcctggacaactaagtgagactccatctctacaaaaaattaaaaaattagccaggtgtggaggggcatgcctgtggtctcagctattcaggaggctgaggcaggagaatcacttgagaccaggaagttgaggctgcaatgagccgtgatcatgccactgcactccagcctgggtgacagagtgagaccctgtctttaaaaaaaagaaaaagaaaagcacgctgcttgtaaaaagcgtacagtnggtcaggcgtggtggctcatgcctgtaatcctagcactttgagaggctgaggtgggtagatcacctgaggtcaggggtttgagaccagcctggccaacatggcgaaaccccacctctactaaaaatacaaaaattagccgggcgtggtagcgcatgcctgtaaccccagctactggggaggctgaggcaggagaatcgcttgaacctaggaggcggaggttgcagtgagccgagatggcgccactgcactccagcctgggcagcagagtgagactccatctc

SEQ ID NO: 408574 - DNA, 1054 bp, Homo sapiens
agcgggctgggcctgtgatcgctgaggggcgagcagttgcgaccctgggctcctggggacctgagcgttatgtctttccgcgacctccgcaatttcacagagatgatgagagccctgggataccctcgacatatttctatggaaaatttccgtacacccaattttggacttgtatctgaagtgcttctctggcttgtgaaaagatatgagccccagactgacatcccgcctgacgtggatactgaacaggaccgagttttcttcattaaggcaattgcccagttcatggccaccaaggcacatataaaactcaacactaagaagctttatcaagcagatgggtatgcggtaaaagagctgctgaagatcacatctgtcctttataatgctatgaagaccaaggggatggagggctctgaaatagtagaggaagatgtcaacaagttcaagtttgatcttggctcaaagattgcagatttgaaggcagccaggcagcttgcgtctgaaatcacctccaaaggagcatctctgtatgacttgctcggcatggaagtagagttgagggaaatgagaacagaagccattgccagacctctggaaataaacgagactgaaaaagtgatgagaattgcaataaaagagattttgacacaggttcagaagactaaagacctgctcaataatgtggcctctgatgaagctaatttagaagccaaaatcgaaaagagaaaattagaactggaaagaaatcggaagcgactagagactctgcagagtgtcaggccatgttttatggatgagtatgagaagactgaggaagaattacaaaagcagtatgacacttatctggagaaatttcaaaatctgacttatctggaacaacagcttgaagaccatcataggatggagcaagaaaggtttgaggtaacgatgactcggacatagacatccaggaggacgatgaatccgacagtgagttggaagaaaggcggctgcccaagccacagacagccatggagatgctcatgcaaggtaccccggcgtctttcgctgg

SEQ ID NO: 408575 - DNA, 1752 bp, Homo sapiens
ctgcaggggggggggggggggggggctgtcatggcggcaggacggcgaacttgcagtatctccacgacccgcccctacaggtgccagtgcctccagaatgtggcagctcacaagcctcctgctgttcgtggccacctggggaatttccggcacaccagctcctcttgactcagtgttctccagcagcgagcgtgcccaccaggtgctgcggatccgcaaacgtgccaactccttcctggaggagctccgtcacagcagcctggagcgggagtgcatagaggagatctgtgacttcgaggaggccaaggaaattttccaaaatgtggatgacacaacggtgaccagtgcttggtcttgcccttggagcacccgtgcgccagcctgtgctgcgggcacggcacgtgcatcgacggcatcggcagcttcagctgcgactgccgcagcggctgggagggccgcttctgccagcgcgaggtgagcttcctcaattgctcgctggacaacggcggctgcacgcattactgcctagaggaggtgggctggcggcgctgtagctgtgcgcctggctacaagctgggggacgacctcctgcagtgtcaccccgcagtgaagttcccttgtgggaggccctggaagcggatggagaagaagcgcagtcacctgaaacgagacacagaagaccaagaagaccaagtagatccgcggctcattgatgggaagatgaccaggcggggagacagcccctggcaggtggtcctgctggactcaaagaagaagctggcctgcggggcagtgctcatccacccctcctgggtgctgacagcggcccactgcatggatgagtccaagaagctccttgtcaggcttggagagtatgacctgcggcgctgggagaagtgggagctggacctggacatcaaggaggtcttcgtccaccccaactacagcaagagcaccaccgacaatgacatcgcactgctgcacctggcccagcccgccaccctctcgcagaccatagtgcccatctgcctcccggacagcggccttgcagagcgcgagctcaatcaggccggccaggagaccctcgtgacgggctggggctaccacagcagccgagagaaggaggccaagagaaaccgcaccttcgtcctcaacttcatcaagattcccgtggtcccgcacaatgagtgcagcgaggtcatgagcaacatggtgtctgagaacatgctgtgtgcgggcatcctcggggaccggcaggatgcctgcgagggcgacagtggggggcccatggtcgcctccttccacggcacctggttcctggtgggcctggtgagctggggtgagggctgtgggctccttcacaactacggcgtttacaccaaagtcagccgctacctcgactggatccatgggcacatcagagacaaggaagccccccagaagagctgggcaccttagcgaccctccctgcagggctgggcttttgcatggcaatggatgggacattaaagggacatgtaacaagcacaccggcctgctgttctgtccttccatccctcttttgggctcttctggagggaagtaacatttactgagcacctgttgtatgtcacatgccttatgaatagaatcttaactcctagagcaactctgtggggtggggaggagcagatccaagttttgcggggtctaaagctgtgtgtgttgagggggatactctgtttatgaaaaagaataaaaaacacaaccacg

SEQ ID NO: 408576 - DNA, 823 bp, Homo sapiens
ctgcaggggggggggggggggggggctgtcatggcggcaggacggcgaacttgcagtatctccacgacccgcccctacaggtgccagtgcctccagaatgtggcagctcacaagcctcctgctgttcgtggccacctggggaatttccggcacaccagctcctcttgactcagtgttctccagcagcgagcgtgcccaccaggtgctgcggatccgcaaacgtgccaactccttcctggaggagctccgtcacagcagcctggagcgggagtgcatagaggagatctgtgacttcgaggaggccaaggaaattttccaaaatgtggatgacacaacggtgaccagtgcttggtcttgcccttggagcacccgtgcgccagcctgtgctgcgggcacggcacgtgcatcgacggcatcggcagcttcagctgcgactgccgcagcggctgggagggccgcttctgccagcgcggtgagggggagaggtggatgctggcgggcggcggggcggggctggggccgggttggtgcctggccccgggtggtgtacttctatgtggacgatactactggtgtcaaggtgcccatgtatgtgcagtcgatctcccatcagatacccttattaatgcggagcttactctgtcagcttgcggctcatcatcctccctcgcccaatggcgattagcatttcttgaacctttccgtacacgggccctgattcagcactaatccttggttgaatttgaattcgggacccgtttctatctgctacctgaggctctgcctcatgcgccgtcttgatctttctctttcgctctccctt

SEQ ID NO: 408577 - DNA, 702 bp, Homo sapiens
  misc_feature (504)..(504): n is a, c, g, or t
  misc_feature (512)..(512): n is a, c, g, or t
  misc_feature (515)..(516): n is a, c, g, or t
  misc_feature (518)..(518): n is a, c, g, or t
ctgcaggggggggggggggggggggctgtcatggcggcaggacggcgaacttgcagtatctccacgacccgcccctacaggtgccagtgcctccagaatgtggcagctcacaagcctcctgctgttcgtggccacctggggaatttccggcacaccagctcctcttgactcagtgttctccagcagcgagcgtgcccaccaggtgctgcggatccgcaaacgtgccaactccttcctggaggagctccgtcacagcagcctggagcgggagtgcatagaggagatctgtgacttcgaggaggccaaggaaattttccaaaatgtggatgacacactggccttctggtccaagcacgtcgacggtgaccagtgcttggtcttgcccttggagcacccgtgcgccagcctgtgctgcgggcacggcacgtgcatcgacggcatcggcagcttcagctgcgactgccgcagcggctgggagggccgcttctgccagcgcggtgaggnggagaggngcnngnggacccactcctaacgagatgactatggcattatttgggccacttgggatacccggcggcattccatgaacaaccccctctatgaagactaccccatgtaacagactcacaattgggggccagtacgactccctggtgggcgccctccacgctggtgacgctgcgcctcctatctcatctgccg

SEQ ID NO: 408578 - DNA, 1777 bp, Homo sapiens
ctgcaggggggggggggggggggggctgtcatggcggcaggacggcgaacttgcagtatctccacgacccgcccctacaggtgccagtgcctccagaatgtggcagctcacaagcctcctgctgttcgtggccacctggggaatttccggcacaccagctcctcttgactcagtgttctccagcagcgagcgtgcccaccaggtgctgcggatccgcaaacgtgccaactccttcctggaggagctccgtcacagcagcctggagcgggagtgcatagaggagatctgtgacttcgaggaggccaaggaaattttccaaaatgtggatgacacactggccttctggtccaagcacgtcgacggtgaccagtgcttggtcttgcccttggagcacccgtgcgccagcctgtgctgcgggcacggcacgtgcatcgacggcatcggcagcttcagctgcgactgccgcagcggctgggagggccgcttctgccagcgcgaggtgagcttcctcaattgctcgctggacaacggcggctgcacgcattactgcctagaggaggtgggctggcggcgctgtagctgtgcgcctggctacaagctgggggacgacctcctgcagtgtcaccccgcagtgaagttcccttgtgggaggccctggaagcggatggagaagaagcgcagtcacctgaaacgagacacagaagaccaagaagaccaagtagatccgcggctcattgatgggaagatgaccaggcggggagacagcccctggcaggtggtcctgctggactcaaagaagaagctggcctgcggggcagtgctcatccacccctcctgggtgctgacagcggcccactgcatggatgagtccaagaagctccttgtcaggcttggagagtatgacctgcggcgctgggagaagtgggagctggacctggacatcaaggaggtcttcgtccaccccaactacagcaagagcaccaccgacaatgacatcgcactgctgcacctggcccagcccgccaccctctcgcagaccatagtgcccatctgcctcccggacagcggccttgcagagcgcgagctcaatcaggccggccaggagaccctcgtgacgggctggggctaccacagcagccgagagaaggaggccaagagaaaccgcaccttcgtcctcaacttcatcaagattcccgtggtcccgcacaatgagtgcagcgaggtcatgagcaacatggtgtctgagaacatgctgtgtgcgggcatcctcggggaccggcaggatgcctgcgagggcgacagtggggggcccatggtcgcctccttccacggcacctggttcctggtgggcctggtgagctggggtgagggctgtgggctccttcacaactacggcgtttacaccaaagtcagccgctacctcgactggatccatgggcacatcagagacaaggaagccccccagaagagctgggcaccttagcgaccctccctgcagggctgggcttttgcatggcaatggatgggacattaaagggacatgtaacaagcacaccggcctgctgttctgtccttccatccctcttttgggctcttctggagggaagtaacatttactgagcacctgttgtatgtcacatgccttatgaatagaatcttaactcctagagcaactctgtggggtggggaggagcagatccaagttttgcggggtctaaagctgtgtgtgttgagggggatactctgtttatgaaaaagaataaaaaacacaaccacg

SEQ ID NO: 408579 - DNA, 1835 bp, Homo sapiens
ggcactgcccggagctcagaagtcctcctcagacaggtgccagtgcctccagaatgtggcagctcacaagcctcctgctgttcgtggccacctggggaatttccggcacaccagctcctcttgactcagtgttctccagcagcgagcgtgcccaccaggtgctgcggatccgcaaacgtgccaactccttcctggaggagctccgtcacagcagcctggagcgggagtgcatagaggagatctgtgacttcgaggaggccaaggaaattttccaaaatgtggatgacacactggccttctggtccaagcacgtcgacggtgaccagtgcttggtcttgcccttggagcacccgtgcgccagcctgtgctgcgggcacggcacgtgcatcgacggcatcggcagcttcagctgcgactgccgcagcggctgggagggccgcttctgccagcgcggtgagggggagaggtggatgctggcgggcggcggggcggggctggggccgggttgggggcgcggcaccagcaccagctgcccgcgccctcccctgcccgcagaggtgagcttcctcaattgctcgctggacaacggcggctgcacgcattactgcctagaggaggtgggctggcggcgctgtagctgtgcgcctggctacaagctgggggacgacctcctgcagtgtcaccccgcagtgaagttcccttgtgggaggccctggaagcggatggagaagaagcgcagtcacctgaaacgagacacagaagaccaagaagaccaagtagatccgcggctcattgatgggaagatgaccaggcggggagacagcccctggcaggtggtcctgctggactcaaagaagaagctggcctgcggggcagtgctcatccacccctcctgggtgctgacagcggcccactgcatggatgagtccaagaagctccttgtcaggcttggagagtatgacctgcggcgctgggagaagtgggagctggacctggacatcaaggaggtcttcgtccaccccaactacagcaagagcaccaccgacaatgacatcgcactgctgcacctggcccagcccgccaccctctcgcagaccatagtgcccatctgcctcccggacagcggccttgcagagcgcgagctcaatcaggccggccaggagaccctcgtgacgggctggggctaccacagcagccgagagaaggaggccaagagaaaccgcaccttcgtcctcaacttcatcaagattcccgtggtcccgcacaatgagtgcagcgaggtcatgagcaacatggtgtctgagaacatgctgtgtgcgggcatcctcggggaccggcaggatgcctgcgagggcgacagtggggggcccatggtcgcctccttccacggcacctggttcctggtgggcctggtgagctggggtgagggctgtgggctccttcacaactacggcgtttacaccaaagtcagccgctacctcgactggatccatgggcacatcagagacaaggaagccccccagaagagctgggcaccttagcgaccctccctgcagggctgggcttttgcatggcaatggatgggacattaaagggacatgtaacaagcacaccggcctgctgttctgtccttccatccctcttttgggctcttctggagggaagtaacatttactgagcacctgttgtatgtcacatgccttatgaatagaatcttaactcctagagcaactctgtggggtggggaggagcagatccaagttttgcggggtctaaagctgtgtgtgttgagggggatactctgtttatgaaaaagaataaaaaacacaaccacg

SEQ ID NO: 408580 - DNA, 769 bp, Homo sapiens
ctgcaggggggggggggggggggggctgtcatggcggcaggacggcgaacttgcagtatctccacgacccgcccctacaggtgccagtgcctccagaatgtggcagctcacaagcctcctgctgttcgtggccacctggggaatttccggcacaccagctcctcttgactcagtgttctccagcagcgagcgtgcccaccaggtgctgcggatccgcaaacgtgccaactccttcctggaggagctccgtcacagcagcctggagcgggagtgcatagaggagatctgtgacttcgaggaggccaaggaaattttccaaaatgtggatgacacactggccttctggtccaagcacgtcgacggtgaccagtgcttggtcttgcccttggagcacccgtgcgccagcctgtgctgcgggcacggcacgtgcatcgacggcatcggcagcttcagctgcgactgccgcagcggctgggagggccgcttctgccagcgcggtgagggggagaggtggatgctggcgggcggcggggcggggctggggccgggttggaccatgctgaccgtcttatgtcatgccatggttggcccctcgttcagtctgttcccgcccgtctctgaagagcttcgaaccaacaaggccacactgtcgagtatactaacggacgtctacctcgcatatcgatcagagtactggcaggctagttatcatccccgctaagtgcgcagtgtatacgcccactagttctggggaggtctactcctctgc

SEQ ID NO: 408581 - DNA, 320 bp, Homo sapiens
actagtaagtgcttaataattactagctgttatgatgatgaagaaatattatcactcttttactaagagtataagaaaagtcattatcaaagcacactgtttttcatatctaagtgaacagtgatatttgtaataagagcactttaagtattcctattaaagcggaagatagcaggcagggtggaaaagtacaagaataattcccatggagtacaggtctccacttttgtcccttagccatctccaatgtaaggaaagtcttggactgaaagtctgtttctgaaagtcatacaagagctatttttatgccagaaaagcga

SEQ ID NO: 408582 - DNA, 3923 bp, Homo sapiens
  misc_feature (4)..(4): n is a, c, g, or t
  misc_feature (6)..(6): n is a, c, g, or t
  misc_feature (8)..(8): n is a, c, g, or t
acgngncnggagagtgagagaaaggctggaagacgagacctgctcactctgtcaccgaggctagagtacagtggcacaatcacagctcattgcagcctcaacctcccaggctcaatcgatccttccaactgagcctccctagcagctgggactattagtgcacaccaccacacctagcctgcaggatgtttcctcaatgaggggaaggctgctgcacaatggcagtttttgatactcctgaggaggcctttggtgtcttacgtccagtctgtgttcagctcacaaagacccagacagtggagaatgtggagcatctgcagacacgactacaagctgtgagtgacagtgcccttcaggaacttcagcagtacatcctcttccctctgcgatttaccctgaagaccccaggtcccaaaagagagcgtttgatccaaagtgtggtggaatgcctcacatttgtcctttcttcaacatgtgtgaaagaacaggagcttctccaggaactcttttcagaactctctgcttgtctgtattcacccagctcccaaaaacctgcggctgtgtccgaggagttgaaattggctgtgatccagggacttagcacattaatgcactcagcttatggggacatcattctgactttttatgagccctccattctgccacgtttaggatttgctgtatctttactgttaggccttgcagaacaggagaaatcaaagcaaattaaaattgctgccttaaaatgtttacaggttctactcttgcagtgtgattgtcaggaccatccaaggtcattggatgaacttgaacaaaagcagctgggggatttgtttgcctcttttttacctggaatctcaactgcactgaccaggcttatcacaggagactttaaacaaggtcacagcattgtcgtatcttccctaaagatcttttacaagacagtgagcttcattatggctgatgaacagctcaaaagaatctcaaaggtccaagcaaaacctgcagttgagcacagagtagcagagctgatggtttacagggaagcagattgggtaaaaaagactggcgacaagttgactatccttattaaaaagataattgagtgtgtttctgttcacccacactggaaggtgagactggaactggtagaacttgtggaggaccttcttttgaagtgcagtcaatcattggtcgaatgtgctggtccccttctgaaggccttagtgggactagtaaatgatgagagtcctgaaatccaagcccagtgcaataaagttctgagacattttgcagatcaaaaagtagtggtgggcaacaaagccctcgctgacatcttgtcagaaagcctgcattcccttgccacatctcttcctcgcctaatgaactcccaagatgaccagggcaaattctctactctttccttgttacttggttatctgaaactcttgggcccaaaaataaactttgtcctcaactctgtggcccatctccagcggctttccaaagcactcatccaagttctagagctagacgtggctgacatcaagattgttgaggaacggcgttggaactctgatgatctgaatgcttctccaaagacctcagccacacagccttggaaccgcatccagaggagatatttccgcttcttcactgatgagagaatcttcatgctcttgaggcaggtttgtcagctacttggttattatgggaatctttatttgcttgtggatcactttatggaactttaccatcaatctgtggtttaccggaagcaagctgccatgatccttaatgaactggttacaggggctgctgggctggaggttgaggatcttcacgaaaaacatattaaaacaaacccagaagaactgagagagattgtgacatctatacttgaagaatacacaagtcaagaaaattggtatttggttacctgtcttgaaactgaggaaatgggagaggagctgatgatggagcacccaggcctccaagccatcacgtctggtgaacacacctgccaagttacatcttttctagccttctcaaagccaagtcccactatttgctccatgaacagtaacatctggcaaatatgcattcagttggaaggaattggccagtttgcatatgcactaggaaaagacttctgtttgctcttgatgtcagccctttatccagtactggagaaggctggagaccaaaccctactcattagtcaggtggctaccagcaccatgatggacgtttgccgtgcttgtggctacgactccctgcagcacctgatcaatcaaaattcagactatttagtgaatgggatctctttaaatctgcgtcatctggctctgcatcctcataccccaaaggtcctggaagtcatgctgcggaactcagatgctaacctgcttcctttggtggcagatgtggttcaagatgtcttggccaccctggaccaattttacgataagagagctgcttcctttgtcagcgttctgcatgctctgatggcagcattagcccagtggttcccagacacaggtaatcttgggcacctccaagagcaaagtttaggagaagagggaagtcatttgaaccaaagaccagcagctcttgagaagagcaccaccacagctgaagacatcgaacagtttttgctgaactacctcaaagagaaggatgtggcagatggaaatgtctcggattttgataatgaagaagaggaacagtcagtccctcccaaagtggatgagaatgacacccgtccagatgtggagccaccactgccattgcagatccaaatagccatggacgtgatggaacgctgcatccacttgttgtcagataaaaatctgcaaatccgcctgaaggtcttggatgtgctggatctgtgtgtggttgttcttcagtcccacaaaaaccagctgcttcccttggctcatcaggcctggccctcgctcgttcaccgactcacacgggacgcccccctggcagtgcttagagccttcaaggttttacgtaccctgggaagcaagtgtggtgactttcttcgcagccggttctgcaaagatgtcctgccaaagctggctggctccctagtcacccaggcccccatcagtgccagggctggaccagtttactcgcacacgctggccttcaagttgcagctggctgtcttacagggcctgggccccctctgtgagagactggacctaggtgagggtgacctgaataaagtggctgatgcctgcttgatttacctcagtgtcaaacagcccgtgaaattacaagaggctgccaggagcgtcttcctccacttgatgaaggtggacccagactccacctggttcctcctgaacgagctttactgccccgtgcagttcacacctccccaccccagcctccaccctgtgcagctgcacggggccagcgggcagcagaacccctacacgaccaacgtgctccagctgctcaaggagctgcagtgaccctgctcccccaccacagaggccaccgatccctcccctactgccagccagaagctgggctgaccccaccccggccataggcggtggcagcggcagcagagaaggtgaattagttagccaatcgatttataaattgatcgatcacacaactgcttagaaatggattgaaggaaagtagctgactattatttatatttcataccttgtgttttcaagtgacattgtctggtggctctaagggtttaaccccttagcctaccatctctatagccccagctccctcacaggccacacacacacacacacaagaggtcagttcccctccatctgcatacacctccctgtcttcaaataatgagatggaactaatttgttttacctaacctgatctttgggaaacaaacggaaataaagacacttcttggatgaaaagta

SEQ ID NO: 408583 - DNA, 2737 bp, Homo sapiens
  misc_feature (4)..(4): n is a, c, g, or t
  misc_feature (6)..(6): n is a, c, g, or t
  misc_feature (8)..(8): n is a, c, g, or t
acgngncnggagagtgagagaaaggctggaagacgagacctgctcactctgtcaccgaggctagagtacagtggcacaatcacagctcattgcagcctcaacctcccaggctcaatcgatccttccaactgagcctccctagcagctgggactattagtgcacaccaccacacctagcctgcaggatgtttcctcaatgaggggaaggctgctgcacaatggcagtttttgatactcctgaggaggcctttggtgtcttacgtccagtctgtgttcagctcacaaagacccagacagtggagaatgtggagcatctgcagacacgactacaagctgtgagtgacagtgcccttcaggaacttcagcagtacatcctcttccctctgcgatttaccctgaagaccccaggtcccaaaagagagcgtttgatccaaagtgtggtggaatgcctcacatttgtcctttcttcactgatgagagaatcttcatgctcttgaggcaggtttgtcagctacttggttattatgggaatctttatttgcttgtggatcactttatggaactttaccatcaatctgtggtttaccggaagcaagctgccatgatccttaatgaactggttacaggggctgctgggctggaggttgaggatcttcacgaaaaacatattaaaacaaacccagaagaactgagagagattgtgacatctatacttgaagaatacacaagtcaagaaaattggtatttggttacctgtcttgaaactgaggaaatgggagaggagctgatgatggagcacccaggcctccaagccatcacgtctggtgaacacacctgccaagttacatcttttctagccttctcaaagccaagtcccactatttgctccatgaacagtaacatctggcaaatatgcattcagttggaaggaattggccagtttgcatatgcactaggaaaagacttctgtttgctcttgatgtcagccctttatccagtactggagaaggctggagaccaaaccctactcattagtcaggtggctaccagcaccatgatggacgtttgccgtgcttgtggctacgactccctgcagcacctgatcaatcaaaattcagactatttagtgaatgggatctctttaaatctgcgtcatctggctctgcatcctcataccccaaaggtcctggaagtcatgctgcggaactcagatgctaacctgcttcctttggtggcagatgtggttcaagatgtcttggccaccctggaccaattttacgataagagagctgcttcctttgtcagcgttctgcatgctctgatggcagcattagcccagtggttcccagacacaggtaatcttgggcacctccaagagcaaagtttaggagaagagggaagtcatttgaaccaaagaccagcagctcttgagaagagcaccaccacagctgaagacatcgaacagtttttgctgaactacctcaaagagaaggatgtggcagatggaaatgtctcggattttgataatgaagaagaggaacagtcagtccctcccaaagtggatgagaatgacacccgtccagatgtggagccaccactgccattgcagatccaaatagccatggacgtgatggaacgctgcatccacttgttgtcagataaaaatctgcaaatccgcctgaaggtcttggatgtgctggatctgtgtgtggttgttcttcagtcccacaaaaaccagctgcttcccttggctcatcaggcctggccctcgctcgttcaccgactcacacgggacgcccccctggcagtgcttagagccttcaaggttttacgtaccctgggaagcaagtgtggtgactttcttcgcagccggttctgcaaagatgtcctgccaaagctggctggctccctagtcacccaggcccccatcagtgccagggctggaccagtttactcgcacacgctggccttcaagttgcagctggctgtcttacagggcctgggccccctctgtgagagactggacctaggtgagggtgacctgaataaagtggctgatgcctgcttgatttacctcagtgtcaaacagcccgtgaaattacaagaggctgccaggagcgtcttcctccacttgatgaaggtggacccagactccacctggttcctcctgaacgagctttactgccccgtgcagttcacacctccccaccccagcctccaccctgtgcagctgcacggggccagcgggcagcagaacccctacacgaccaacgtgctccagctgctcaaggagctgcagtgaccctgctcccccaccacagaggccaccgatccctcccctactgccagccagaagctgggctgaccccaccccggccataggcggtggcagcggcagcagagaaggtgaattagttagccaatcgatttataaattgatcgatcacacaactgcttagaaatggattgaaggaaagtagctgactattatttatatttcataccttgtgttttcaagtgacattgtctggtggctctaagggtttaaccccttagcctaccatctctatagccccagctccctcacaggccacacacacacacacacaagaggtcagttcccctccatctgcatacacctccctgtcttcaaataatgagatggaactaatttgttttacctaacctgatctttgggaaacaaacggaaataaagacacttcttggatgaaaagta

SEQ ID NO: 408584 - DNA, 1159 bp, Homo sapiens
ccatgtgggagggaagcctgcgctggccgcccacgcgggagggaagcctgcgctggccgtcgtactgaccgctgcctgtgacactgatgcaggcagtctcttttcagtcttggatgtgctggatctgtgtgtggttgttcttcagtcccacaaaaaccagctgcttcccttggctcatcaggcctggccctcgctcgttcaccgactcacacgggacgcccccctggcagtgcttagagccttcaaggttttacgtaccctgggaagcaagtgtggtgactttcttcgcagccggttctgcaaagatgtcctgccaaagctggctggctccctagtcacccaggcccccatcagtgccagggctggaccagtttactcgcacacgctggccttcaagttgcagctggctgtcttacagggcctgggccccctctgtgagagactggacctaggtgagggtgacctgaataaagtggctgatgcctgcttgatttacctcagtgtcaaacagcccgtgaaattacaagaggctgccaggagcgtcttcctccacttgatgaaggtggacccagactccacctggttcctcctgaacgagctttactgccccgtgcagttcacacctccccaccccagcctccaccctgtgcagctgcacggggccagcgggcagcagaacccctacacgaccaacgtgctccagctgctcaaggagctgcagtgaccctgctcccccaccacagaggccaccgatccctcccctactgccagccagaagctgggctgaccccaccccggccataggcggtggcagcggcagcagagaaggtgaattagttagccaatcgatttataaattgatcgatcacacaactgcttagaaatggattgaaggaaagtagctgactattatttatatttcataccttgtgttttcaagtgacattgtctggtggctctaagggtttaaccccttagcctaccatctctatagccccagctccctcacaggccacacacacacacacacaagaggtcagttcccctccatctgcatacacctccctgtcttcaaataatgagatggaactaatttgttttacctaacctgatctttgggaaacaaacggaaataaagacacttcttggatgaaaagta

SEQ ID NO: 408585 - DNA, 194 bp, Homo sapiens
aataaagtggctgatgcctgcttgatttacctcagtgtcaaacagcccgtgaaattacaagaggctgccaggaggtacgtctgcctgatcacccgcatccctttacgtttgttctaaattacagatgatttgctaatggcaagcagagttgaggcatctctgctcttttctctgtcaccctgccaggttaagat

SEQ ID NO: 408586 - DNA, 436 bp, Homo sapiens
aacagtttttgctgaactacctcaaagagaaggatgtggcagatggaaatgtctcggattttgataatgaagaaggtaacttgtttattttggcttagctggttttttctttctgaaacagattattgtaaaaatggtgaaacatcattacagaaagggtagaaataagaaaagttactcataaccttaccaggctaacatagctattctcctgttttgtgtaatctttttccattcttttctgttacaaaactgtttttccgtggttgcagctgtgtaccctttttgtgtttagttataagcaactctgcttattgccgttgaattttgatcattaacgttttaatagctgttactaagtgtccatcccctgtaggacatttaggttgcttctggcttaataataactctaataaacagtgctgcggtggatgat

SEQ ID NO: 408587 - DNA, 3783 bp, Homo sapiens
  misc_feature (4)..(4): n is a, c, g, or t
  misc_feature (6)..(6): n is a, c, g, or t
  misc_feature (8)..(8): n is a, c, g, or t
acgngncnggagagtgagagaaaggctggaagacgagcctgcaggatgtttcctcaatgaggggaaggctgctgcacaatggcagtttttgatactcctgaggaggcctttggtgtcttacgtccagtctgtgttcagctcacaaagacccagacagtggagaatgtggagcatctgcagacacgactacaagctgtgagtgacagtgcccttcaggaacttcagcagtacatcctcttccctctgcgatttaccctgaagaccccaggtcccaaaagagagcgtttgatccaaagtgtggtggaatgcctcacatttgtcctttcttcaacatgtgtgaaagaacaggagcttctccaggaactcttttcagaactctctgcttgtctgtattcacccagctcccaaaaacctgcggctgtgtccgaggagttgaaattggctgtgatccagggacttagcacattaatgcactcagcttatggggacatcattctgactttttatgagccctccattctgccacgtttaggatttgctgtatctttactgttaggccttgcagaacaggagaaatcaaagcaaattaaaattgctgccttaaaatgtttacaggttctactcttgcagtgtgattgtcaggaccatccaaggtcattggatgaacttgaacaaaagcagctgggggatttgtttgcctcttttttacctggaatctcaactgcactgaccaggcttatcacaggagactttaaacaaggtcacagcattgtcgtatcttccctaaagatcttttacaagacagtgagcttcattatggctgatgaacagctcaaaagaatctcaaaggtccaagcaaaacctgcagttgagcacagagtagcagagctgatggtttacagggaagcagattgggtaaaaaagactggcgacaagttgactatccttattaaaaagataattgagtgtgtttctgttcacccacactggaaggtgagactggaactggtagaacttgtggaggaccttcttttgaagtgcagtcaatcattggtcgaatgtgctggtccccttctgaaggccttagtgggactagtaaatgatgagagtcctgaaatccaagcccagtgcaataaagttctgagacattttgcagatcaaaaagtagtggtgggcaacaaagccctcgctgacatcttgtcagaaagcctgcattcccttgccacatctcttcctcgcctaatgaactcccaagatgaccagggcaaattctctactctttccttgttacttggttatctgaaactcttgggcccaaaaataaactttgtcctcaactctgtggcccatctccagcggctttccaaagcactcatccaagttctagagctagacgtggctgacatcaagattgttgaggaacggcgttggaactctgatgatctgaatgcttctccaaagacctcagccacacagccttggaaccgcatccagaggagatatttccgcttcttcactgatgagagaatcttcatgctcttgaggcaggtttgtcagctacttggttattatgggaatctttatttgcttgtggatcactttatggaactttaccatcaatctgtggtttaccggaagcaagctgccatgatccttaatgaactggttacaggggctgctgggctggaggttgaggatcttcacgaaaaacatattaaaacaaacccagaagaactgagagagattgtgacatctatacttgaagaatacacaagtcaagaaaattggtatttggttacctgtcttgaaactgaggaaatgggagaggagctgatgatggagcacccaggcctccaagccatcacgtctggtgaacacacctgccaagttacatcttttctagccttctcaaagccaagtcccactatttgctccatgaacagtaacatctggcaaatatgcattcagttggaaggaattggccagtttgcatatgcactaggaaaagacttctgtttgctcttgatgtcagccctttatccagtactggagaaggctggagaccaaaccctactcattagtcaggtggctaccagcaccatgatggacgtttgccgtgcttgtggctacgactccctgcagcacctgatcaatcaaaattcagactatttagtgaatgggatctctttaaatctgcgtcatctggctctgcatcctcataccccaaaggtcctggaagtcatgctgcggaactcagatgctaacctgcttcctttggtggcagatgtggttcaagatgtcttggccaccctggaccaattttacgataagagagctgcttcctttgtcagcgttctgcatgctctgatggcagcattagcccagtggttcccagacacaggtaatcttgggcacctccaagagcaaagtttaggagaagagggaagtcatttgaaccaaagaccagcagctcttgagaagagcaccaccacagctgaagacatcgaacagtttttgctgaactacctcaaagagaaggatgtggcagatggaaatgtctcggattttgataatgaagaagaggaacagtcagtccctcccaaagtggatgagaatgacacccgtccagatgtggagccaccactgccattgcagatccaaatagccatggacgtgatggaacgctgcatccacttgttgtcagataaaaatctgcaaatccgcctgaaggtcttggatgtgctggatctgtgtgtggttgttcttcagtcccacaaaaaccagctgcttcccttggctcatcaggcctggccctcgctcgttcaccgactcacacgggacgcccccctggcagtgcttagagccttcaaggttttacgtaccctgggaagcaagtgtggtgactttcttcgcagccggttctgcaaagatgtcctgccaaagctggctggctccctagtcacccaggcccccatcagtgccagggctggaccagtttactcgcacacgctggccttcaagttgcagctggctgtcttacagggcctgggccccctctgtgagagactggacctaggtgagggtgacctgaataaagtggctgatgcctgcttgatttacctcagtgtcaaacagcccgtgaaattacaagaggctgccaggagcgtcttcctccacttgatgaaggtggacccagactccacctggttcctcctgaacgagctttactgccccgtgcagttcacacctccccaccccagcctccaccctgtgcagctgcacggggccagcgggcagcagaacccctacacgaccaacgtgctccagctgctcaaggagctgcagtgaccctgctcccccaccacagaggccaccgatccctcccctactgccagccagaagctgggctgaccccaccccggccataggcggtggcagcggcagcagagaaggtgaattagttagccaatcgatttataaattgatcgatcacacaactgcttagaaatggattgaaggaaagtagctgactattatttatatttcataccttgtgttttcaagtgacattgtctggtggctctaagggtttaaccccttagcctaccatctctatagccccagctccctcacaggccacacacacacacacacaagaggtcagttcccctccatctgcatacacctccctgtcttcaaataatgagatggaactaatttgttttacctaacctgatctttgggaaacaaacggaaataaagacacttcttggatgaaaagta

SEQ ID NO: 408588 - DNA, 2494 bp, Homo sapiens
  misc_feature (4)..(4): n is a, c, g, or t
  misc_feature (6)..(6): n is a, c, g, or t
  misc_feature (8)..(8): n is a, c, g, or t
acgngncnggagagtgagagaaaggctggaagacgagcctgcaggatgtttcctcaatgaggggaaggctgctgcacaatggcagtttttgatactcctgaggaggcctttggtgtcttacgtccagtctgtgttcagctcacaaagacccagacagtggagaatgtggagcatctgcagacacgactacaagctcggctttccaaagcactcatccaagttctagagctagacgtggctgacatcaagattgttgaggaacggcgttggaactctgatgatctgaatgcttctccaaagacctcagccacacagccttggaaccgcatccagaggagatatttccgcttcttcactgatgagagaatcttcatgctcttgaggggctgctgggctggaggttgaggatcttcacgaaaaacatattaaaacaaacccagaagaactgagagagattgtgacatctatacttgaagaatacacaagtcaagaaaattggtatttggttacctgtcttgaaactgaggaaatgggagaggagctgatgatggagcacccaggcctccaagccatcacgtctggtgaacacacctgccaagttacatcttttctagccttctcaaagccaagtcccactatttgctccatgaacagtaacatctggcaaatatgcattcagttggaaggaattggccagtttgcatatgcactaggaaaagacttctgtttgctcttgatgtcagccctttatccagtactggagaaggctggagaccaaaccctactcattagtcaggtggctaccagcaccatgatggacgtttgccgtgcttgtggctacgactccctgcagcacctgatcaatcaaaattcagactatttagtgaatgggatctctttaaatctgcgtcatctggctctgcatcctcataccccaaaggtcctggaagtcatgctgcggaactcagatgctaacctgcttcctttggtggcagatgtggttcaagatgtcttggccaccctggaccaattttacgataagagagctgcttcctttgtcagcgttctgcatgctctgatggcagcattagcccagtggttcccagacacaggtaatcttgggcacctccaagagcaaagtttaggagaagagggaagtcatttgaaccaaagaccagcagctcttgagaagagcaccaccacagctgaagacatcgaacagtttttgctgaactacctcaaagagaaggatgtggcagatggaaatgtctcggattttgataatgaagaagaggaacagtcagtccctcccaaagtggatgagaatgacacccgtccagatgtggagccaccactgccattgcagatccaaatagccatggacgtgatggaacgctgcatccacttgttgtcagataaaaatctgcaaatccgcctgaaggtcttggatgtgctggatctgtgtgtggttgttcttcagtcccacaaaaaccagctgcttcccttggctcatcaggcctggccctcgctcgttcaccgactcacacgggacgcccccctggcagtgcttagagccttcaaggttttacgtaccctgggaagcaagtgtggtgactttcttcgcagccggttctgcaaagatgtcctgccaaagctggctggctccctagtcacccaggcccccatcagtgccagggctggaccagtttactcgcacacgctggccttcaagttgcagctggctgtcttacagggcctgggccccctctgtgagagactggacctaggtgagggtgacctgaataaagtggctgatgcctgcttgatttacctcagtgtcaaacagcccgtgaaattacaagaggctgccaggagcgtcttcctccacttgatgaaggtggacccagactccacctggttcctcctgaacgagctttactgccccgtgcagttcacacctccccaccccagcctccaccctgtgcagctgcacggggccagcgggcagcagaacccctacacgaccaacgtgctccagctgctcaaggagctgcagtgaccctgctcccccaccacagaggccaccgatccctcccctactgccagccagaagctgggctgaccccaccccggccataggcggtggcagcggcagcagagaaggtgaattagttagccaatcgatttataaattgatcgatcacacaactgcttagaaatggattgaaggaaagtagctgactattatttatatttcataccttgtgttttcaagtgacattgtctggtggctctaagggtttaaccccttagcctaccatctctatagccccagctccctcacaggccacacacacacacacacaagaggtcagttcccctccatctgcatacacctccctgtcttcaaataatgagatggaactaatttgttttacctaacctgatctttgggaaacaaacggaaataaagacacttcttggatgaaaagta

SEQ ID NO: 408589 - DNA, 622 bp, Homo sapiens
agcaccatgatggacgtttgccgtgcttgtggctacgactccctgcagcacctgatcaatcaaaattcagactatttagtgaatgggatctctttaaatctgcgtcatctggctctgcatcctcataccccaaaggtcctggaagtcatgctgcggaactcagatgctaacctgcttcctttggtggcagatgtggttcaagatgtcttggccaccctggaccaattttacgataagagagctgcttcctttgtcagcgttctgcatgctctgatggcagcattaggtacattgagagccctttttaatgctgatgtgtgggggacaggactcagtctcctagtttgcttagcctcgttttttgcattgtttgtggtgatgctatggaggacgttttaatcattttctctccagtcccataggttatgggggggtttcactgtttatcttttatactttcagtaatctctaccatttattgagctcctgctctatgccagggtataaaccctgcagaataaatgtaaatattatttctattttataaataagaaaaactaagggtcagtgacatcctacttagccagggtcacacaattaataaatgataaaatcaggattt

SEQ ID NO: 408590 - DNA, 507 bp, Homo sapiens
gtttcagaatcgagagatgcttccgttttggatgaacagcaccggcaggcgggaaggttggcagcgtggatggcacggctacgacaacgagctcatggacatgcggggcatcttcctggccttcggacctgatttcaaatccaacttcagagctgctcctatcaggtcggtggacgtctacaatgtcatgtgcaatgtggtgggcatcaccccgctgcccaacaacggatcctggtccagggtgatgtgcatgctgaagggccgcgccagcactgccccgcctgtctggcccagccactgtgccctggcactgattcttctcttcctgcttgcataactgatcatattgcttgtctcagaaaaaaacaccatcagcaaagtgggcctccaaagccagatgattttcattttatgtgtgaataatagcttcattaacacaatcaagaccatgcacattgtaaatacattattcttggataattctatacataaaagttcctacttgtt

SEQ ID NO: 408591 - DNA, 393 bp, Homo sapiens
gtttcagaatcgagagatgcttccgttttggatgaacagcaccggcaggcgggaaggttggcagcgtggatggcacggctacgacaacgagctcatggacatgcggggcatcttcctggccttcggacctggtaggcgaggaaatgaccagatgctctcagaccccattcccaaggaagtgtctgtaaggggggctacgggtgccaggagaggctgcagggatttccttacagaccctctttatgagccaagcagagcaaacccagccggtctccatgaaacatcttttgctggcttcctttcaaatgcttcttgggtttggcaaatgtagccaaatactttgccttgtaaattttaaatcctgagtgcagtgaagaaaatgtattccacatg

SEQ ID NO: 408592 - DNA, 907 bp, Homo sapiens
taaaaaacatgcttgtctgacaagtcaatcattttaagccccttgttcacttcaggatggttgctaaaggcttctctgtgagctaaaagctctcgctgttaaggggctgcctgccctgactgtatgcattaaatggaacagttctctacatggtttcttactacagatgccttgggatatatggacactggcattacctgctgcaacaggtcctctcccagggtactgctgagacctaagggcttaaatgctcaccaaaccaagtgaccttggagggctggtcatggtgggcatctgggagctgggaaagagcattggagaacttcatagggaaacctagtaggcaaaaatgaaagaacccataagggccattggcatgagccatagctaaaggccactgggttagctctcaaagaaaactgcaagattgaagcataaattccttcatcatgaaccagaagtcatggagtggagccaggggcaagaaagagaaagatgaagaggtagaaccaccaggataaaggtgccaagaaaaacagtgagagcaacactcagggaaccagagacaggaacacagctgggaactaggaggagaaaccaccacagctggagcgcaaagtggccaggtcagaaaagcctcatggaatcctggttaactgaatgtttctattgactgaggccactgcttaagccctgtattcttttttatttcaatccccatggttagaaaaatagtcctaaaatgggttcataccctttcctatcctgcaagatcttaaacatcactatcttttcctgcagtagttaaaagcatgggctttggaatcagaaactgggcacaaatctgagccctgctacttattaactgtgtaacattggtcaaatgaataaacttcctggagcctca

SEQ ID NO: 408593 - DNA, 437 bp, Homo sapiens
tttttttttgagactgaggtttgctcttgttgcccaggctggagtgcaatggtgcgatctcagctcaccacaacctctgcctcccagtttcaagtgattctcctgcctcagcctcctcagtagctgggattacaggcatgcaccaccacgcccagctaattttgtatttttagtagagacggggtttctccatattggtcaggctggtcttgaactcctgaactcaggtgatccatctgtctcagcctcccaaagtgctgggattacaggcgtgagccaccacacttggcctaaatacaattatttttaataaaaaagaaagtattatcctgtcaagagccaccctaaccagactcagtacaatgttaatacacatcacccagaagagagggcaccttcagttcgtgccagagaatctctcttgtcagtaaaaagtt

SEQ ID NO: 408594 - DNA, 4613 bp, Homo sapiens
gtctccctaagccctgtgtctaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcgggaaagaagccctcgtggatggaggaagaagatttatcttttctctacaagagcagcccaggaagaaagcatcagggaactgttaagaggagacaagaagaagaccacttccagtttccagacatggctgatgggggctaccctaataaaattaagaggccttgccttgaagatgtcacccttgcaatgggcccaggtgctcatcctagtactgcttgtgcagaactgcaggtccctccattgacaataaatcctagccctgcggctatgggagtggctggccagtcattactgctggagaataaccctatgaatggcaacatcatgggctcaccatttgtagtaccacagactacagaagtgggactgaaagggcccactgttccttactatgagaaaatcaacagcgtgccggctgtagaccaggagcttcaagagctgctagaggagctcaccaaaattcaagacccttctccaaatgagctagatcttgagaagatactggggacgaagccagaagagccactggttttagatcatccccaggcaaccctaagcacaactcccaagccttcggttcagatgtcacacttggagagcctggcttccagcaaggagtttgcttctagttgcagccaagttactggcatgtcacttcagatcccatcctcctccacagggatcagctattcgattccttccaccagtaagcagatagtgtcaccgagttcttcaatggcacagtccaagagccaggtccaggccatgctccctgtcgctctgccccccttaccagtgcctcagtggcatcacgcccaccagctgaaggcgttggcagccagcaagcaggggtctgctacaaagcagcaagggcccacccccagttggtctggtctgcctcctccaggactctctccaccttcccgcccagtgccatcactacagccaccaccgctgccactgccaccaccaccacccccattcagcccccagagcctcatggtgtcctgcatgtcgtccaataccttgtcgggtagcactctccgaggctctcccaatgccttactgtcaagcatgacgtccagcagcaatgctgccctggggcccgccatgccctatgctcctgagaagctccccagccctgctctcactcaacagccgcagttcggccctcagagctccattcttgccaacctcatgtcctctaccatcaaaacccctcaaggacacctgatgtctgctctgcctgccagcaaccctgggccgtccccaccctatcgcccagagaagctctctagcccaggcttgccacagcagtccttcaccccacagtgttccctgatccgaagcctcactcccaccagtaatcttctaagccagcaacagcagcagcagcagcagcagcagcaagcaaatgtgatctttaagcccataagcagcaactcatccaaaaccctgagcatgatcatgcagcaggggatggcaagctccagcccaggagccacggagccatttacttttggcaacaccaagcccttgtcccattttgtttctgagccgggtccccagaagatgccctccatgcctaccacctctaggcagccttccctgctccactacctgcagcagccgacaccaacgcaggcctcctcagccactgcctcctccacggccactgccaccttgcagctgcagcagcagcagcagcaacagcagcagcagcctgaccattcttcattccttctgcagcagatgatgcagcaaccccagcgttttcagcgatcagtggcctcagattccatgcctgctctgcccagacaggtctgttgccatctgtttgcatggacttctgcagctagctcggtgaagccccagcatcaacacgggaactctttcactagcaggcaagatcctcagcctggagacgtgtcaccgtctaacattactcatgtagacaaagcctgcaagcttggggaagccaggcacccccaggtcagcctcgggcgacagcccccgtcctgccaggccctggggagtgagtccttcctgcccggcagctcctttgctcatgagctggcccgagtcacctcctcgtacagcacctcagaggcagcgccctggggcagctgggatccgaaggcctggaggcaggtgcccgctccactactgcctagctgcgacgccacagcaagaggaacagagatcaggtcttatggcaatgacccctgaacggcagaatgcatatatctcccaacagatgagtccatttgaagccgtccaagaacaagtcacctccaagtgtagccggatcaaggcaagccccccatctagcaagcacttgatgccacccagaactgggcttcttcagaacaatctgagtccaggaatgatcccactcaccaggcaccagagctgcgagggcatgggagtgatctcaccaactctggggaagcggcaaggaattttcacctccagcccccagtgtcccatcctctcacactcaggccagactcccctgggcagacttgactctgtctgccagcatatgcagagccccaaggccaccccaccagaagtgcccctgcctgggttctgtcccagctccctgggcacccagtccttgagtccccaccagctcagacggcctagtgtgccaagaatgcccactgcgttcaacaatgctgcatgggtcacagcggcagcagctgtgaccacagcagtttcggggaaaacacccctcagccaagtggataatagcgttcagcagcactcaccttctggccaggcctgccttcagaggccatctgattgggaggcacaagtgcccgctgcgatgggaacacaagtgcccctggccaacaaccccagcttcagcctgctgggcagccagagcctcaggcagagcccggtacagggcccggtgcctgtagcaaacaccaccaagttcctccagcagggtatggccagctttagtcccctgagccccatacagggcatcgagccaccaagctatgtggctgctgctgccaccgctgctgctgcttctgccgttgctgccagccagttcccaggtccgttcgacagaacggatattccccctgagctgccacctgccgactttttgcgccagccccaacccccactaaatgatctgatttcgtcacctgactgcaatgaggtagatttcattgaagctctcttgaaaggctcctgtgtgagcccagatgaagactgggtgtgcaacttgaggctgatcgacgacattttggaacagcatgctgctgctcaaaatgccacagcccagaattctgggcaagtcacccaggatgctggggcactttaaatctgagcaggatgcccatagaaacccccatggtgacatcactctaggaagtggtgtcgatccatacccgcagttgtctcccgttacaatttgagtggtgttgtcagcccatgcttatccctctctctacctgtgacaaaatggaaagctggtgatttttcaagctacgtgtacatatttgaaaattttgtaaatggttttcctaaacattaatgacagaagtatttatacttcattttgtgactttgtaaataaagcgacggcttttgtttcagtagagttgtgtttactatgcattgttttgtgtttattatacaatgttacaaatatgcagaccgtgttgtttgctccagtgataccttgttaagctaggtggctgagtcgcttatggttttaatgcaatgagcaatgtggatatgaccaagagttgttgtgcaagttgacaaatgccaaatagaaaaccacttggccatttatttctatgttcactaaaaatcctattgccttgtgtgattcttaatctcttttgcgaacctttcagtctccgctagctctttcctaatgagctttacagcagaagctgttttatcgttaagtgccccacagagacactttaccaggaggctgggagagttctccagatttgggagaggcgcagagacagtgtgtgagccgagccctgtctcagcaatccacctggaggagctagagtatcctcctccctttaccattcagaccgagagaaaaagcccagcttgtgtgcaccctcgtggggttaaggcgagctgttcctggtttaaagcctttcagtatttgttttgatgtaaggctctgtggtttgggggggaacatctgtaaacattattagttgatttggggtttgtctttgatggtttctatctgcaattatcgtcatgtatatttaagtgtctgttatagaaaacccacacccactgtcctgtaaacttttctcagtgtccagactttctgtaatcacattttaattgccacctcgtatttcacctctacatttgaaatctggcgtctgtttcaagccagtgtgttttttcttcgttctgtaataaacagccaggagaaaa

SEQ ID NO: 408595 - DNA, 3962 bp, Homo sapiens
gtctccctaagccctgtgtctaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcgggaaagaagccctcgtggatggaggaagaagatttatcttttctctacaagagcagcccaggaagaaagcatcagggaactgttaagaggagacaagaagaagaccacttccagtttccagacatggctgatgggggctaccctaataaaattaagaggccttgccttgaagatgtcacccttgcaatgggcccaggtgctcatcctagtactgcttgtgcagaactgcaggtccctccattgacaataaatcctagccctgcggctatgggagtggctggccagtcattactgctggagaataaccctatgaatggcaacatcatgggctcaccatttgtagtaccacagactacagaagtgggactgaaagggcccactgttccttactatgagaaaatcaacagcgtgccggctgtagaccaggagcttcaagagctgctagaggagctcaccaaaattcaagacccttctccaaatgagctagatcttgagaagatactggggacgaagccagaagagccactggttttagatcatccccaggcaaccctaagcacaactcccaagccttcggttcagatgtcacacttggagagcctggcttccagcaaggagtttgcttctagttgcagccaagttactggcatgtcacttcagatcccatcctcctccacagggatcagctattcgattccttccaccagtaagcagatagtgtcaccgagttcttcaatggcacagtccaagagccaggtccaggccatgctccctgtcgctctgccccccttaccagtgcctcagtggcatcacgcccaccagctgaaggcgttggcagccagcaagcaggggtctgctacaaagcagcaagggcccacccccagttggtctggtctgcctcctccaggactctctccaccttcccgcccagtgccatcactacagccaccaccgctgccactgccaccaccaccacccccattcagcccccagagcctcatggtgtcctgcatgtcgtccaataccttgtcgggtagcactctccgaggctctcccaatgccttactgtcaagcatgacgtccagcagcaatgctgccctggggcccgccatgccctatgctcctgagaagctccccagccctgctctcactcaacagccgcagttcggccctcagagctccattcttgccaacctcatgtcctctaccatcaaaacccctcaaggacacctgatgtctgctctgcctgccagcaaccctgggccgtccccaccctatcgcccagagaagctctctagcccaggcttgccacagcagtccttcaccccacagtgttccctgatccgaagcctcactcccaccagtaatcttctaagccagcaacagcagcagcagcagcagcagcagcaagcaaatgtgatctttaagcccataagcagcaactcatccaaaaccctgagcatgatcatgcagcaggggatggcaagctccagcccaggagccacggagccatttacttttggcaacaccaagcccttgtcccattttgtttctgagccgggtccccagaagatgccctccatgcctaccacctctaggcagccttccctgctccactacctgcagcagccgacaccaacgcaggcctcctcagccactgcctcctccacggccactgccaccttgcagctgcagcagcagcagcagcaacagcagcagcagcctgaccattcttcattccttctgcagcagatgatgcagcaaccccagcgttttcagcgatcagtggcctcagattccatgcctgctctgcccagacaggtctgttgccatctgtttgcatggacttctgcagctagctcggtgaagccccagcatcaacacgggaactctttcactagcaggcaagatcctcagcctggagacgtgtcaccgtctaacattactcatgtagacaaagcctgcaagcttggggaagccaggcacccccaggtcagcctcgggcgacagcccccgtcctgccaggccctggggagtgagtccttcctgcccggcagctcctttgctcatgagctggcccgagtcacctcctcgtacagcacctcagaggcagcgccctggggcagctgggatccgaaggcctggaggcaggtgcccgctccactactgcctagctgcgacgccacagcaagaggaacagagatcaggtcttatggcaatgacccctgaacggcagaatgcatatatctcccaacagatgagtccatttgaagccgtccaagaacaagtcacctccaagtgtagccggatcaaggcaagccccccatctagcaagcacttgatgccacccagaactgggcttcttcagaacaatctgagtccaggaatgatcccactcaccaggcaccagagctgcgagggcatgggagtgatctcaccaactctggggaagcggcaaggaattttcacctccagcccccagtgtcccatcctctcacactcaggccagactcccctgggcagacttgactctgtctgccagcatatgcagagccccaaggccaccccaccagaagtgcccctgcctgggttctgtcccagctccctgggcacccagtccttgagtccccaccagctcagacggcctagtgtgccaagaatgcccactgcgttcaacaatgctgcatgggtcacagcggcagcagctgtgaccacagcagtttcggggaaaacacccctcagccaagtggataatagcgttcagcagcactcaccttctggccaggcctgccttcagaggccatctgattgggaggcacaagtgcccgctgcgatgggaacacaagtgcccctggccaacaaccccagcttcagcctgctgggcagccagagcctcaggcagagcccggtacagggcccggtgcctgtagcaaacaccaccaagttcctccagcagggtatggccagctttagtcccctgagccccatacagggcatcgagccaccaagctatgtggctgctgctgccaccgctgctgctgcttctgccgttgctgccagccagttcccaggtccgttcgacagaacggatattccccctgagctgccacctgccgactttttgcgccagccccaacccccactaaatgatctgatttcgtcacctgactgcaatgaggtagatttcattgaagctctcttgaaaggctcctgtgtgagcccagatgaagactgggtgtgcaacttgaggctgatcgacgacattttggaacagcatgctgctgctcaaaatgccacagcccagaattctgggcaagtcacccaggatgctggggcactttaaatctgagcaggatgcccatagaaacccccatggtgacatcactctaggaagtggtgtcgatccatacccgcagttgtctcccgttacaatttgagtggtgttgtcagcccatgcttatccctctctctacctgtgacaaaatggaaagctggtgatttttcaagctacgtgtacatatttgaaaattttgtaaatggttttcctaaacattaatgacagaagtatttatacttcattttgtgactttgtaaataaagcgacggcttttgtttcagtagagttgtgtttactatgcattgttttgtgtttattatacaatgttacaaatatgcagaccgtgttgtttgctccagtgataccttgttaagctaggcagtgatgcctgtcccacccccatcgagaaaaccatctccaaagccaaagggcagtgaagccgtcgtaagtagtga

SEQ ID NO: 408596 - DNA, 3499 bp, Homo sapiens
gtctccctaagccctgtgtctaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcgggaaagaagccctcgtggatggaggaagaagatttatcttttctctacaagagcagcccaggaagaaagcatcagggaactgttaagaggagacaagaagaagaccacttccagtttccagacatggctgatgggggctaccctaataaaattaagaggccttgccttgaagatgtcacccttgcaatgggcccaggtgctcatcctagtactgcttgtgcagaactgcaggtccctccattgacaataaatcctagccctgcggctatgggagtggctggccagtcattactgctggagaataaccctatgaatggcaacatcatgggctcaccatttgtagtaccacagactacagaagtgggactgaaagggcccactgttccttactatgagaaaatcaacagcgtgccggctgtagaccaggagcttcaagagctgctagaggagctcaccaaaattcaagacccttctccaaatgagctagatcttgagaagatactggggacgaagccagaagagccactggttttagatcatccccaggcaaccctaagcacaactcccaagccttcggttcagatgtcacacttggagagcctggcttccagcaaggagtttgcttctagttgcagccaagttactggcatgtcacttcagatcccatcctcctccacagggatcagctattcgattccttccaccagtaagcagatagtgtcaccgagttcttcaatggcacagtccaagagccaggtccaggccatgctccctgtcgctctgccccccttaccagtgcctcagtggcatcacgcccaccagctgaaggcgttggcagccagcaagcaggggtctgctacaaagcagcaagggcccacccccagttggtctggtctgcctcctccaggactctctccaccttcccgcccagtgccatcactacagccaccaccgctgccactgccaccaccaccacccccattcagcccccagagcctcatggtgtcctgcatgtcgtccaataccttgtcgggtagcactctccgaggctctcccaatgccttactgtcaagcatgacgtccagcagcaatgctgccctggggcccgccatgccctatgctcctgagaagctccccagccctgctctcactcaacagccgcagttcggccctcagagctccattcttgccaacctcatgtcctctaccatcaaaacccctcaaggacacctgatgtctgctctgcctgccagcaaccctgggccgtccccaccctatcgcccagagaagctctctagcccaggcttgccacagcagtccttcaccccacagtgttccctgatccgaagcctcactcccaccagtaatcttctaagccagcaacagcagcagcagcagcagcagcagcaagcaaatgtgatctttaagcccataagcagcaactcatccaaaaccctgagcatgatcatgcagcaggggatggcaagctccagcccaggagccacggagccatttacttttggcaacaccaagcccttgtcccattttgtttctgagccgggtccccagaagatgccctccatgcctaccacctctaggcagccttccctgctccactacctgcagcagccgacaccaacgcaggcctcctcagccactgcctcctccacggccactgccaccttgcagctgcagcagcagcagcagcaacagcagcagcagcctgaccattcttcattccttctgcagcagatgatgcagcaaccccagcgttttcagcgatcagtggcctcagattccatgcctgctctgcccagacaggtctgttgccatctgtttgcatggacttctgcagctagctcggtgaagccccagcatcaacacgggaactctttcactagcaggcaagatcctcagcctggagacgtgtcaccgtctaacattactcatgtagacaaagcctgcaagcttggggaagccaggcacccccaggtcagcctcgggcgacagcccccgtcctgccaggccctggggagtgagtccttcctgcccggcagctcctttgctcatgagctggcccgagtcacctcctcgtacagcacctcagaggcagcgccctggggcagctgggatccgaaggcctggaggcaggtgcccgctccactactgcctagctgcgacgccacagcaagaggaacagagatcaggtcttatggcaatgacccctgaacggcagaatgcatatatctcccaacagatgagtccatttgaagccgtccaagaacaagtcacctccaagtgtagccggatcaaggcaagccccccatctagcaagcacttgatgccacccagaactgggcttcttcagaacaatctgagtccaggaatgatcccactcaccaggcaccagagctgcgagggcatgggagtgatctcaccaactctggggaagcggcaaggaattttcacctccagcccccagtgtcccatcctctcacactcaggccagactcccctgggcagacttgactctgtctgccagcatatgcagagccccaaggccaccccaccagaagtgcccctgcctgggttctgtcccagctccctgggcacccagtccttgagtccccaccagctcagacggcctagtgtgccaagaatgcccactgcgttcaacaatgctgcatgggtcacagcggcagcagctgtgaccacagcagtttcggggaaaacacccctcagccaagtggataatagcgttcagcagcactcaccttctggccaggcctgccttcagaggccatctgattgggaggcacaagtgcccgctgcgatgggaacacaagtgcccctggccaacaaccccagcttcagcctgctgggcagccagagcctcaggcagagcccggtacagggcccggtgcctgtagcaaacaccaccaagttcctccagcagggtatggccagctttagtcccctgagccccatacagggcatcgagccaccaagctatgtggctgctgctgccaccgctgctgctgcttctgccgttgctgccagccagttcccaggtccgttcgacagaacggatattccccctgagctgccacctgccgactttttgcgccagccccaacccccactaaatgatctgatttcgtcaccacacccaccaccgctgccactgccaccaccaccacccccattcagcccccagagcctcatggtgtcctgcatgtcgtccaataccttgtcgggtagcactctccgaggctctcccaatgccttactgtcaagcatgacgtccacagcaatgctccctggggccc

SEQ ID NO: 408597 - DNA, 8179 bp, Homo sapiens
ctaaaaataccattaagtaatagtattagcttttgtattctgagattcaacagcagcagtcacttccctccactcctatgtgtatcccaggaccaccctgggcggggagggctgaggtcagggaggtctgaagctggtcctgggctccgggggtgacagtgatgaggaactgggtgcacacatgagtggggcagccgggcctggccagagaagcaacacacacgtgcacagacatgtttatccacatacacatgtgcacgcatgtgcacaaacacattgcaggcaggcatgttgacgcctcaggcagcggaggaccctgactctgggccctgctgacccgggcaaggcccattgtgatgcgtgccatgacctcagaatgtcactggtgcttagcacctatccgctctccagactgcgtctgtgttctacggcagttacacacacgcagtggtattcacaagcggttttgtggactcaaaggttttctccctgagaggcataacccaggccagctgattcatcagaatcaggtgagtgtgacctgctctcttccctccaggctgacttggggacagtggctatggtatgggcggtgttggcctctgggcagctacagaggagggtcatccctgagcactcaccgggcgcccgttctacactgcccatgtagacgattttctctttcgtcttcatggtggcttcgtagagtgggtgctgttcccaaatgtacccattcgacaggtgagccgtctggggtcagagaggcagtaactggcctgggaatccagacaagaccctgggttttgctctcagccctgctgtgtgccatgctagacttcaggcctcaaccctgagacctccctgctctagatcccaaatctgcccagatttccgatccaatgggcagagcctggccctggcagagacactgggatggatccactgtgggtggggaggagggaagggtcctcagaacacacctggggcctaagctgggtcttgatggtcactgtgggacccactggacacacacagtcccttgtctgggagtggcatggggagccttctgcccttgggcagttgtggaaagtgaaggagccctggagagctggctgaggggagactatcttcccttgtgttcaaaggggtccaggcactggggctctccccaagtatttcttattctgtctggcctcgctttccttttgccctgagtattctcaggagggacggtccatctagatgtcctccaggagcaaggacccactgttcttcatcagtgacccaggaaaatgaagccccctcctgtggggacagctcagaatggtggagtccacagtccctccctgagagacatggtttccatgagcacagtggctgctttggagacagtaatcattttcatccccaaaaccaaacacactcctgctcaaatggtgttattgctaaagcagcttcactggttagactgaagggccatggtagcccaagtgatgagcggggtagaatggagcagtcaggagagatcttgttccccgtaggaaactgggcatctctgtggccctgaacatcccaggaggccgatcgtacagagacctctggtgcctgaccgcagttcacatccacatccctggaatagaccatcacaggctcttcacccttggcaggtggacaccattcaacctgccggggcaggatggacatggtagagaatgcagatagtttgcaggcacaggagcggaaggacatacttatgaagtatgacaagggacaccgagctgggctgccagaggacaaggggcctgagcccgttggaatcaacagcagcattgatcgttttggcattttgcatgagacggagctgcctcctgtgactgcacgggaggcgaagaaaattcggcgggagatgacacgaacgagcaagtggatggaaatgctgggagaatgggagacatataagcacagtagcaaactcatagatcgagtgtacaagggaattcccatgaacatccggggcccggtgtggtcagtcctcctgaacattcaggaaatcaagttgaaaaaccccggaagataccagatcatgaaggagaggggcaagaggtcatctgaacacatccaccacatcgacctggacgtgaggacgactctccggaaccatgtcttctttagggatcgatatggagccaagcagagggaactattctacatcctcctggcctattcggagtataacccggaggtgggctactgcagggacctgagccacatcaccgccttgttcctcctttatctgcctgaggaggacgcattctgggcactggtgcagctgctggccagtgagaggcactccctgccaggattccacagcccaaatggtgggacagtccaggggctccaagaccaacaggagcatgtggtacccaagtcacaacccaagaccatgtggcatcaggacaaggaaggtctatgcgggcagtgtgcctcgttaggctgccttctccggaacctgattgacgggatctctctcgggctcaccctgcgcctgtgggacgtgtatttggtggaaggagaacaggtgttgatgccaataaccagcattgctcttaaggttcagcagaagcgcctcatgaagacatccaggtgtggcctgtgggcacgtctgcggaaccaattcttcgatacctgggccatgaacgatgacaccgtgctcaagcatcttagggcctctacgaagaaactaacaaggaagcaaggggacctgccacccccaggcccaacagccctgggacgaaggtgtgtggcaggaagcccccagccagtctgaaccctgggggcagtcccaggagccacccaccatgccccaacggcttccccatgccaggcagcacacacccctccctctgggatcagcagactacaggcgtgtcgtcagtgtcagaccacaggggccacacagagaccccaaggactccagagatgcagccaaacgcgagcaagggtccttggcacccaggcctgtgccggcttcacgtggtgggaagaccctctgcaaggggtataggcaggcccctccaggcccaccagcccagttccagcggcccatttgctcagcttccccgccatgggcatctcgtttttccacgccctgtcctggtggggctgtccgggaagacacgtaccctgtgggcactcagggtgtgcccagcctggccctggctcagggaggacctcagggttcctggagattcctggagtggaagtcaatgccccggctcccaacggacctggatatagggggcccttggttcccccattatgattttgaacggagctgctgggtccgtgccatatcccaggaggaccagctggccacctgctggcaggctgaacactgcggagaggttcacaacaaagatatgagttggcctgaggagatgtcttttacagcaaatagtagtaaaatagatagacaaaaggttcccacagaaaagggagccacaggtctaagcaacctgggaaacacatgcttcatgaactcaagcatccagtgcgttagtaacacacagccactgacacagtattttatctcagggagacatctttatgaactcaacaggacaaatcccattggtatgaaggggcatatggctaaatgctatggtgatttagtgcaggaactctggagtggaactcagaagagtgttgccccattaaagcttcggcggaccatagcaaaatatgctcccaagtttgatgggtttcagcaacaagactcccaagaacttctggcttttctcttggatggtcttcatgaagatctcaaccgagtccatgaaaagccatatgtggaactgaaggacagtgatggccgaccagactgggaagtagctgcagaggcctgggacaaccatctaagaagaaatagatcaattattgtggatttgttccatgggcagctaagatctcaagtcaaatgcaagacatgtgggcatataagtgtccgatttgaccctttcaattttttgtctttgccactaccaatggacagttacatggacttagaaataacagtgattaagttagatggtactacccctgtacggtatggactaagactgaatatggatgaaaagtacacaggtttaaaaaaacagctgagggatctctgtggacttaattcagaacaaatcctactagcagaagtacatgattccaacataaagaactttcctcaggataaccaaaaagtacaactctcagtgagcggatttttgtgtgcatttgaaattcctgtcccttcatctccaatttcagcttctagtccaacacaaatagatttctcctcttcaccatctacaaatggaatgttcaccctaactaccaatggggacctacccaaaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcacctcaggagaatcgccccagcctctttggaatgccattgattgttccatgcactgtgcatacccagaagaaagacctatatgatgcggtttggattcaagtatcctggttagcaagaccactcccacctcaggaagctagtattcatgcccaggatcgtgataactgtatgggctatcaatatccattcactctacgagttgtgcagaaagatgggatctcctgtgcttggtgcccacagtatagattttgcagaggctgtaaaattgattgtggggaagacagagctttcattggaaatgcctatattgctgtggattggcaccccacagcccttcaccttcgctatcaaacatcccaggaaagggttgtagataagcatgagagtgtggagcagagtcggcgagcgcaagccgagcccatcaacctggacagctgtctccgtgctttcaccagtgaggaagagctaggggaaagtgagatgtactactgttccaagtgtaagacccactgcttagcaacaaagaagctggatctctggaggcttccacccttcctgattattcaccttaagcgatttcaatttgtaaatgatcagtggataaaatcacagaaaattgtcagatttcttcgggaaagttttgatccgagtgcttttttggtaccacgagacccggccctctgccagcataaaccactcacaccccagggggatgagctctccaagcccaggattctggcaagagaggtgaagaaagtggatgcgcagagttcggctggaaaagaggacatgctcctaagcaaaagcccatcttcactcagcgctaacatcagcagcagcccaaaaggttctccttcttcatcaagaaaaagtggaaccagctgtccctccagcaaaaacagcagccctaatagcagcccacggactttggggaggagcaaagggaggctccggctgccccagattggcagcaaaaataagccgtcaagtagtaagaagaacttggatgccagcaaagagaatggggctgggcagatctgtgagctggctgacgccttgagccgagggcatatgcgggggggcagccaaccagagctggtcactcctcaggaccatgaggtagctttggccaatggattcctttatgagcatgaagcatgtggcaatggctgtggcgatggctacagcaatggtcagcttggaaaccacagtgaagaagacagcactgatgaccaaagagaagacactcatattaagcctatttataatctatatgcaatttcatgccattcaggaattctgagtgggggccattacatcacttatgccaaaaacccaaactgcaagtggtactgttataatgacagcagctgtgaggaacttcaccctgatgaaattgacaccgactctgcctacattcttttctatgagcagcaggggatagactacgcacaatttctgccaaagattgatggcaaaaagatggcagacacaagcagtacggatgaagactctgagtctgattacgaaaagtactctatgttacagtaaagctaccactctggctgctagacagcttggtggcgagggagatgactccttgtagctgatacttggcaaaagtgtcactgaaagacaagctaaatgtagttattttatcctgttagaacaaaaattctaattaaaatagttaacttgaagagtagaaacaattgtattttgaagtctcatacaagctgtctgatagagaactttcaggcagatcccaccattagcctgtaaacaaaaggtgtggcaccagccacctgggaccaaataagaattgaattgtgcttgtccagatatgaacaaatatgtagtgagtatagagtttaccaataatcataacaaatattaaagatttccttggagtcagaggaaaaaacaaacaattataatgttgtctagggacgacatgatacgctacctcctttttcctgaagttttattccattatattgacaagatggagaaagcaagatcatgaaggtgtgcaaatgattcttacggcatggacaaggatttttcaatttattttttaaactgtttccataccctttctttttcttgctttttgtttttgccattgtgtttacgtttgagacacaaccagtcattggtggcaggggcatagagtggtcagtctgaaagggaggctctcttaagagctatgtgccttccaaccagagggagacccagtagaaagaaaaacatcctgggaaatccagctaccagggccctcccagtggaggcatcttacatttaggctacttcaagtatcctcagaaatgtattctgcacccccggccccgcccatgctgagggaaggggagcagttgccaatatttgcaccatcttcacatgcacatgttgcaacaagagcttctgggaaggtaagcggcatcggagctagatcacgtttcacaattagtggttattcttttctgtgtttgttttgcactttaaaaaagagagaacacatgcaaatgaacttgcttgtgtgtatttgatggctctaagggctataaattacaaacaaaacacatcccagacattaggagttcataagtatatttaatgaaattggtggttttaggaagtcaactttagttttgctttgtttgcatgtccactggtttttttattttgatatttgtctttttttaaattttacagtagtcattgaaagttatgtttctttgcttacttcattttttccctctaattatttaagattggaacaaaagtataaatattatttatttgaggtagaatttttttcatgtagtttcttaatatatacttgaaggaaatgtttcaccttatttttggtctttgtttattcatttagaccctgcaagttgattctcattgccagattccattaccctttcttcctcataggtagtaattaccaatgtaactaagcatttgtgttctgatatctgaggccagtaactattaatatctagttctcagagcatttggaaaggttatcttaaatggctacctaaattgaaatccttttcagaaaaaatataattgcaagtaggtaggagtggcctaaattgtctaatgtaataaagtcagacaaaatgcacactttatagtttcaagattttcagtaaataaaatctgtccattcctacctggacatgtcccattaaaaagtggaagattttaaataatttctttacagatgttttatttaaacaggtagcacaatctactaatgttgtgtgatttgtgttatactggttgtaattaatttttttaattcatgaactagcggaaaatttattaaattaactattaactacattcaccttgtaaattactgtataaaacttgttgacaatgcactgactttagaaagatgttaatgtacataaatagagtgtaaataaaatagtgttgatgtactgaaatatgaactgtatcaaaagtattggtaattgtatatggggtgtacctgtttatctgttaactattatccaaacaaattaaatactgtggttgcctctatgtgctgtttttcctcatacaagtaaacacagaaagtc

SEQ ID NO: 408598 - DNA, 387 bp, Homo sapiens
tcgtcctcaggatacttgagaaaagagcaaagatgaaaataccacaagcttatgatgctgtacttatctttgaatttgtagatttctcctcttcaccatctacaaatggaatgttcaccctaactaccaatggggacctacccaaaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatggttagttaaatgttaggcaactcactgccagtcttgctagtgtcatttgtgaaatagccattttctgtctttgcaacatcattgaatgcatttt

SEQ ID NO: 408599 - DNA, 7856 bp, Homo sapiens
ctaaaaataccattaagtaatagtattagcttttgtattctgagattcaacagcagcagtcacttccctccactcctatgtgtatcccaggaccaccctgggcggggagggctgaggtcagggaggtctgaagctggtcctgggctccgggggtgacagtgatgaggaactgggtgcacacatgagtggggcagccgggcctggccagagaagcaacacacacgtgcacagacatgtttatccacatacacatgtgcacgcatgtgcacaaacacattgcaggcaggcatgttgacgcctcaggcagcggaggaccctgactctgggccctgctgacccgggcaaggcccattgtgatgcgtgccatgacctcagaatgtcactggtgcttagcacctatccgctctccagactgcgtctgtgttctacggcagttacacacacgcagtggtattcacaagcggttttgtggactcaaaggttttctccctgagaggcataacccaggccagctgattcatcagaatcaggtgagtgtgacctgctctcttccctccaggctgacttggggacagtggctatggtatgggcggtgttggcctctgggcagctacagaggagggtcatccctgagcactcaccgggcgcccgttctacactgcccatgtagacgattttctctttcgtcttcatggtggcttcgtagagtgggtgctgttcccaaatgtacccattcgacaggtgagccgtctggggtcagagaggcagtaactggcctgggaatccagacaagaccctgggttttgctctcagccctgctgtgtgccatgctagacttcaggcctcaaccctgagacctccctgctctagatcccaaatctgcccagatttccgatccaatgggcagagcctggccctggcagagacactgggatggatccactgtgggtggggaggagggaagggtcctcagaacacacctggggcctaagctgggtcttgatggtcactgtgggacccactggacacacacagtcccttgtctgggagtggcatggggagccttctgcccttgggcagttgtggaaagtgaaggagccctggagagctggctgaggggagactatcttcccttgtgttcaaaggggtccaggcactggggctctccccaagtatttcttattctgtctggcctcgctttccttttgccctgagtattctcaggagggacggtccatctagatgtcctccaggagcaaggacccactgttcttcatcagtgacccaggaaaatgaagccccctcctgtggggacagctcagaatggtggagtccacagtccctccctgagagacatggtttccatgagcacagtggctgctttggagacagtaatcattttcatccccaaaaccaaacacactcctgctcaaatggtgttattgctaaagcagcttcactggttagactgaagggccatggtagcccaagtgatgagcggggtagaatggagcagtcaggagagatcttgttccccgtaggaaactgggcatctctgtggccctgaacatcccaggaggccgatcgtacagagacctctggtgcctgaccgcagttcacatccacatccctggaatagaccatcacaggctcttcacccttggcaggtggacaccattcaacctgccggggcaggatggacatggtagagaatgcagatagtttgcaggcacaggagcggaaggacatacttatgaagtatgacaagggacaccgagctgggctgccagaggacaaggggcctgagcccgttggaatcaacagcagcattgatcgttttggcattttgcatgagacggagctgcctcctgtgactgcacgggaggcgaagaaaattcggcgggagatgacacgaacgagcaagtggatggaaatgctgggagaatgggagacatataagcacagtagcaaactcatagatcgagtgtacaagggaattcccatgaacatccggggcccggtgtggtcagtcctcctgaacattcaggaaatcaagttgaaaaaccccggaagataccagatcatgaaggagaggggcaagaggtcatctgaacacatccaccacatcgacctggacgtgaggacgactctccggaaccatgtcttctttagggatcgatatggagccaagcagagggaactattctacatcctcctggcctattcggagtataacccggaggtgggctactgcagggacctgagccacatcaccgccttgttcctcctttatctgcctgaggaggacgcattctgggcactggtgcagctgctggccagtgagaggcactccctgccaggattccacagcccaaatggtgggacagtccaggggctccaagaccaacaggagcatgtggtacccaagtcacaacccaagaccatgtggcatcaggacaaggaaggtctatgcgggcagtgtgcctcgttaggctgccttctccggaacctgattgacgggatctctctcgggctcaccctgcgcctgtgggacgtgtatttggtggaaggagaacaggtgttgatgccaataaccagcattgctcttaaggttcagcagaagcgcctcatgaagacatccaggtgtggcctgtgggcacgtctgcggaaccaattcttcgatacctgggccatgaacgatgacaccgtgctcaagcatcttagggcctctacgaagaaactaacaaggaagcaaggggacctgccacccccagccaaacgcgagcaagggtccttggcacccaggcctgtgccggcttcacgtggtgggaagaccctctgcaaggggtataggcaggcccctccaggcccaccagcccagttccagcggcccatttgctcagcttccccgccatgggcatctcgtttttccacgccctgtcctggtggggctgtccgggaagacacgtaccctgtgggcactcagggtgtgcccagcctggccctggctcagggaggacctcagggttcctggagattcctggagtggaagtcaatgccccggctcccaacggacctggatatagggggcccttggttcccccattatgattttgaacggagctgctgggtccgtgccatatcccaggaggaccagctggccacctgctggcaggctgaacactgcggagaggttcacaacaaagatatgagttggcctgaggagatgtcttttacagcaaatagtagtaaaatagatagacaaaaggttcccacagaaaagggagccacaggtctaagcaacctgggaaacacatgcttcatgaactcaagcatccagtgcgttagtaacacacagccactgacacagtattttatctcagggagacatctttatgaactcaacaggacaaatcccattggtatgaaggggcatatggctaaatgctatggtgatttagtgcaggaactctggagtggaactcagaagagtgttgccccattaaagcttcggcggaccatagcaaaatatgctcccaagtttgatgggtttcagcaacaagactcccaagaacttctggcttttctcttggatggtcttcatgaagatctcaaccgagtccatgaaaagccatatgtggaactgaaggacagtgatggccgaccagactgggaagtagctgcagaggcctgggacaaccatctaagaagaaatagatcaattattgtggatttgttccatgggcagctaagatctcaagtcaaatgcaagacatgtgggcatataagtgtccgatttgaccctttcaattttttgtctttgccactaccaatggacagttacatggacttagaaataacagtgattaagttagatggtactacccctgtacggtatggactaagactgaatatggatgaaaagtacacaggtttaaaaaaacagctgagggatctctgtggacttaattcagaacaaatcctactagcagaagtacatgattccaacataaagatttctcctcttcaccatctacaaatggaatgttcaccctaactaccaatggggacctacccaaaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcacctcaggagaatcgccccagcctctttggaatgccattgattgttccatgcactgtgcatacccagaagaaagacctatatgatgcggtttggattcaagtatcctggttagcaagaccactcccacctcaggaagctagtattcatgcccaggatcgtgataactgtatgggctatcaatatccattcactctacgagttgtgcagaaagatgggatctcctgtgcttggtgcccacagtatagattttgcagaggctgtaaaattgattgtggggaagacagagctttcattggaaatgcctatattgctgtggattggcaccccacagcccttcaccttcgctatcaaacatcccaggaaagggttgtagataagcatgagagtgtggagcagagtcggcgagcgcaagccgagcccatcaacctggacagctgtctccgtgctttcaccagtgaggaagagctaggggaaagtgagatgtactactgttccaagtgtaagacccactgcttagcaacaaagaagctggatctctggaggcttccacccttcctgattattcaccttaagcgatttcaatttgtaaatgatcagtggataaaatcacagaaaattgtcagatttcttcgggaaagttttgatccgagtgcttttttggtaccacgagacccggccctctgccagcataaaccactcacaccccagggggatgagctctccaagcccaggattctggcaagagaggtgaagaaagtggatgcgcagagttcggctggaaaagaggacatgctcctaagcaaaagcccatcttcactcagcgctaacatcagcagcagcccaaaaggttctccttcttcatcaagaaaaagtggaaccagctgtccctccagcaaaaacagcagccctaatagcagcccacggactttggggaggagcaaagggaggctccggctgccccagattggcagcaaaaataagccgtcaagtagtaagaagaacttggatgccagcaaagagaatggggctgggcagatctgtgagctggctgacgccttgagccgagggcatatgcgggggggcagccaaccagagctggtcactcctcaggaccatgaggtagctttggccaatggattcctttatgagcatgaagcatgtggcaatggctgtggcgatggctacagcaatggtcagcttggaaaccacagtgaagaagacagcactgatgaccaaagagaagacactcatattaagcctatttataatctatatgcaatttcatgccattcaggaattctgagtgggggccattacatcacttatgccaaaaacccaaactgcaagtggtactgttataatgacagcagctgtgaggaacttcaccctgatgaaattgacaccgactctgcctacattcttttctatgagcagcaggggatagactacgcacaatttctgccaaagattgatggcaaaaagatggcagacacaagcagtacggatgaagactctgagtctgattacgaaaagtactctatgttacagtaaagctaccactctggctgctagacagcttggtggcgagggagatgactccttgtagctgatacttggcaaaagtgtcactgaaagacaagctaaatgtagttattttatcctgttagaacaaaaattctaattaaaatagttaacttgaagagtagaaacaattgtattttgaagtctcatacaagctgtctgatagagaactttcaggcagatcccaccattagcctgtaaacaaaaggtgtggcaccagccacctgggaccaaataagaattgaattgtgcttgtccagatatgaacaaatatgtagtgagtatagagtttaccaataatcataacaaatattaaagatttccttggagtcagaggaaaaaacaaacaattataatgttgtctagggacgacatgatacgctacctcctttttcctgaagttttattccattatattgacaagatggagaaagcaagatcatgaaggtgtgcaaatgattcttacggcatggacaaggatttttcaatttattttttaaactgtttccataccctttctttttcttgctttttgtttttgccattgtgtttacgtttgagacacaaccagtcattggtggcaggggcatagagtggtcagtctgaaagggaggctctcttaagagctatgtgccttccaaccagagggagacccagtagaaagaaaaacatcctgggaaatccagctaccagggccctcccagtggaggcatcttacatttaggctacttcaagtatcctcagaaatgtattctgcacccccggccccgcccatgctgagggaaggggagcagttgccaatatttgcaccatcttcacatgcacatgttgcaacaagagcttctgggaaggtaagcggcatcggagctagatcacgtttcacaattagtggttattcttttctgtgtttgttttgcactttaaaaaagagagaacacatgcaaatgaacttgcttgtgtgtatttgatggctctaagggctataaattacaaacaaaacacatcccagacattaggagttcataagtatatttaatgaaattggtggttttaggaagtcaactttagttttgctttgtttgcatgtccactggtttttttattttgatatttgtctttttttaaattttacagtagtcattgaaagttatgtttctttgcttacttcattttttccctctaattatttaagattggaacaaaagtataaatattatttatttgaggtagaatttttttcatgtagtttcttaatatatacttgaaggaaatgtttcaccttatttttggtctttgtttattcatttagaccctgcaagttgattctcattgccagattccattaccctttcttcctcataggtagtaattaccaatgtaactaagcatttgtgttctgatatctgaggccagtaactattaatatctagttctcagagcatttggaaaggttatcttaaatggctacctaaattgaaatccttttcagaaaaaatataattgcaagtaggtaggagtggcctaaattgtctaatgtaataaagtcagacaaaatgcacactttatagtttcaagattttcagtaaataaaatctgtccattcctacctggacatgtcccattaaaaagtggaagattttaaataatttctttacagatgttttatttaaacaggtagcacaatctactaatgttgtgtgatttgtgttatactggttgtaattaatttttttaattcatgaactagcggaaaatttattaaattaactattaactacattcaccttgtaaattactgtataaaacttgttgacaatgcactgactttagaaagatgttaatgtacataaatagagtgtaaataaaatagtgttgatgtactgaaatatgaactgtatcaaaagtattggtaattgtatatggggtgtacctgtttatctgttaactattatccaaacaaattaaatactgtggttgcctctatgtgctgtttttcctcatacaagtaaacacagaaagtc

SEQ ID NO: 408600 - DNA, 7028 bp, Homo sapiens
ctaaaaataccattaagtaatagtattagcttttgtattctgagattcaacagcagcagtcacttccctccactcctatgtgtatcccaggaccaccctgggcggggagggctgaggtcagggaggtctgaagctggtcctgggctccgggggtgacagtgatgaggaactgggtgcacacatgagtggggcagccgggcctggccagagaagcaacacacacgtgcacagacatgtttatccacatacacatgtgcacgcatgtgcacaaacacattgcaggcaggcatgttgacgcctcaggcagcggaggaccctgactctgggccctgctgacccgggcaaggcccattgtgatgcgtgccatgacctcagaatgtcactggtgcttagcacctatccgctctccagactgcgtctgtgttctacggcagttacacacacgcagtggtattcacaagcggttttgtggactcaaaggttttctccctgagaggcataacccaggccagctgattcatcagaatcaggaaactgggcatctctgtggccctgaacatcccaggaggccgatcgtacagagacctctggtgcctgaccgcagttcacatccacatccctggaatagaccatcacaggctcttcacccttggcaggtggacaccattcaacctgccggggcaggatggacatggtagagaatgcagatagtttgcaggcacaggagcggaaggacatacttatgaagtatgacaagggacaccgagctgggctgccagaggacaaggggcctgagcccgttggaatcaacagcagcattgatcgttttggcattttgcagtcctgcccctcctgggagtcagagccacaggaaggcccttgtcctcccttccctgtgccttctcccgggctgagccctgagctggatagggacagagccagtcctttctgggggtcggctcccaggcttgggcggctccaggccctgtgcacgtcctcagctctgcctgggttgccttacagtgagacggagctgcctcctgtgactgcacgggaggcgaagaaaattcggcgggagatgacacgaacgagcaagtggatggaaatgctgggagaatgggagacatataagcacagtagcaaactcatagatcgagtgtacaagggaattcccatgaacatccggggcccggtgtggtcagtcctcctgaacattcaggaaatcaagttgaaaaaccccggaagataccagatcatgaaggagaggggcaagaggtcatctgaacacatccaccacatcgacctggacgtgaggacgactctccggaaccatgtcttctttagggatcgatatggagccaagcagagggaactattctacatcctcctggcctattcggagtataacccggaggtgggctactgcagggacctgagccacatcaccgccttgttcctcctttatctgcctgaggaggacgcattctgggcactggtgcagctgctggccagtgagaggcactccctgccaggattccacagcccaaatggtgggacagtccaggggctccaagaccaacaggagcatgtggtacccaagtcacaacccaagaccatgtggcatcaggacaaggaaggtctatgcgggcagtgtgcctcgttaggctgccttctccggaacctgattgacgggatctctctcgggctcaccctgcgcctgtgggacgtgtatttggtggaaggagaacaggtgttgatgccaataaccagcattgctcttaaggttcagcagaagcgcctcatgaagacatccaggtgtggcctgtgggcacgtctgcggaaccaattcttcgatacctgggccatgaacgatgacaccgtgctcaagcatcttagggcctctacgaagaaactaacaaggaagcaaggggacctgccacccccagccaaacgcgagcaagggtccttggcacccaggcctgtgccggcttcacgtggtgggaagaccctctgcaaggggtataggcaggcccctccaggcccaccagcccagttccagcggcccatttgctcagcttccccgccatgggcatctcgtttttccacgccctgtcctggtggggctgtccgggaagacacgtaccctgtgggcactcagggtgtgcccagcctggccctggctcagggaggacctcagggttcctggagattcctggagtggaagtcaatgccccggctcccaacggacctggatatagggggcccttggttcccccattatgattttgaacggagctgctgggtccgtgccatatcccaggaggaccagctggccacctgctggcaggctgaacactgcggagaggttcacaacaaagatatgagttggcctgaggagatgtcttttacagcaaatagtagtaaaatagatagacaaaaggttcccacagaaaagggagccacaggtctaagcaacctgggaaacacatgcttcatgaactcaagcatccagtgcgttagtaacacacagccactgacacagtattttatctcagggagacatctttatgaactcaacaggacaaatcccattggtatgaaggggcatatggctaaatgctatggtgatttagtgcaggaactctggagtggaactcagaagagtgttgccccattaaagcttcggcggaccatagcaaaatatgctcccaagtttgatgggtttcagcaacaagactcccaagaacttctggcttttctcttggatggtcttcatgaagatctcaaccgagtccatgaaaagccatatgtggaactgaaggacagtgatggccgaccagactgggaagtagctgcagaggcctgggacaaccatctaagaagaaatagatcaattattgtggatttgttccatgggcagctaagatctcaagtcaaatgcaagacatgtgggcatataagtgtccgatttgaccctttcaattttttgtctttgccactaccaatggacagttacatggacttagaaataacagtgattaagttagatggtactacccctgtacggtatggactaagactgaatatggatgaaaagtacacaggtttaaaaaaacagctgagggatctctgtggacttaattcagaacaaatcctactagcagaagtacatgattccaacataaagatttctcctcttcaccatctacaaatggaatgttcaccctaactaccaatggggacctacccaaaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcacctcaggagaatcgccccagcctctttggaatgccattgattgttccatgcactgtgcatacccagaagaaagacctatatgatgcggtttggattcaagtatcctggttagcaagaccactcccacctcaggaagctagtattcatgcccaggatcgtgataactgtatgggctatcaatatccattcactctacgagttgtgcagaaagatgggatctcctgtgcttggtgcccacagtatagattttgcagaggctgtaaaattgattgtggggaagacagagctttcattggaaatgcctatattgctgtggattggcaccccacagcccttcaccttcgctatcaaacatcccaggaaagggttgtagataagcatgagagtgtggagcagagtcggcgagcgcaagccgagcccatcaacctggacagctgtctccgtgctttcaccagtgaggaagagctaggggaaagtgagatgtactactgttccaagtgtaagacccactgcttagcaacaaagaagctggatctctggaggcttccacccttcctgattattcaccttaagcgatttcaatttgtaaatgatcagtggataaaatcacagaaaattgtcagatttcttcgggaaagttttgatccgagtgcttttttggtaccacgagacccggccctctgccagcataaaccactcacaccccagggggatgagctctccaagcccaggattctggcaagagaggtgaagaaagtggatgcgcagagttcggctggaaaagaggacatgctcctaagcaaaagcccatcttcactcagcgctaacatcagcagcagcccaaaaggttctccttcttcatcaagaaaaagtggaaccagctgtccctccagcaaaaacagcagccctaatagcagcccacggactttggggaggagcaaagggaggctccggctgccccagattggcagcaaaaataagccgtcaagtagtaagaagaacttggatgccagcaaagagaatggggctgggcagatctgtgagctggctgacgccttgagccgagggcatatgcgggggggcagccaaccagagctggtcactcctcaggaccatgaggtagctttggccaatggattcctttatgagcatgaagcatgtggcaatggctgtggcgatggctacagcaatggtcagcttggaaaccacagtgaagaagacagcactgatgaccaaagagaagacactcatattaagcctatttataatctatatgcaatttcatgccattcaggaattctgagtgggggccattacatcacttatgccaaaaacccaaactgcaagtggtactgttataatgacagcagctgtgaggaacttcaccctgatgaaattgacaccgactctgcctacattcttttctatgagcagcaggggatagactacgcacaatttctgccaaagattgatggcaaaaagatggcagacacaagcagtacggatgaagactctgagtctgattacgaaaagtactctatgttacagtaaagctaccactctggctgctagacagcttggtggcgagggagatgactccttgtagctgatacttggcaaaagtgtcactgaaagacaagctaaatgtagttattttatcctgttagaacaaaaattctaattaaaatagttaacttgaagagtagaaacaattgtattttgaagtctcatacaagctgtctgatagagaactttcaggcagatcccaccattagcctgtaaacaaaaggtgtggcaccagccacctgggaccaaataagaattgaattgtgcttgtccagatatgaacaaatatgtagtgagtatagagtttaccaataatcataacaaatattaaagatttccttggagtcagaggaaaaaacaaacaattataatgttgtctagggacgacatgatacgctacctcctttttcctgaagttttattccattatattgacaagatggagaaagcaagatcatgaaggtgtgcaaatgattcttacggcatggacaaggatttttcaatttattttttaaactgtttccataccctttctttttcttgctttttgtttttgccattgtgtttacgtttgagacacaaccagtcattggtggcaggggcatagagtggtcagtctgaaagggaggctctcttaagagctatgtgccttccaaccagagggagacccagtagaaagaaaaacatcctgggaaatccagctaccagggccctcccagtggaggcatcttacatttaggctacttcaagtatcctcagaaatgtattctgcacccccggccccgcccatgctgagggaaggggagcagttgccaatatttgcaccatcttcacatgcacatgttgcaacaagagcttctgggaaggtaagcggcatcggagctagatcacgtttcacaattagtggttattcttttctgtgtttgttttgcactttaaaaaagagagaacacatgcaaatgaacttgcttgtgtgtatttgatggctctaagggctataaattacaaacaaaacacatcccagacattaggagttcataagtatatttaatgaaattggtggttttaggaagtcaactttagttttgctttgtttgcatgtccactggtttttttattttgatatttgtctttttttaaattttacagtagtcattgaaagttatgtttctttgcttacttcattttttccctctaattatttaagattggaacaaaagtataaatattatttatttgaggtagaatttttttcatgtagtttcttaatatatacttgaaggaaatgtttcaccttatttttggtctttgtttattcatttagaccctgcaagttgattctcattgccagattccattaccctttcttcctcataggtagtaattaccaatgtaactaagcatttgtgttctgatatctgaggccagtaactattaatatctagttctcagagcatttggaaaggttatcttaaatggctacctaaattgaaatccttttcagaaaaaatataattgcaagtaggtaggagtggcctaaattgtctaatgtaataaagtcagacaaaatgcacactttatagtttcaagattttcagtaaataaaatctgtccattcctacctggacatgtcccattaaaaagtggaagattttaaataatttctttacagatgttttatttaaacaggtagcacaatctactaatgttgtgtgatttgtgttatactggttgtaattaatttttttaattcatgaactagcggaaaatttattaaattaactattaactacattcaccttgtaaattactgtataaaacttgttgacaatgcactgactttagaaagatgttaatgtacataaatagagtgtaaataaaatagtgttgatgtactgaaatatgaactgtatcaaaagtattggtaattgtatatggggtgtacctgtttatctgttaactattatccaaacaaattaaatactgtggttgcctctatgtgctgtttttcctcatacaagtaaacacagaaagtc

SEQ ID NO: 408601 - DNA, 382 bp, Homo sapiens
tttacttttttaagagacagtctcactatgctgcctaggcttttctcaaactcctggactcaagcgatcctcctgcctcagcctcccaagttgctggaattagaggcatgagccactgtgtccggggttattttgttgtttgtttggctttttttgatagcagttgcttaggtcaaacctatttcctgaaaaacagaaaagagttttcttctcctgttattttattttacttacaacaaatagcacatatactgccacaaaaaaaagtgaggcaacttttgtccactccatacaaaccttaaatgctcaacatacctcttagcacttggcacaggcctgggcacataatcagctctcaaagttagattgacagcccagatgc

SEQ ID NO: 408602 - DNA, 875 bp, Homo sapiens
tgacttgctcactatcatgaactcactcaaaagaaactagcaattttttagacttcttttgggatccttgtaccgcatcctatactgcttttatgttcatgtgtgcatttgtgtacatgtatacacatattactccataacgaagcacagtcttcttttatacctttcctggttggggtagtagaggaattttacagcctacaatcagacacatccagaagaagagtggaatatgtatgataccttaaaaatcagcacatttaacaaagtataacttactcatggttacaactaagttaatgttttttccctttatttttcaaaaggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtatggtaatctggttccagcagcccaacaaacacagccacaattaggatagtctcagcttttcccacccattgatggcttagtagagaggttccattgaaggcacacactgaggggtctcacttgggttcagataaatgttgtcatggtcccacaccctttaggttagctaccagtacatcataagctcacgtttgtttgtttcccaaacatctgttccaaacagtgtgagttgactgaactctagttgacagtcactatcaaccctgattggcagtcatatttgtttgcttctgtgcatttggcataatgccccttaccctg

SEQ ID NO: 408603 - DNA, 1849 bp, Homo sapiens
ggctcacctgcagagacagaattcctgagtgaacgaacagagcagctcctcttccatctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcccacagtacagcctcacattcttcttccaattctgaagatacagagatgtgatgaaaacgcggctattgcagacggctaatttatgcttaacttaggaagagataaggttccttgagcaccaaagatgattcataactctgtataggtgacagctgcttataaaagcatcttagcagataagcctattaaaattgtgcttttgtaacaatgttgtggttgctagaataaataccgatgcggccgtctttcttatattttaccttcctctcgtcgtc

SEQ ID NO: 408604 - DNA, 1788 bp, Homo sapiens
ggctcacctgcagagacagaattcctgagtgaacgaacagagcagctcctcttccatctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcggctattgcagacggctaatttatgcttaacttaggaagagataaggttccttgagcaccaaagatgattcataactctgtataggtgacagctgcttataaaagcatcttagcagataagcctattaaaattgtgcttttgtaacaatgttgtggttgctagaataaataccgatgcggccgtctttcttatattttaccttcctctcgtcgtc

SEQ ID NO: 408605 - DNA, 1184 bp, Homo sapiens
atgacagcttttacataagacgcgtggctacaagtatgcccactgactttctgggaacttgcagccttttaatatgctattttgccaaaatcaaatgtcagatgcttttagtaacaggattattttcgttaagaccccttcattgttaattgctgggttagtttctggggtgagttctgagcaggaaacgagcctagatagtgtgcttataagcttcctgggatgctggtggaaggggtggtagttgtactcagcatgccttttttatctatttcatcagggctttgggctccagcagaaaatctgttttatttttttaggggacttactgataattttattttttggggttgggggagggtaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcccacagtacagcctcacattcttcttccaattctgaagatacagagatgtgatgaaaacgaatcctttctcaaggtgagttgtgacctgtttactgtctctttag

SEQ ID NO: 408606 - DNA, 949 bp, Homo sapiens
tgacttgctcactatcatgaactcactcaaaagaaactagcaattttttagacttcttttgggatccttgtaccgcatcctatactgcttttatgttcatgtgtgcatttgtgtacatgtatacacatattactccataacgaagcacagtcttcttttatacctttcctggttggggtagtagaggaattttacagcctacaatcagacacatccagaagaagagtggaatatgtatgataccttaaaaatcagcacatttaacaaagtataacttactcatggttacaactaagttaatgttttttccctttatttttcaaaaggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcccacagtacagcctcacattcttcttccaattctgaagatacagagatgtgatgaaaacgaatcctttctcaaggtgagttgtgacctgtttactgtctctttag

SEQ ID NO: 408607 - DNA, 1269 bp, Homo sapiens
tgagacgttgtcttgctctgtcaccaggctggagtgcagtggtgccatctcagctcactgcaatctccacctcccgggttcaagcgattcccctgcctcagcctcctgagtagctggaattacaggtgcgcaccaccatgcccagctaattttttgtattttagtagttttaccatgttggccaggatggtctcgatctcctgaccttgtgatccgcccgcctcggcctcccaaagtgctgggattacaggtataagccaacacgcccgggccacacatttttttcaaggtgtcctatggggcacaacaggaccagagaagccatagggagctagcttttggcttaagaaccaactgaagctgccagaaatgatgagtcattttgcagttggtggaaagtcaagcagaaatcagaggcggctgctgcagctgtttgttgtaaaggggattctgacccctcctgatcttatcatagaatgatttaattgtaatttttctgttttggttaatagagaactttgatcgaaaaagaagcctgccctcatcatctccttccccgctctccaaatcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcggctattgcagacggctaatttatgcttaacttaggaagagataaggttccttgagcaccaaagatgattcataactctgtataggtgacagctgcttataaaagcatcttagcagataagcctattaaaattgtgcttttgtaacaatgttgtggttgctagaataaataccgatgcggccgtctttcttatattttaccttcctctcgtcgtc

SEQ ID NO: 408608 - DNA, 183 bp, Homo sapiens
tccaagcttcaacttaactacatttctctgtatgatgatgtctcttacttctacaggttccttgagcaccaaagatgattcataactctgtataggtgacagctgcttataaaagcatcttagcagataagcctattaaaattgtgcttttgtaacaatgttgtggttgctagaataaatacc

SEQ ID NO: 408609 - DNA, 1678 bp, Homo sapiens
ggctcacctgcagagacagaattcctgagtgaacgaacagagcagctcctcttccatctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcccacagtacagcctcacattcttcttccaattctgaagatacagagatgtgatgaaaacgaatcctttctcaaggtgagttgtgacctgtttactgtctctttag

SEQ ID NO: 408610 - DNA, 1897 bp, Homo sapiens
ggctcacctgcagagacagaattcctgagtgaacgaacagagcagctcctcttccatctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacggctctacacaattgctgtcaactgcatgctgtgaaagaaagaaattctagcccacagtacagcctcacattcttcttccaattctgaagatacagagatgtgatgaaaacgcggctattgcagacggctaatttatgcttaacttaggaagagataaggttccttgagcaccaaagatgattcataactctgtataggtgacagctgcttataaaagcatcttagcagataagcctattaaaattgtgcttttgtaacaatgttgtggttgctagaataaataccgatgcggccgtctttcttatattttaccttcctctcgtcgtc

SEQ ID NO: 408611 - DNA, 1318 bp, Homo sapiens
atgacagcttttacataagacgcgtggctacaagtatgcccactgactttctgggaacttgcagccttttaatatgctattttgccaaaatcaaatgtcagatgcttttagtaacaggattattttcgttaagaccccttcattgttaattgctgggttagtttctggggtgagttctgagcaggaaacgagcctagatagtgtgcttataagcttcctgggatgctggtggaaggggtggtagttgtactcagcatgccttttttatctatttcatcagggctttgggctccagcagaaaatctgttttatttttttaggggacttactgataattttattttttggggttgggggagggtaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactgagaactttgatcgaaaaagaagcctgccctcatcatctccttccccgctctccaaatcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcggctattgcagacggctaatttatgcttaacttaggaagagataaggttccttgagcaccaaagatgattcataactctgtataggtgacagctgcttataaaagcatcttagcagataagcctattaaaattgtgcttttgtaacaatgttgtggttgctagaataaataccgatgcggccgtctttcttatattttaccttcctctcgtcgtc

SEQ ID NO: 408612 - DNA, 1305 bp, Homo sapiens
ggctcacctgcagagacagaattcctgagtgaacgaacagagcagctcctcttccatctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggtaagtaatacaaggccatatattcatgcattaaggctgggcccattcactcatgacctcaacttttgcactgagttaggactttgttcctcaaactggaagaggcataacaatcatcattaaggctaaactgaagctcaactcaaattggtagtgataagagaatgccaaatgattgataaatgagttttaagtccttggtcttaagattttgaaagaatttgtgaatataactgcaggcttactcttg

SEQ ID NO: 408613 - DNA, 354 bp, Homo sapiens
tggtaaacatgttgtcccaactctgcaccgtatctgtagttatctagattcccactggcgcttgggggtctcattcagaaaacaccaatccctaggagagaccaagtgagattgcctaccctttaggaattctgcctgtcagactggcccagggtaaaaccacaggtcagtcaaactcgtcctcttcagccgcccacggtgggctcccgaacctgctttgtggtattcaccacaggaagtcaagggctatcacgtggctccccgactccccaaggaagccgtgagccattcccttccccttcagtctttttacagatacctcctcacatcagaagtcacctgtcctgcccctct

SEQ ID NO: 408614 - DNA, 439 bp, Homo sapiens
ccctaatgaataatgatgttgcctattcacatgattagtttccatctgcaagtcttcattggtgaagtgtctaaatccttttgactgttttaaaagctgagttatttcatatacaaaaattaacacaagatggactagagacttaaatgcaaaacctcaaactataaaaatccctggaagaaaatctggtcattagccttggcaaagaatttatgtctaagtcctcaaaagtgaatgcaacaaaaacaaaattgacaattggtacctaattaaacaaaagagcttcctgcacagcaaaaacaaacaaacaacaataacaaaaactaacggcagagtaaacagatgacctatgggatgagagaaaatatttgcaaaatgtacatttcacaaaagaccaatatctagattttataagaaacttgaacaaatcaaaaaaaaa

SEQ ID NO: 408615 - DNA, 679 bp, Homo sapiens
tgtttttgtgtgtgttatttaaatcttcctccagcctaaaagggttttataaaacagcagctaaggccatggataaacctgtatgtaaggactggagcaaagcgagctggtctatccagactggtctgtgagatttaactctgcagcctcccctgggcacttcagacccagacggccaccttctgccactccagcaaagaataagcgccctgcttccttcaggtctcagaccaggactttatggctcatgcagatttttaaggtcatttttcttcccaaggaagaaacttgcctccagttccttcactgttaggtagcttattttcattttctctattttacaatgaaaagagtgagacctgggaagtccttgatttgcaaggaattagactcacagcattggtaaccctagaaccttcttagggtaacactaagtaccttctagacaacatgtctacctaaatgaaatgggatgtgtttcggaacatttgtctccagtttttttttaatcttgcaccctgccatttaaaaagatgtgtaaagcacatattctcaacatatgcacattgatttataaatcatatatacaaactgttacattattcttcatattagaaaacaaatacaaaatagaacattttaaatggtgatataaaaataaattgaaactgaaattcta

SEQ ID NO: 408616 - DNA, 410 bp, Homo sapiens
  misc_feature (16)..(16): n is a, c, g, or t
  misc_feature (18)..(18): n is a, c, g, or t
  misc_feature (20)..(20): n is a, c, g, or t
  misc_feature (132)..(133): n is a, c, g, or t
  misc_feature (147)..(147): n is a, c, g, or t
  misc_feature (149)..(149): n is a, c, g, or t
  misc_feature (155)..(155): n is a, c, g, or t
  misc_feature (177)..(177): n is a, c, g, or t
  misc_feature (182)..(182): n is a, c, g, or t
  misc_feature (186)..(186): n is a, c, g, or t
  misc_feature (193)..(194): n is a, c, g, or t
  misc_feature (196)..(196): n is a, c, g, or t
  misc_feature (216)..(216): n is a, c, g, or t
  misc_feature (268)..(268): n is a, c, g, or t
  misc_feature (336)..(336): n is a, c, g, or t
  misc_feature (370)..(370): n is a, c, g, or t
  misc_feature (372)..(372): n is a, c, g, or t
  misc_feature (376)..(376): n is a, c, g, or t
  misc_feature (395)..(395): n is a, c, g, or t
  misc_feature (397)..(398): n is a, c, g, or t
  misc_feature (405)..(406): n is a, c, g, or t
  misc_feature (410)..(410): n is a, c, g, or t
ctctcaaaaaaaaaananantgtgtgtagctctgttgtttccgtttgagttgcacaaaatgaccaaataggacctttttatttccttcccattttacttattgcattaaccttagcaagaagtcaagaaggnngggcgtggtggctnangtctgnaatcccagtactttggaaggcngaggnaggnggatcanntnaggtcaggagttcgagaccntcctggccaacgtggtgaaacaccgtctctactaaaaatacaaaaattagcnaggtgtggtggtgggcgcctgtaatcccagctactcgggaggctgaggcacaagaattgcttgaaccnaggaggcagaggttgcagtgagccgagatcacgncnctgnactccagcctgggtgacgngnnagactcnntctn

SEQ ID NO: 408617 - DNA, 1088 bp, Homo sapiens
  misc_feature (20)..(20): n is a, c, g, or t
  misc_feature (83)..(83): n is a, c, g, or t
actaggattgttccgttttnttgtttttctaatattgtactcccagaatgtgtaatacttctttcaatgtgtgaccaagtatntcactcagccaacaacttttccacacctggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataatatatataaatatgctacatatatatttataaaatttctagtgggagttctatataaatgtttctttggtattcttcagcctgtgatttaaagttttacaaaaagcagagctttttcctaagttacttttcagttaggtaactgtgtgatccagttcttccagctgcttctataatgaggcacatattaatacagtttttatatggtatctatgaaagagttcacttcatagagaataatacttgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgccacacggaaatctttaagttatttgttgaggtaccatatatttagggtgctaggggcaagtaatgttaatatgtgcaataggaactactggtttgaatgtgtaaatgggtgatctctctgagtcctggcaacatccagcaaaactactgcttattctccaaagaatattgggagctctcaatcctcggtgatatgggaaagagaactgagtatttgccctatgactgagctttctataggaattttattaaagaatgtttaattttgttgtccttcttaatgttctcagtcaaataaatgagtgagctggtttcggctgctcttgga

SEQ ID NO: 408618 - DNA, 721 bp, Homo sapiens
cgaccacgcgtccgcgaccacgcgtccgataaatgtttctttggtattcttcagcctgtgatttaaagttttacaaaaagcagagctttttcctaagttacttttcagttaggtaactgtgtgatccagttcttccagctgcttctataatgaggcacatattaatacagtttttatatggtatctatgaaagagttcacttcatagagaataatacttgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgccacacggaaatctttaagttatttgttgaggtaccatatatttagggtgctaggggcaagtaatgttaatatgtgcaataggaactactggtttgaatgtgtaaatgggtgatctctctgagtcctggcaacatccagcaaaactactgcttattctccaaagaatattgggagctctcaatcctcggtgatatgggaaagagaactgagtatttgccctatgactgagctttctataggaattttattaaagaatgtttaattttgttgtccttcttaatgttctcagtcaaataaatgagtgagctggtttcggctgctcttgga

SEQ ID NO: 408619 - DNA, 345 bp, Homo sapiens
gggagagaagattcagtcgtccatttggagggaggaatcccttcctcccggtgatccttactcatattctagccaccaaccacggttagtgcttgcggattgccgtgcagggtaggtttcgaatctgggacagcggatggtgaacgttacagtgagagtcatttggaagatgccttagggttggccggtacgtgaccttttgggtgatggcatggagggccagctaaaagaggtactgtttgcatagtgtagggaaacaggaaaaaggacggagaggcgggtctgtggtttcaggttaaattactagagcttttgcagaagatgggcgggcaggagcaaactcga

SEQ ID NO: 408620 - DNA, 497 bp, Homo sapiens
cgggctccagccgggctgaccgggtgtctgtaaaactctgcacctgctcaggccaggggcctctgggccgaacacaccaccccgcccagtgcccactggacccggccacaggcccatcacgtgtccaagccaggctggccatcacaggggccactcacacacccgcaccacctgctggggacttaggaccgtgctctcccttcactcaaacccaccctgtgccctcccccaactcacttcatgtctggtcccagagcacccctcttgctggggtcgcacctgcttagcccgcagggctggtttccgtggggggtgggttcagggggaagcagaggaggggccgcgagaggggtgagcgtggccctggccccgcagtggagacccaccggacacacacacgggtggacggagcgaggcagccaccgaccctgccggcgggcgggcctaggagagccaggcgaagtccttgtcagggcctctggggggctgcgcggccg

SEQ ID NO: 408621 - DNA, 592 bp, Homo sapiens
tcactctcttcctagggtcctccttcctctgtattagctacactctcagatcctgtcctgcccccagcagctccacagggcttccggttcagaccggaagaacaggagaacagaaggccacgtgcttctcttccaaatgcccaggaggaaaaaggctaattaagtctcattggtcccaccaggtcacatgtacaggctttagccaatcactgtggtcagaggtaggctatgttttgattggttaggtctgagtcacgtgatgagttccaatacaagcacaggaaggaagataaggccagaggatgttctctagagaaaaagtggggctatgttacctgaaccagtcagcacacatgttcagatattctgatcaagttcagaacaacagcctgctttgtctaatgcttgcatttcattttgaaaagttgttatacattggcagcctctgagctgaactactgagggtgtggcctactcatttgcagagtgcattcaaaagattaaaattccagaaaaccctggagaggccaggccattgagaggtcctctaaacccacccacaagccggtaacagtattaagatgaaaaaaaa

SEQ ID NO: 408622 - DNA, 443 bp, Homo sapiens
aaagttgatttcctctgctggtgagccatacatcactgacatccctgtctgtgctgcttgtctgtgacagaatgacaggtgtcatttgtcactggggcttgcggaagctgtgggaagagggattgaaattttttttctggaagggctcagtgtctgccagatcattaaaaagtggggctatgttacctgaaccagtcagcacacatgttcagatattctgatcaagttcagaacaacagcctgctttgtctaatgcttgcatttcattttgaaaagttgttatacattggcagcctctgagctgaactactgagggtgtggcctactcatttgcagagtgcattcaaaagattaaaattccagaaaaccctggagaggccaggccattgagaggtcctctaaacccacccacaagccggtaacagtattaagatgaaaaaaaa

SEQ ID NO: 408623 - DNA, 368 bp, Homo sapiens
ccctggtgctgtatctgccatcttttcacactgggtgtgacccgaagagacagcctgaggtccgtcctcactcactgtgtttcaggaactgagggtcagctggcagtgggatgaggctggcccccttctccgctttcgttccgggaggcctcccgtagagcggtaggggctcgagatggcatttcgtttggggcacgagctggtccgggaggtctgggatctctggttctgacctctgggcacctgctgcagctgtggctgaggcccagaaatgtgaagggcctccatccactccagtagtgaccccaacgtggggttcaatgtggaggggggaggggctgctgcggcagctgcaggagcagaagtgc

SEQ ID NO: 408624 - DNA, 3691 bp, Homo sapiens
taggcggtgcatcccgttcgcgcctggggctgtggtcttcccgcgcctgaggcggcggcggcaggagctgaggggagttgtagggaactgaggggagctgctgtgtcccccgcctcctcctccccatttccgcgctcccgggaccatgtccgcgctggcgggtgaagatgtctggaggtgtccaggctgtggggaccacattgctccaagccagatatggtacaggactgtcaacgaaacctggcacggctcttgcttccggtgttcagaatgccaggattccctcaccaactggtactatgagaaggatgggaagctctactgccccaaggactactgggggaagtttggggagttctgtcatgggtgctccctgctgatgacagggccttttatggtggctggggagttcaagtaccacccagagtgctttgcctgtatgagctgcaaggtgatcattgaggatggggatgcatatgcactggtgcagcatgccaccctctactgtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagaggtcaaccggatgcacatcagtcccaacaatcgaaacgccatccaccctggggaccgcatcctggagatcaatgggacccccgtccgcacacttcgagtggaggaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgacacacaaagccacgggcaaagtgatggtcatgaaagagttaattcgatgtgatgaggagacccagaaaacttttctgactgaggtgaaagtgatgcgcagcctggaccaccccaatgtgctcaagttcattggtgtgctgtacaaggataagaagctgaacctgctgacagagtacattgaggggggcacactgaaggactttctgcgcagtatggatccgttcccctggcagcagaaggtcaggtttgccaaaggaatcgcctccggaatggcctatttgcactctatgtgcatcatccaccgggatctgaactcgcacaactgcctcatcaagttggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaatacttgcctgaaagctgtgaagaagaaaaaaacccctggcctttgggccaggaggaatctgttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcacaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaatgcaatgtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaactgggccattgatcagactaaataaattaagcagttaaca

SEQ ID NO: 408625 - DNA, 3806 bp, Homo sapiens
ggcccctgctcaagaatgccagtgtgtgtgtagcctccacagagaggtcgttttctcggagtccagaggggccgcctgagcttctgagaactagggaggagccatcccagccatgagcccctgtgggaatctgctgggggccaagtggcctggagtcctcaggctcccgcagctgctccggagggagaggtgagctcagggcagcctgcctgcagccagaggtgccgggagccccgggcctgtcatggtggccatctacagccggcctgaggcagtcacagacggatttgcagctgagcctgtctatctggtgtgggaagaagatggggagttacttgtcagtcccggcttacttcacctccagagacctgtttcggtgttcagaatgccaggattccctcaccaactggtactatgagaaggatgggaagctctactgccccaaggactactgggggaagtttggggagttctgtcatgggtgctccctgctgatgacagggccttttatggtggctggggagttcaagtaccacccagagtgctttgcctgtatgagctgcaaggtgatcattgaggatggggatgcatatgcactggtgcagcatgccaccctctactgtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagaggtcaaccggatgcacatcagtcccaacaatcgaaacgccatccaccctggggaccgcatcctggagatcaatgggacccccgtccgcacacttcgagtggaggaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgacacacaaagccacgggcaaagtgatggtcatgaaagagttaattcgatgtgatgaggagacccagaaaacttttctgactgaggtgaaagtgatgcgcagcctggaccaccccaatgtgctcaagttcattggtgtgctgtacaaggataagaagctgaacctgctgacagagtacattgaggggggcacactgaaggactttctgcgcagtatggatccgttcccctggcagcagaaggtcaggtttgccaaaggaatcgcctccggaatggcctatttgcactctatgtgcatcatccaccgggatctgaactcgcacaactgcctcatcaagttggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaatacttgcctgaaagctgtgaagaagaaaaaaacccctggcctttgggccaggaggaatctgttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcacaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaatgcaatgtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaactgggccattgatcagactaaataaattaagcagttaaca

SEQ ID NO: 408626 - DNA, 2880 bp, Homo sapiens
ggcccctgctcaagaatgccagtgtgtgtgtagcctccacagagaggtcgttttctcggagtccagaggggccgcctgagcttctgagaactagggaggagccatcccagccatgagcccctgtgggaatctgctgggggccaagtggcctggagtcctcaggctcccgcagctgctccggagggagaggtgagctcagggcagcctgcctgcagccagaggtgccgggagccccgggcctgtcatggtggccatctacagccggcctgaggcagtcacagacggatttgcagctgagcctgtctatctggtgtgggaagaagatggggagttacttgtcagtcccggcttacttcacctccagagacctgtttcggtgttcagaatgccaggattccctcaccaactggtactatgagaaggatgggaagctctactgccccaaggactactgggggaagtttggggagttctgtcatgggtgctccctgctgatgacagggccttttatggtggctggggagttcaagtaccacccagagtgctttgcctgtatgagctgcaaggtgatcattgaggatggggatgcatatgcactggtgcagcatgccaccctctactgtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagaggtcaaccggatgcacatcagtcccaacaatcgaaacgccatccaccctggggaccgcatcctggagatcaatgggacccccgtccgcacacttcgagtggaggaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgacacacaaagccacgggcaaagtgatggtcatgaaagagttaattcgatgtgatgaggagacccagaaaacttttctgactgaggtgaaagtgatgcgcagcctggaccaccccaatgtgctcaagttcattggtgtgctgtacaaggataagaagctgaacctgctgacagagtacattgaggggggcacactgaaggactttctgcgcagtatggatccgttcccctggcagcagaaggtcaggtttgccaaaggaatcgcctccggaatggcctatttgcactctatgtgcatcatccaccgggatctgaactcgcacaactgcctcatcaagttggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcagagccccccccggggccgcaggagagggcccgggctgcgcggatgatgagggcccagtgaggcgccaagggaaggtcaccatcaagtatgaccccaaggagctacggaagcacctcaacctagaggagtggatcctggagcagctcacgcgcctctacgactgccaggaagaggagatctcagaactagagattgacgtggatgagctcctggacatggagagtgacgatgcctgggcttccagggtcaaggagctgctggttgactgttacaaacccacagaggccttcatctctggcctgctggacaagatccgggccatgcagaagctgagcacaccccagaagaagtgagggtccccgacccaggcgaacggtggctcccataggacaatcgctaccccccgacctcgtagcaacagcaataccgggggaccctgcggccaggcctggttccatgagcagggctcctcgtgcccctggcccaggggtctcttcccctgccccctcagttttccacttttggatttttttattgttattaaactgatgggactttgtgtttttatattgactctgcggcacgggccctttaataaagcgaggtagggtacgcctttggtgcagctcaaaaaaaaaaaaaaaatgatttccagcggtccacattagagttgaaattttctggtgggagaatctataccttgttcctttataggccaaggaccgcagtccttcagtaacaccagtgtaaaagcttgaggagaaattgtgaagctacacagtatttgttttctaatacctcttgtcattctaaatatctttaatttattaaaaaatatatatatacagt

SEQ ID NO: 408627 - DNA, 820 bp, Homo sapiens
tgcttcctccccagggccaggtttgagaacatccccatgaagtcctgacctgtcttttatcctaccaggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcaggttggtatcctgcctttttctcccagctcacagggtcctgggacgtttgcctctgtctaaggccacccctgagccctctgcaagcacaggggtgagagaagccttgaggtcaagaatgtggctgtcaacccctgagccatctgacaacacatatgtacaggttggagaagagagaggtaaagacatagcagcaagtaatctggataggacacagaaacacagccattaaaagaaagtttaaaagaaggaaattcacccaaaccatttgaatacagtaagtgtattcatctttcgatattcccctgtccatatctacacatatacttttttttatagtaaatagttctgtattttgccctgcat

SEQ ID NO: 408628 - DNA, 437 bp, Homo sapiens
cttccgagacggggtttcaccttggtgaccaggctggtctcgagctcctgacctcaggtgttcagaatgccaggattccctcaccaactggtactatgagaaggatgggaagctctactgccccaaggactactgggggaagtttggggagttctgtcatgggtgctccctgctgatgacagggccttttatggtgagtgaatcccttcatatctgcccctcttggtcttcagagtccattgacagtgcttccagttccctgtggcctgttaatcttttagtctttccatcagccagggcatctccctttatttattcattcattcaactagcaggtatcaattgagcacctactaagtgaaaggtaagatccttccctcaaagacttaatagttgaacgttgggagtgggaggagaggcaggcagagaggagacac

SEQ ID NO: 408629 - DNA, 5313 bp, Homo sapiens
ggcccctgctcaagaatgccagtgtgtgtgtagcctccacagagaggtcgttttctcggagtccagaggggccgcctgagcttctgagaactagggaggagccatcccagccatgagcccctgtgggaatctgctgggggccaagtggcctggagtcctcaggctcccgcagctgctccggagggagaggtgagctcagggcagcctgcctgcagccagaggtgccgggagccccgggcctgtcatggtggccatctacagccggcctgaggcagtcacagacggatttgcagctgagcctgtctatctggtgtgggaagaagatggggagttacttgtcagtcccggcttacttcacctccagagacctgtttcggtgttcagaatgccaggattccctcaccaactggtactatgagaaggatgggaagctctactgccccaaggactactgggggaagtttggggagttctgtcatgggtgctccctgctgatgacagggccttttatggtggctggggagttcaagtaccacccagagtgctttgcctgtatgagctgcaaggtgatcattgaggatggggatgcatatgcactggtgcagcatgccaccctctactgtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagaggtcaaccggatgcacatcagtcccaacaatcgaaacgccatccaccctggggaccgcatcctggagatcaatgggacccccgtccgcacacttcgagtggaggaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgacacacaaagccacgggcaaagtgatggtcatgaaagagttaattcgatgtgatgaggagacccagaaaacttttctgactgaggtgaaagtgatgcgcagcctggaccaccccaatgtgctcaagttcattggtgtgctgtacaaggataagaagctgaacctgctgacagagtacattgaggggggcacactgaaggactttctgcgcagtatggatccgttcccctggcagcagaaggtcaggtttgccaaaggaatcgcctccggaatggcctatttgcactctatgtgcatcatccaccgggatctgaactcgcacaactgcctcatcaagttggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcagagccccccccggggccgcaggagagggcccgggctgcgcggatgatgagggcccagtgaggcgccaagggaaggtcaccatcaagtatgaccccaaggagctacggaagcacctcaacctagaggagtggatcctggagcagctcacgcgcctctacgactgccaggaagaggagatctcagaactagagattgacgtggatgagctcctggacatggagagtgacgatgcctgggcttccagggtcaaggagctgctggttgactgttacaaacccacagaggccttcatctctggcctgctggacaagatccgggccatgcagaagctgagcacaccccagaagaagtgagggtccccgacccaggcgaacggtggctcccataggacaatcgctaccccccgacctcgtagcaacagcaataccgggggaccctgcggccaggcctggttccatgagcagggctcctcgtgcccctggcccaggggtctcttcccctgccccctcagttttccacttttggatttttttattgttattaaactgatgggactttgtgtttttatattgactctgcggcacgggccctttaataaagcgaggtagggtacgcctttggtgcagctcaaaaaaaaaaaaaaaatgatttccagcggtccacattagagttgaaattttctggtgggagaatctataccttgttcctttataggccaaggaccgcagtccttcagtaacaccagtgtaaaagcttgaggagaaattgtgaagctacacagtatttgttttctaatacctcttgtcattctaaatatctttaatttattaaaaaatatatatatacagtattgaatgcctactgtgtgctaggtacagttctaaacacttgggttacagcagcgaacaaaataaaggtgcttaccctcatagaacatagattctagcatggtatctactgtatcatacagtagatacaataagtaaactatattgaatattagaatgtggcagatgctatggaaaaagagtcaagacaagtaaagacgattgttcagggtaccagttgcaattttaaatatggtcgtcagagcaggcctcactgaggtgacatgacatttaagcataaacatggaggaggaggagtaagcctgagctgtcttaggcttccggggcagccaagccatttccgtggcactaggagcctggtgtttccgattccacctttgataactgcattttctctaagatatgggagggaagtttttctcctattgtttttaagtattaactccagctagtccagccttgttatagtgttacctaatctttatagcaaatatatgaggtaccggtaacattatgcccatttctcacagaggcactactaggtgaaggagtttgcctgacgttatacaaccaggaagtagctgagcctagatcccttccacccaccccatggccctgctcatgttccacctgcctctaatttacctcttttccttctagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaatacttgcctgaaagctgtgaagaagaaaaaaacccctggcctttgggccaggaggaatctgttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcacaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaatgcaatgtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaactgggccattgatcagactaaataaattaagcagttaaca

SEQ ID NO: 408630 - DNA, 5644 bp, Homo sapiens
ggcccctgctcaagaatgccagtgtgtgtgtagcctccacagagaggtcgttttctcggagtccagaggggccgcctgagcttctgagaactagggaggagccatcccagccatgagcccctgtgggaatctgctgggggccaagtggcctggagtcctcaggctcccgcagctgctccggagggagaggtgagctcagggcagcctgcctgcagccagaggtgccgggagccccgggcctgtcatggtggccatctacagccggcctgaggcagtcacagacggatttgcagctgagcctgtctatctggtgtgggaagaagatggggagttacttgtcagtcccggcttacttcacctccagagacctgtttcggtgttcagaatgccaggattccctcaccaactggtactatgagaaggatgggaagctctactgccccaaggactactgggggaagtttggggagttctgtcatgggtgctccctgctgatgacagggccttttatggtggctggggagttcaagtaccacccagagtgctttgcctgtatgagctgcaaggtgatcattgaggatggggatgcatatgcactggtgcagcatgccaccctctactgtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagaggtcaaccggatgcacatcagtcccaacaatcgaaacgccatccaccctggggaccgcatcctggagatcaatgggacccccgtccgcacacttcgagtggaggaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgacacacaaagccacgggcaaagtgatggtcatgaaagagttaattcgatgtgatgaggagacccagaaaacttttctgactgaggtgaaagtgatgcgcagcctggaccaccccaatgtgctcaagttcattggtgtgctgtacaaggataagaagctgaacctgctgacagagtacattgaggggggcacactgaaggactttctgcgcagtatggatccgttcccctggcagcagaaggtcaggtttgccaaaggaatcgcctccggaatggcctatttgcactctatgtgcatcatccaccgggatctgaactcgcacaactgcctcatcaagttggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacattctcctcacccccaactccaccctcccaggataaccagttgggacataatctttatttaaaaatggtttccggatagagaaagcgcttcggcggcggcagccccggcggcggccgcaggggacaaagggcgggcggatcggcggggagggggcggggcgcgaccaggccaggcccgggggctccgcatgctgcagctgcccccgggcgcccccgccgccgccctcgccgcggagccggcgagctaacctgagccagccggcgggcgtcacggaggcggcggcacaaggaggggccccacgcgcgcacgtggccccggaggccgccgtggcggacagcggcaccgcggggggcgcggcgttggcggccccggccccggcccccaggccaggcagtggcggccaaggaccacgcatctactttcagagccccccccggggccgcaggagagggcccgggctgcgcggatgatgagggcccagtgaggcgccaagggaaggtcaccatcaagtatgaccccaaggagctacggaagcacctcaacctagaggagtggatcctggagcagctcacgcgcctctacgactgccaggaagaggagatctcagaactagagattgacgtggatgagctcctggacatggagagtgacgatgcctgggcttccagggtcaaggagctgctggttgactgttacaaacccacagaggccttcatctctggcctgctggacaagatccgggccatgcagaagctgagcacaccccagaagaagtgagggtccccgacccaggcgaacggtggctcccataggacaatcgctaccccccgacctcgtagcaacagcaataccgggggaccctgcggccaggcctggttccatgagcagggctcctcgtgcccctggcccaggggtctcttcccctgccccctcagttttccacttttggatttttttattgttattaaactgatgggactttgtgtttttatattgactctgcggcacgggccctttaataaagcgaggtagggtacgcctttggtgcagctcaaaaaaaaaaaaaaaatgatttccagcggtccacattagagttgaaattttctggtgggagaatctataccttgttcctttataggccaaggaccgcagtccttcagtaacaccagtgtaaaagcttgaggagaaattgtgaagctacacagtatttgttttctaatacctcttgtcattctaaatatctttaatttattaaaaaatatatatatacagtattgaatgcctactgtgtgctaggtacagttctaaacacttgggttacagcagcgaacaaaataaaggtgcttaccctcatagaacatagattctagcatggtatctactgtatcatacagtagatacaataagtaaactatattgaatattagaatgtggcagatgctatggaaaaagagtcaagacaagtaaagacgattgttcagggtaccagttgcaattttaaatatggtcgtcagagcaggcctcactgaggtgacatgacatttaagcataaacatggaggaggaggagtaagcctgagctgtcttaggcttccggggcagccaagccatttccgtggcactaggagcctggtgtttccgattccacctttgataactgcattttctctaagatatgggagggaagtttttctcctattgtttttaagtattaactccagctagtccagccttgttatagtgttacctaatctttatagcaaatatatgaggtaccggtaacattatgcccatttctcacagaggcactactaggtgaaggagtttgcctgacgttatacaaccaggaagtagctgagcctagatcccttccacccaccccatggccctgctcatgttccacctgcctctaatttacctcttttccttctagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaatacttgcctgaaagctgtgaagaagaaaaaaacccctggcctttgggccaggaggaatctgttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcacaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaatgcaatgtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaactgggccattgatcagactaaataaattaagcagttaaca

SEQ ID NO: 408631 - DNA, 3267 bp, Homo sapiens
  misc_feature (134)..(134): n is a, c, g, or t
  misc_feature (137)..(137): n is a, c, g, or t
gtacccaaagacaaaaaattagctgggcgtggtggcacatgcctgtaatcccatttacttgggaggctgaggcaggagaattgcttgaacctgggaggcggaggttttggtgagccgagattttgcccttgcantcnagcctggttgacagagcgagactctgtctcaaaaaaaaaaaatcccatttgctcattttttggatactagtataactatcactctaaaccagttagtacttaaatcaagcagatatgggagatggtgaattaccatctacagtgttgtcatatatgtcacatactgagcattatcagctagtagaatctagttaattgttctatgtgtgatgtatgcagagttcccattttgaatgtgtttttactatgcttaaataaatgactgatgtcagcaaccccaaaatgatacatctgatgtaagagcccctgttccccaataataacatctaaactatagacattggaatgaacaggtgcccctaagtttcctccctccagggtttcttggccggtctctgaggactacacatccctactcccgtctttcctcatcttcaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgacacacaaagccacgggcaaagtgatggtcatgaaagagttaattcgatgtgatgaggagacccagaaaacttttctgactgaggtgaaagtgatgcgcagcctggaccaccccaatgtgctcaagttcattggtgtgctgtacaaggataagaagctgaacctgctgacagagtacattgaggggggcacactgaaggactttctgcgcagtatggatccgttcccctggcagcagaaggtcaggtttgccaaaggaatcgcctccggaatggcctatttgcactctatgtgcatcatccaccgggatctgaactcgcacaactgcctcatcaagttggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaatacttgcctgaaagctgtgaagaagaaaaaaacccctggcctttgggccaggaggaatctgttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcacaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaatgcaatgtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaactgggccattgatcagactaaataaattaagcagttaaca

SEQ ID NO: 408632 - DNA, 1746 bp, Homo sapiens
aatatacggctaggtacgaggctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaatacttgcctgaaagctgtgaagaagaaaaaaacccctggcctttgggccaggaggaatctgttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcacaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaatgcaatgtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaactgggccattgatcagactaaataaattaagcagttaaca

SEQ ID NO: 408633 - DNA, 1770 bp, Homo sapiens
taacacacacaccactacaacatcaccaacacacttacgctacgtaagagctggtatttagcatccgatgctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaatacttgcctgaaagctgtgaagaagaaaaaaacccctggcctttgggccaggaggaatctgttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcacaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaatgcaatgtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaactgggccattgatcagactaaataaattaagcagttaaca

SEQ ID NO: 408634 - DNA, 2660 bp, Homo sapiens
ggcccctgctcaagaatgccagtgtgtgtgtagcctccacagagaggtcgttttctcggagtccagaggggccgcctgagcttctgagaactagggaggagccatcccagccatgagcccctgtgggaatctgctgggggccaagtggcctggagtcctcaggctcccgcagctgctccggagggagaggtgagctcagggcagcctgcctgcagccagaggtgccgggagccccgggcctgtcatggtggccatctacagccggcctgaggcagtcacagacggatttgcagctgagcctgtctatctggtgtgggaagaagatggggagttacttgtcagtcccggcttacttcacctccagagacctgtttcggtgttcagaatgccaggattccctcaccaactggtactatgagaaggatgggaagctctactgccccaaggactactgggggaagtttggggagttctgtcatgggtgctccctgctgatgacagggccttttatggtggctggggagttcaagtaccacccagagtgctttgcctgtatgagctgcaaggtgatcattgaggatggggatgcatatgcactggtgcagcatgccaccctctactgtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagaggtcaaccggatgcacatcagtcccaacaatcgaaacgccatccaccctggggaccgcatcctggagatcaatgggacccccgtccgcacacttcgagtggaggaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgacacacaaagccacgggcaaagtgatggtcatgaaagagttaattcgatgtgatgaggagacccagaaaacttttctgactgaggtgaaagtgatgcgcagcctggaccaccccaatgtgctcaagttcattggtgtgctgtacaaggataagaagctgaacctgctgacagagtacattgaggggggcacactgaaggactttctgcgcagtatggatccgttcccctggcagcagaaggtcaggtttgccaaaggaatcgcctccggaatggcctatttgcactctatgtgcatcatccaccgggatctgaactcgcacaactgcctcatcaagttggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcagagccccccccggggccgcaggagagggcccgggctgcgcggatgatgagggcccagtgaggcgccaagggaaggtcaccatcaagtatgaccccaaggagctacggaagcacctcaacctagaggagtggatcctggagcagctcacgcgcctctacgactgccaggaagaggagatctcagaactagagattgacgtggatgagctcctggacatggagagtgacgatgcctgggcttccagggtcaaggagctgctggttgactgttacaaacccacagaggccttcatctctggcctgctggacaagatccgggccatgcagaagctgagcacaccccagaagaagtgagggtccccgacccaggcgaacggtggctcccataggacaatcgctaccccccgacctcgtagcaacagcaataccgggggaccctgcggccaggcctggttccatgagcagggctcctcgtgcccctggcccaggggtctcttcccctgccccctcagttttccacttttggatttttttattgttattaaactgatgggactttgtgtttttatattgactctgcggcacgggccctttaataaagcgaggtagggtacgcctttggtgcagctc

SEQ ID NO: 408635 - DNA, 347 bp, Homo sapiens
gacaccaaggagaatctggaggggacactgaggagacgttccctaaggtgccacctcccaccctggctctgttctgtcctatgtctgtctctcggatgaagctgagctggctttcagaagcctgcagagttaggaaaggaaccagctggccagggacagactatgaggattgtgctgacccagctgcccctgtggggatcacagtttacagccagagcctgtgcggacccagctgtctgccaggtttccttagaaacctgagagtcagtctctgtccactgaactcctaagctggacaggaggcagtgatgctaaaccctgaagggcaacatggcctatggagaaag

SEQ ID NO: 408636 - DNA, 430 bp, Homo sapiens
ctggcctgagtgtgtctatttgatagagctttctgctctgattctcccttgctatacaccttttctccccttctcagtggcttctcttgcctatgcttcctccccagggccaggtttgagaacatccccatgaagtcctgacctgtcttttatcctaccaggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggtgagtcctgaagccctggaggggacacccgcagagggaggacagatgctgcccttgcatcagagccctgggaattccaggggaggcctgtgaa

SEQ ID NO: 408637 - DNA, 412 bp, Homo sapiens
tggggagagctctctaacctattttaccacctcctcttctgccattcttcctgtccacatcccagcatccctttcccttgccaagtatctgtggcctctgtagtcctttgtaaacagctgtcttcttaccctacagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcaggttggtatcctgcctttttctcccagctcacagggtcctgggacgtttgcctctgtctaaggccacccctgagccctctgcaagcacaggggtgagagaagccttgaggtcaagaatg

SEQ ID NO: 408638 - DNA, 3468 bp, Homo sapiens
ggcccctgctcaagaatgccagtgtgtgtgtagcctccacagagaggtcgttttctcggagtccagaggggccgcctgagcttctgagaactagggaggagccatcccagccatgagcccctgtgggaatctgctgggggccaagtggcctggagtcctcaggctcccgcagctgctccggagggagaggtgagctcagggcagcctgcctgcagccagaggtgccgggagccccgggcctgtcatggtggccatctacagccggcctgaggcagtcacagacggatttgcagctgagcctgtctatctggtgtgggaagaagatggggagttacttgtcagtcccggcttacttcacctccagagacctgtttcggtgttcagaatgccaggattccctcaccaactggtactatgagaaggatgggaagctctactgccccaaggactactgggggaagtttggggagttctgtcatgggtgctccctgctgatgacagggccttttatggtggctggggagttcaagtaccacccagagtgctttgcctgtatgagctgcaaggtgatcattgaggatggggatgcatatgcactggtgcagcatgccaccctctactgtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagaggtcaaccggatgcacatcagtcccaacaatcgaaacgccatccaccctggggaccgcatcctggagatcaatgggacccccgtccgcacacttcgagtggaggaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgacacacaaagccacgggcaaagtgatggtcatgaaagagttaattcgatgtgatgaggagacccagaaaacttttctgactgaggtgaaagtgatgcgcagcctggaccaccccaatgtgctcaagttcattggtgtgctgtacaaggataagaagctgaacctgctgacagagtacattgaggggggcacactgaaggactttctgcgcagtatggatccgttcccctggcagcagaaggtcaggtttgccaaaggaatcgcctccggaatggcctatttgcactctatgtgcatcatccaccgggatctgaactcgcacaactgcctcatcaagttggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaatacttgcctgaaagctgtgaagaagaaaaaaacccctggcctttgggccaggaggaatctgttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcacaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtatt

SEQ ID NO: 408639 - DNA, 1343 bp, Homo sapiens
aaaaatacaaaacttagccaggcatggtggcaggtgcctgtaaccccagctacttgggaggctgaggcaggagaattgcttgaacccaggggcggaggttgcagtgagccgatatcacgccattgcactccagcctcggcaacaagagtgaaactctgtctcaaaaatggggttcttttcctgccatcaaaaatcatgtttcttttaaaaacaagttcaaacattaccaaagtttatagcacaggaaatacgtcttctgtaatctcccttaaccaatatatccctcaacattctcctcacccccaactccaccctcccaggataaccagttgggacataatctttatttaaaaatggtttccggatagagaaagcgcttcggcggcggcagccccggcggcggccgcaggggacaaagggcgggcggatcggcggggagggggcggggcgcgaccaggccaggcccgggggctccgcatgctgcagctgcccccgggcgcccccgccgccgccctcgccgcggagccggcgagctaacctgagccagccggcgggcgtcacggaggcggcggcacaaggaggggccccacgcgcgcacgtggccccggaggccgccgtggcggacagcggcaccgcggggggcgcggcgttggcggccccggccccggcccccaggccaggcagtggcggccaaggaccacgcatctactttcagagccccccccggggccgcaggagagggcccgggctgcgcggatgatgagggcccagtgaggcgccaagggaaggtcaccatcaagtatgaccccaaggagctacggaagcacctcaacctagaggagtggatcctggagcagctcacgcgcctctacgactgccaggaagaggagatctcagaactagagattgacgtggatgagctcctggacatggagagtgacgatgcctgggcttccagggtcaaggagctgctggttgactgttacaaacccacagaggccttcatctctggcctgctggacaagatccgggccatgcagaagctgagcacaccccagaagaagtgagggtccccgacccaggcgaacggtggctcccataggacaatcgctaccccccgacctcgtagcaacagcaataccgggggaccctgcggccaggcctggttccatgagcagggctcctcgtgcccctggcccaggggtctcttcccctgccccctcagttttccacttttggatttttttattgttattaaactgatgggactttgtgtttttatattgactctgcggcacgggccctttaataaagcgaggtagggtacgcctttggtgcagctc

SEQ ID NO: 408640 - DNA, 3996 bp, Homo sapiens
aaaaatacaaaacttagccaggcatggtggcaggtgcctgtaaccccagctacttgggaggctgaggcaggagaattgcttgaacccaggggcggaggttgcagtgagccgatatcacgccattgcactccagcctcggcaacaagagtgaaactctgtctcaaaaatggggttcttttcctgccatcaaaaatcatgtttcttttaaaaacaagttcaaacattaccaaagtttatagcacaggaaatacgtcttctgtaatctcccttaaccaatatatccctcaacattctcctcacccccaactccaccctcccaggataaccagttgggacataatctttatttaaaaatggtttccggatagagaaagcgcttcggcggcggcagccccggcggcggccgcaggggacaaagggcgggcggatcggcggggagggggcggggcgcgaccaggccaggcccgggggctccgcatgctgcagctgcccccgggcgcccccgccgccgccctcgccgcggagccggcgagctaacctgagccagccggcgggcgtcacggaggcggcggcacaaggaggggccccacgcgcgcacgtggccccggaggccgccgtggcggacagcggcaccgcggggggcgcggcgttggcggccccggccccggcccccaggccaggcagtggcggccaaggaccacgcatctactttcagagccccccccggggccgcaggagagggcccgggctgcgcggatgatgagggcccagtgaggcgccaagggaaggtcaccatcaagtatgaccccaaggagctacggaagcacctcaacctagaggagtggatcctggagcagctcacgcgcctctacgactgccaggaagaggagatctcagaactagagattgacgtggatgagctcctggacatggagagtgacgatgcctgggcttccagggtcaaggagctgctggttgactgttacaaacccacagaggccttcatctctggcctgctggacaagatccgggccatgcagaagctgagcacaccccagaagaagtgagggtccccgacccaggcgaacggtggctcccataggacaatcgctaccccccgacctcgtagcaacagcaataccgggggaccctgcggccaggcctggttccatgagcagggctcctcgtgcccctggcccaggggtctcttcccctgccccctcagttttccacttttggatttttttattgttattaaactgatgggactttgtgtttttatattgactctgcggcacgggccctttaataaagcgaggtagggtacgcctttggtgcagctcaaaaaaaaaaaaaaaatgatttccagcggtccacattagagttgaaattttctggtgggagaatctataccttgttcctttataggccaaggaccgcagtccttcagtaacaccagtgtaaaagcttgaggagaaattgtgaagctacacagtatttgttttctaatacctcttgtcattctaaatatctttaatttattaaaaaatatatatatacagtattgaatgcctactgtgtgctaggtacagttctaaacacttgggttacagcagcgaacaaaataaaggtgcttaccctcatagaacatagattctagcatggtatctactgtatcatacagtagatacaataagtaaactatattgaatattagaatgtggcagatgctatggaaaaagagtcaagacaagtaaagacgattgttcagggtaccagttgcaattttaaatatggtcgtcagagcaggcctcactgaggtgacatgacatttaagcataaacatggaggaggaggagtaagcctgagctgtcttaggcttccggggcagccaagccatttccgtggcactaggagcctggtgtttccgattccacctttgataactgcattttctctaagatatgggagggaagtttttctcctattgtttttaagtattaactccagctagtccagccttgttatagtgttacctaatctttatagcaaatatatgaggtaccggtaacattatgcccatttctcacagaggcactactaggtgaaggagtttgcctgacgttatacaaccaggaagtagctgagcctagatcccttccacccaccccatggccctgctcatgttccacctgcctctaatttacctcttttccttctagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaatacttgcctgaaagctgtgaagaagaaaaaaacccctggcctttgggccaggaggaatctgttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcacaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaatgcaatgtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaactgggccattgatcagactaaataaattaagcagttaaca

SEQ ID NO: 408641 - DNA, 3751 bp, Homo sapiens
ggcccctgctcaagaatgccagtgtgtgtgtagcctccacagagaggtcgttttctcggagtccagaggggccgcctgagcttctgagaactagggaggagccatcccagccatgagcccctgtgggaatctgctgggggccaagtggcctggagtcctcaggctcccgcagctgctccggagggagaggtgagctcagggcagcctgcctgcagccagaggtgccgggagccccgggcctgtcatggtggccatctacagccggcctgaggcagtcacagacggatttgcagctgagcctgtctatctggtgtgggaagaagatggggagttacttgtcagtcccggcttacttcacctccagagacctgtttcggtgttcagaatgccaggattccctcaccaactggtactatgagaaggatgggaagctctactgccccaaggactactgggggaagtttggggagttctgtcatgggtgctccctgctgatgacagggccttttatggtggctggggagttcaagtaccacccagagtgctttgcctgtatgagctgcaaggtgatcattgaggatggggatgcatatgcactggtgcagcatgccaccctctactgtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagaggtcaaccggatgcacatcagtcccaacaatcgaaacgccatccaccctggggaccgcatcctggagatcaatgggacccccgtccgcacacttcgagtggaggaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgacacacaaagccacgggcaaagtgatggtcatgaaagagttaattcgatgtgatgaggagacccagaaaacttttctgactgaggtgaaagtgatgcgcagcctggaccaccccaatgtgctcaagttcattggtgtgctgtacaaggataagaagctgaacctgctgacagagtacattgaggggggcacactgaaggactttctgcgcagtatggatccgttcccctggcagcagaaggtcaggtttgccaaaggaatcgcctccggaatggcctatttgcactctatgtgcatcatccaccgggatctgaactcgcacaactgcctcatcaagttggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaatacttgcctgaaagctgtgaagaagaaaaaaacccctggcctttgggccaggaggaatctgttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcacaggaagaggctgggggactagaaagaggccctgccctctagaaagctcagatcttggcttctgttactcatactcgggtgggctccttagtcagatgcctgcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaatgcaatgtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaactgggccattgatcagactaaataaattaagcagttaaca

SEQ ID NO: 408642 - DNA, 3532 bp, Homo sapiens
ggcccctgctcaagaatgccagtgtgtgtgtagcctccacagagaggtcgttttctcggagtccagaggggccgcctgagcttctgagaactagggaggagccatcccagccatgagcccctgtgggaatctgctgggggccaagtggcctggagtcctcaggctcccgcagctgctccggagggagaggtgagctcagggcagcctgcctgcagccagaggtgccgggagccccgggcctgtcatggtggccatctacagccggcctgaggcagtcacagacggatttgcagctgagcctgtctatctggtgtgggaagaagatggggagttacttgtcagtcccggcttacttcacctccagagacctgtttcggtgttcagaatgccaggattccctcaccaactggtactatgagaaggatgggaagctctactgccccaaggactactgggggaagtttggggagttctgtcatgggtgctccctgctgatgacagggccttttatggtggctggggagttcaagtaccacccagagtgctttgcctgtatgagctgcaaggtgatcattgaggatggggatgcatatgcactggtgcagcatgccaccctctactgtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagaggtcaaccggatgcacatcagtcccaacaatcgaaacgccatccaccctggggaccgcatcctggagatcaatgggacccccgtccgcacacttcgagtggaggaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgacacacaaagccacgggcaaagtgatggtcatgaaagagttaattcgatgtgatgaggagacccagaaaacttttctgactgaggtgaaagtgatgcgcagcctggaccaccccaatgtgctcaagttcattggtgtgctgtacaaggataagaagctgaacctgctgacagagtacattgaggggggcacactgaaggactttctgcgcagtatggatccgttcccctggcagcagaaggtcaggtttgccaaaggaatcgcctccggaatggcctatttgcactctatgtgcatcatccaccgggatctgaactcgcacaactgcctcatcaagttggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaatacttgcctgaaagctgtgaagaagaaaaaaacccctggcctttgggccaggaggaatctgttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcacaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagttcagagccaggcctggctctgaacttaggagatgcatccccagtggggactaggcaagcaagaggcccagcagccccattaatgtcacagaatctgactcttgttgtgagaatcg

SEQ ID NO: 408643 - DNA, 2395 bp, Homo sapiens
ggcccctgctcaagaatgccagtgtgtgtgtagcctccacagagaggtcgttttctcggagtccagaggggccgcctgagcttctgagaactagggaggagccatcccagccatgagcccctgtgggaatctgctgggggccaagtggcctggagtcctcaggctcccgcagctgctccggagggagaggtgagctcagggcagcctgcctgcagccagaggtgccgggagccccgggcctgtcatggtggccatctacagccggcctgaggcagtcacagacggatttgcagctgagcctgtctatctggtgtgggaagaagatggggagttacttgtcagtcccggcttacttcacctccagagacctgtttcggtgttcagaatgccaggattccctcaccaactggtactatgagaaggatgggaagctctactgccccaaggactactgggggaagtttggggagttctgtcatgggtgctccctgctgatgacagggccttttatggtggctggggagttcaagtaccacccagagtgctttgcctgtatgagctgcaaggtgatcattgaggatggggatgcatatgcactggtgcagcatgccaccctctactgtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagaggtcaaccggatgcacatcagtcccaacaatcgaaacgccatccaccctggggaccgcatcctggagatcaatgggacccccgtccgcacacttcgagtggaggaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgacacacaaagccacgggcaaagtgatggtcatgaaagagttaattcgatgtgatgaggagacccagaaaacttttctgactgaggtgaaagtgatgcgcagcctggaccaccccaatgtgctcaagttcattggtgtgctgtacaaggataagaagctgaacctgctgacagagtacattgaggggggcacactgaaggactttctgcgcagtatggatccgttcccctggcagcagaaggtcaggtttgccaaaggaatcgcctccggaatggcctatttgcactctatgtgcatcatccaccgggatctgaactcgcacaactgcctcatcaagttggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcaggttggtatcctgcctttttctcccagctcacagggtcctgggacgtttgcctctgtctaaggccacccctgagccctctgcaagcacaggggtgagagaagccttgaggtcaagaatgtggctgtcaacccctgagccatctgacaacacatatgtacaggttggagaagagagaggtaaagacatagcagcaagtaatctggataggacacagaaacacagccattaaaagaaagtttaaaagaaggaaattcacccaaaccatttgaatacagtaagtgtattcatctttcgatattcccctgtccatatctacacatatacttttttttatagtaaatagttctgtattttgccctgcat

SEQ ID NO: 408644 - DNA, 6989 bp, Homo sapiens
  misc_feature (91)..(91): n is a, c, g, or t
  misc_feature (156)..(156): n is a, c, g, or t
  misc_feature (256)..(256): n is a, c, g, or t
  misc_feature (1135)..(1135): n is a, c, g, or t
  misc_feature (1144)..(1144): n is a, c, g, or t
  misc_feature (1348)..(1348): n is a, c, g, or t
  misc_feature (1354)..(1354): n is a, c, g, or t
  misc_feature (1381)..(1381): n is a, c, g, or t
  misc_feature (1428)..(1428): n is a, c, g, or t
  misc_feature (1448)..(1448): n is a, c, g, or t
  misc_feature (1496)..(1496): n is a, c, g, or t
  misc_feature (1512)..(1512): n is a, c, g, or t
  misc_feature (1529)..(1529): n is a, c, g, or t
  misc_feature (1555)..(1555): n is a, c, g, or t
  misc_feature (3615)..(3615): n is a, c, g, or t
aaatttaggtccccacaaaagcattcttttttcttttttgagggagccttgctgttgctcaggctggagtacagtggcgtgatcacggctnactggagcctcaatctcctgggctcaaatgatcatcccacctcagtctcctgagcagctgggacnacagccagcacacccacctaaatttttatttttggtagagacgggagctcaccatgttgcccaggttgatcttgaactcctgggatcaagcaatcctccngcctcagcctcccaaatcactgggattacaggcatgagccactgcacccagccagctctctgctttttgttgcctcagttattctctctgtaagatgggaagaatcctcctggccttatcccaactctccagctggactgggggaagaactataaaagctgagcaagaggtttttatgatttttgttttttctgctgctaccacccaccatgggcatgagacggtttggtttcctggcagcagagctgtgtaggaggttcagtctgttcccctaccacacctaaaactctttcaaccaaacctgcctcaggctgggaagatacagaattttcaacagaggggggagattcactcgggctggtcactggagcttagcagtgcagattaaatcaccccaagaccacagacactgtgttcccaggagttgcatggtctttggtccctaaaaatctgagggctggcagactctggacagtttctgcgggtctccagccagcatgacactggcttgtaccccagggcctggagctgctgcctatatatgctctatatagtaggcataggcaggttttagtatcaaaatattgtacctggctgatatttgtgaatttggattggtgaagtggttcttagcattggctgtgctagagtcaaactctcctagacaggaaggagcttgggtattttaaaaaaaaaaaaaaagagccaaattactggtggctcaacagctgaaaacaatgggagcagaagtgaaatggtggctggggtaaagccaagaatccatttaaggggtgactctacagagatgcatttacttattaagtcacgacttagctgtaggggaaggtgggggaaagacacatagttctgccctcacantgttcagtntaatcaggacagggtatgtgcattcaggccttcctgcccgccacacgtgctgtttcctctgcatggaatgtccttctaccctttctttgtcccctctcctgctgtacttcaatgtatcacctccatggggtaataacatactcttaacgtgtataaggcactttatggtttaaaaagccctctcggccgggcgcagtggctcangcctgnaatcccagcactttgggaggccgaggngggtggatcatctgaggtcaggagttcgagaccagcctggccaacanggtgaaaccctatctctacnaaaaatacaaaaaattagctgggtgtggtgtcgggcgcctgttgtccnagcttctcaggaggcngaggcggaagaatcacntgaacccgggaggcggaggttgcagngatccaagattgcgccactgtactctagcctaggcaacagggtgagactctgtctcaaacagaaaagccttctcaagtacttagttcatttcactcccaccataaccaggcagggcaagaatgtcacttagctgttcagacacgagggcaggaaccagggtctcgatttctggcctggggcagagccatcctctggctcctgctgaaccccctgcagtactatgcatgcactgtgtgctcctaatgcaggaatttgaggcggggtgttgtggggtgcaatggatgggttttttctgcctctttagtgtagaccactagggttatggcgaaatcttacctagtgttgagatacatctttatccttccttccctctcctgccagcaaattggaaggaggttttactgaaacatatcagccctgaccaggtgcctgtggagtatgggggcaccatgactgaccctgatggaaaccccaagtgcaaatccaagggtatgagccgccagaggctagaggtgaacagggatgcctggctcaaatgcacattccagttcactccatgccatgcttctagatcaactacgggggtgacatccccaggaagtattatgtgcgagaccaggtgaaacagcagtatgaacacagcgtgcagatttcccgtggctcctcccaccaagtggagtatgagatcctcttccctggctgtgtcctcaggtaggggcctgggcccttccaggagacccgagctttcatctataggtcctgataggtgggctggaataggagaagccctggtgccaggaccccggagagggcacacacagacagaattatgtctcaattggtgatatcccctgcaggtggcagtttatgtcagatggagcggatgttggttttgggattttcctgaagaccaagatgggagagaggcagcgggcaggggagatgacagaggtgctgcccaaccagaggtacaactcccacctggtccctgaagatgggaccctcacctgcagtgatcctggcatctgtaagtatctctgccttggcaatgccttgaagccccatgtccagctttctgcctgtgaggttcctcttcctccatggatttttggctctgagtgttagaactagaagtggaatgccatcagttcaatcctctccttgtatagatgaagaaatctaggcttggagacttgtttatggtgacccaactggttaacagcagggtgggactttgatctcatactcctaggtatgggtgagtcacagtcctaggcgatcacaggggttcaacacgtctgctttctggtccaggtctaactgggtctgtgactggacagatatttcttggggatgctccttcccagaggtcacagagacagaactggctgggtgggcatgggatcacaaggtaagcagatgctcaaaagtgcagccttcacccctgagtttcactcatctcccagctgaccaaagaatggacacagactatgagcaggcagtttacacaagaatataagaatgggaaacagacatttgaaaaggtgcttaatctctcttaactttgtaataccattaaaattccccttgactcagcaattctacttgtgaaaatttatcctacagaaatacacaaatactcaaagatacaggaacaaggatattcccggtagcctgggaaactggcagtaaaccatatgaccatgataaggtctgttaagtaaattacagtccatccatacaatgttaaagagaataaactgacatgtaaactgtctgggacatgttaaacaaataagcatgaaacacagcatgtatggtatgtacttactttggttaaggaagtgtgtacacagaaaagaactctggggaaatttatgctaactctaacagtggttatctctgggatgataggatgtttatggagggctttcatttttacagtatttctgcaaatatattttatgatgactacgtattaatattacatttataagcagaaaaaccatacctacactcccttcaacacccacaatcaaatctccagtttctttttgtnagagccaatggaaaatcaatcagagcaaaggctttatcatcagagctgagctggacttgactaaaggctagctccatggcctttggcaagtgacaaaacctaagcttcggtttccggactgctacactggggtatctcacagggatacctgatgatttgatgtgataggttctgtgaggcacttagcataatgcctggcatagagcaagcactcaatgcactgcagtcaccactattattgttaggacaaggcctgtgggagaagggccatcctgcagacaatgccgggagatgggagaagccctgtgccccatttctacggtagtaccagcactaccaggagatctgaactagcctcacagatgtcttggcctctctgcttgtctacatggtcacccaacctgagattttgcctccttcctcacatcccaggcacccttcatctccactgccccctcctcacagatgctctgtggtaccatatagctcctgggggaggcggaatattcttattagtgagcagccgggtcctgggggagaaggtgtatactgtgtgcttcagcaagaacaaggcttagcaccagcccagacaatgtcacccacagaggagaaagcacttaatacatataagcttgaatttttttgtctgtttctttgtttttagtagagacgaggtatcgctgtgttgcccaggctggtctcgaactcctgggttcaagcgaccctcctgccttggcctcccaaagtgctgagattaccagcatgagccaccatgcccagccttgaattatttttttaatggatggggaagctggggcatagagaagggatgttctcccataaagtagcttatgtagacatcaagacagaagacatcagagaatcctagagtcctgatccagaacctcttggccattgactgtcctggatgtgtcagagagtgtggaatcccagaccagggaagtaattgacccaaggtcacagagcctgtaggagagccccaaaccattttccagcatctgcccattacccctctatcttctctttagtatctgaaggacattgcccaagaagggaacatgaaccttttaacataatcaggcttgggcttgcaaacccccaaatttattttagttccttctggatacattcccaaccagaacctttacctgcctgcagggtcttgtctgggatctgctccttgcccattcccaagaggagcagaggcaggccacaggatccattcccccttcccaggtacaaagacaatgaagttggaatcagctgttacctggtgccacagctaaggttagatgtgagcccagagagaacccagtattagcttgcaagctcatctgcgggagggcaatgcccttggagaaccaggagacccctggaaagcagaacagtcatccagtggagaaattaaaactgtgccagcctccaatggcaagagcacattaaccttccccaggcttctctggtccttatcccagtgcactaaattaccaaggaggaaaaccaaagtttgaattgatttcgcttttgttttctcacctaatatttaccaagggcctactgagtacagaatactcaactaggaatgaaaagattcccaaagaaagatctggactttgtccactagaagtgcacaatgtggtcagaagactggaaacactatagaaagggtgagcagtgctgtggtgaaaagagcccagccaggcaccaggaggcctggtttctgagtccagctttgccaatgactctcccagtgttttcagcaagtgtctctattaggtttggttttccttctccttaaaatgacagaagtgatggccgggcgtgctttcatcagattctcaagggggtcagttacccaactaaagttaaggagccttatcctggagggtgtctgggggctctgtgagtctatgattagtgtcaaaatgaaccatgcagactctggagctgcaatgactccacttccctctggcctgtggttctctgatcaacccctttcttgtttctgaggccaagtatcttgctaggcagggccattatcgacctagtacttggtgcaatgaatgcaaaggacctctcctccagcatggctgattctggttgctaagactctatcatccagggcagagatgaagcttcactcttgccagagggactattggctctgaaagacctctagtacaggggaaaaatagatgactaacaccttcaccatgaggaaagagtgggtggtgtgtctaccctttgtctaaactatgcattttgtccagggtcaggaaaaggttaagtcttaggattaaatacaggatattttttttcttgctgagaacagtgagagaagaccgggatagggatggggcagaactagtgtttttgttttcacattcagttctcctgaagcggtgtttggctgaaatggaacaacttctcaaagaaacagggttagattaaaagcagcctgttcctctgccaaagtgtggaagctttctctgccaagtgcatgcccattttctctttccagaggaaaccactgctaatgtctattatcctatcaaatatcttccatctagaagcattacatgtttccataataaacagggcatacagtgctcgctttgtcagcacatacactaaaattgaaacaatacagagattagcatggcccctgcgcgaggatgacaatcaggttatcttaaataaataaatagaaaacaggacatacacaaacacacacacacacacacacacacacaatattcacaggaattgtctgtcattcactgtatgtttgaaggaattttgaaactgtcaaactcatcgcaggatttcaggaaactttcccattaggacaagcaccagagtggtatcatcagagaatctgggagtctaagcagacaaagaagtaaagccaaaagtatttttacctatgtagttacaaaaatgttacaaactgtttacatactgttctgcaacttgttttggcctcaggacacattgtggacagtttcctgtcacttctgtggagctaacctcttttttaaaaaatatatcagtattctatcacatggattacaacataaaattgttgaagcaattctcctttgatgaacatttgagttttcccaatctcttattattacaaatagggatgcaacgagcatctctgtccatttacctttttgcaggataaattcctggttcacaaagtttgcacattttaccttttgtcagaaattgaagagggccaggttttccagggtccaagtcaggcagaacaaatgcagcaatgtggaacagacggaaactccagctctgtcatttcctcactgtgtgtcaccagagtcacaccacct

SEQ ID NO: 408645 - DNA, 378 bp, Homo sapiens
taatttttaaaacttttttagtagagacggggtttcatcatgttggccaggctggtcttgaactcctgacctcaagtgatccacccacctcggactcccaaagtgctgggattacaggtgtgagccactggacctggccgaggcccaggctttgggatttcctagaccagtgacatttccaagttttagaatattcccaaatatctattttgccatgtaaggactttaaaacaatgaccatctattgttgccatcattaacacccaaaactataagaatggcaataatctcagatgaaaaagcagtcctttaggaagctgcagtgagccaagatcgtgccactgcactccagcctgggcgacagagactccatctcaa

SEQ ID NO: 408646 - DNA, 2770 bp, Homo sapiens
cgctccctactccgcctctcgggatcctttaagaggcggggcttggctgccagctccgcggcccgggcaaaaggctgggactttactccgggtggcggcgaggacgagtctgtgctccatcagctgccgcacccgccgcctcccgcccccaaaccccatccccgcggttgagccacgatgagcggcagagtcggcgatctgagccccaggcagaaggaggcattggccaagccagaagcttcgacctgcagaagtcggaggccatgctccggaagcatgtggagttccgaaagcaaaaggacattgacaacatcattagctggcagcctccagaggtgatccaacagtatctgtcagggggtatgtgtggctatgacctggatggctgcccagtctggtacgacataattggacctctggatgccaagggtctgctgttctcagcctccaaacaggacctgctgaggaccaagatgcgggagtgtgagctgcttctgcaagagtgtgcccaccagaccacaaagttggggaggaaggtggagaccatcaccataatttatgactgcgaggggcttggcctcaagcatctctggaagcctgctgtggaggcctatggagagtttctctgcatgtttgaggaaaattatcccgaaacactgaagcgtctttttgttgttaaagcccccaaactgtttcctgtggcctataacctcatcaaacccttcctgagtgaggacactcgtaagaagatcatggtcctgggagcaaattggaaggaggttttactgaaacatatcagccctgaccaggtgcctgtggagtatgggggcaccatgactgaccctgatggaaaccccaagtgcaaatccaagatcaactacgggggtgacatccccaggaagtattatgtgcgagaccaggtgaaacagcagtatgaacacagcgtgcagatttcccgtggctcctcccaccaagtggagtatgagatcctcttccctggctgtgtcctcaggtggcagtttatgtcagatggagcggatgttggttttgggattttcctgaagaccaagatgggagagaggcagcgggcaggggagatgacagaggtgctgcccaaccagaggtacaactcccacctggtccctgaagatgggaccctcacctgcagtgatcctggcatctatgtcctgcggtttgacaacacctacagcttcattcatgccaagaaggtcaatttcactgtggaggtcctgcttccagacaaagcctcagaagagaagatgaaacagctgggggcaggcaccccgaaataacaccttctcctatagcaggcctggccccctcagtgtctccctgtcaatttctaccccttgtagcagtcattttcgcacaaccctgaagcccaaagaaactgggctggaggacagacctcaggagctttcatttcagttaggcagaggaagagcgactgcagtgggtctccgtgtctatcaaatacctaaggagtccccaggagctggctggccatcgtgataggatctgtctgtcctgtaaactgtgccaacttcacctgtccagggacagcgaagctgggggtggcggggggcatgtaccacagggtggcagcagggaaaaaaattagaaaagggtgaaagattgggacttaacacttcagggaagtcagctgccggggagaaacttgctcctaaatgaacacataagtttagatcgcaatgaggagtagcagggtagctggttgctagagttacggtggggatcagaaactcttccaaacattttagcactgaggctggggtagcttttggcttttcccaggtctcaggaggtggcctgagtcagcacacatcttcccactcggtagacaggctggcctctccctcactttgagactttggcaactcctgggccacacggcctgcctctttgattactaatgattgtcagtgactcagagcttcctgggacttcgggtacccacccgctgttctccatgcaaacaaagcgccagggaaatgacccacagggatcgcagctgcagggagggccagggaggttgggggtgggagtgaatgctaaaagcagatcgtccagtgcccttttcagtgctaccggcctctcaccaagcagtcctccatgtgagcaaccccgagacaaaaatgctaagtgggatcaagagagcagcactcggagagggtgtttgccagtctgagtgtcccgcggtgcccgccaacccgcttcctgactgacctgagcaaggtcttactaagcagtcccatctctgtgggaggcatgcaacgcgtgcagggagttcaggtgccggtcggcgtagccaggcctggaggccccccaggcaggaggccgcccaaaggcggggccggcgtctcgcagactaggggctgggggcggccacagacggcctcgaaaccacagcccttaccccaatcccacgagccccgccaacgaaccacaggtgctgggctttagagaacatgggaaggcggccccagacctggcgggaacgcctttccctcagagccaggccccggccccgtctgggaagctcatcttgcgaagctgagggagctcagggcaaaggccaggctagcgcggaccggaaggggccgaggctgcacgggcctctgccagaacgctcaggacatcccggcctgggtttacaacgctgttaggaaaattaaccaatgaataaagcaacgttcagtgcgcaaaaaaaagaaaaaatgcccaccgc

SEQ ID NO: 408647 - DNA, 2737 bp, Homo sapiens
cgctccctactccgcctctcgggatcctttaagaggcggggcttggctgccagctccgcggcccgggcaaaaggctgggactttactccgggtggcggcgaggacgagtctgtgctccatcagctgccgcacccgccgcctcccgcccccaaaccccatccccgcggttgagccacgatgagcggcagagtcggcgatctgagccccaggcagaaggaggcattggccaagtttcgggagaatgtccaggatgtgctgccggccctgccgaatccagatgactattttctcctgcgttggctccgagccagaagcttcgacctgcagaagtcggaggccatgctccggaagcatgtggagttccgaaagcaaaaggacattgacaacatcattagctggcagcctccagagcctccaaacaggacctgctgaggaccaagatgcgggagtgtgagctgcttctgcaagagtgtgcccaccagaccacaaagttggggaggaaggtggagaccatcaccataatttatgactgcgaggggcttggcctcaagcatctctggaagcctgctgtggaggcctatggagagtttctctgcatgtttgaggaaaattatcccgaaacactgaagcgtctttttgttgttaaagcccccaaactgtttcctgtggcctataacctcatcaaacccttcctgagtgaggacactcgtaagaagatcatggtcctgggagcaaattggaaggaggttttactgaaacatatcagccctgaccaggtgcctgtggagtatgggggcaccatgactgaccctgatggaaaccccaagtgcaaatccaagatcaactacgggggtgacatccccaggaagtattatgtgcgagaccaggtgaaacagcagtatgaacacagcgtgcagatttcccgtggctcctcccaccaagtggagtatgagatcctcttccctggctgtgtcctcaggtggcagtttatgtcagatggagcggatgttggttttgggattttcctgaagaccaagatgggagagaggcagcgggcaggggagatgacagaggtgctgcccaaccagaggtacaactcccacctggtccctgaagatgggaccctcacctgcagtgatcctggcatctatgtcctgcggtttgacaacacctacagcttcattcatgccaagaaggtcaatttcactgtggaggtcctgcttccagacaaagcctcagaagagaagatgaaacagctgggggcaggcaccccgaaataacaccttctcctatagcaggcctggccccctcagtgtctccctgtcaatttctaccccttgtagcagtcattttcgcacaaccctgaagcccaaagaaactgggctggaggacagacctcaggagctttcatttcagttaggcagaggaagagcgactgcagtgggtctccgtgtctatcaaatacctaaggagtccccaggagctggctggccatcgtgataggatctgtctgtcctgtaaactgtgccaacttcacctgtccagggacagcgaagctgggggtggcggggggcatgtaccacagggtggcagcagggaaaaaaattagaaaagggtgaaagattgggacttaacacttcagggaagtcagctgccggggagaaacttgctcctaaatgaacacataagtttagatcgcaatgaggagtagcagggtagctggttgctagagttacggtggggatcagaaactcttccaaacattttagcactgaggctggggtagcttttggcttttcccaggtctcaggaggtggcctgagtcagcacacatcttcccactcggtagacaggctggcctctccctcactttgagactttggcaactcctgggccacacggcctgcctctttgattactaatgattgtcagtgactcagagcttcctgggacttcgggtacccacccgctgttctccatgcaaacaaagcgccagggaaatgacccacagggatcgcagctgcagggagggccagggaggttgggggtgggagtgaatgctaaaagcagatcgtccagtgcccttttcagtgctaccggcctctcaccaagcagtcctccatgtgagcaaccccgagacaaaaatgctaagtgggatcaagagagcagcactcggagagggtgtttgccagtctgagtgtcccgcggtgcccgccaacccgcttcctgactgacctgagcaaggtcttactaagcagtcccatctctgtgggaggcatgcaacgcgtgcagggagttcaggtgccggtcggcgtagccaggcctggaggccccccaggcaggaggccgcccaaaggcggggccggcgtctcgcagactaggggctgggggcggccacagacggcctcgaaaccacagcccttaccccaatcccacgagccccgccaacgaaccacaggtgctgggctttagagaacatgggaaggcggccccagacctggcgggaacgcctttccctcagagccaggccccggccccgtctgggaagctcatcttgcgaagctgagggagctcagggcaaaggccaggctagcgcggaccggaaggggccgaggctgcacgggcctctgccagaacgctcaggacatcccggcctgggtttacaacgctgttaggaaaattaaccaatgaataaagcaacgttcagtgcgcaaaaaaaagaaaaaatgcccaccgc

SEQ ID NO: 408648 - DNA, 4045 bp, Homo sapiens
  misc_feature (1155)..(1155): n is a, c, g, or t
  misc_feature (1164)..(1164): n is a, c, g, or t
  misc_feature (1368)..(1368): n is a, c, g, or t
  misc_feature (1374)..(1374): n is a, c, g, or t
  misc_feature (1401)..(1401): n is a, c, g, or t
  misc_feature (1448)..(1448): n is a, c, g, or t
  misc_feature (1468)..(1468): n is a, c, g, or t
  misc_feature (1516)..(1516): n is a, c, g, or t
  misc_feature (1532)..(1532): n is a, c, g, or t
  misc_feature (1549)..(1549): n is a, c, g, or t
  misc_feature (1575)..(1575): n is a, c, g, or t
agaaaaaagaggtctgctcggttgcccaggctgcattgcagtggcagtgatcatagcgaactgcggtcttgaactcctgggctcaagggatcttcctgcctaagcctccaaatagctaagactacaagtgcacgccattatgcccagctattttttattttttagtaaagacaggatctcgctttgttgcccaggctggtctcaaactctcgtgctcaagtggtcctcctgcctcagcctcccgagtagctgggattacaggtgtgagccaccacacctggatgcccaatctacctttctagccttttctccctccactgcacccagccagctctctgctttttgttgcctcagttattctctctgtaagatgggaagaatcctcctggccttatcccaactctccagctggactgggggaagaactataaaagctgagcaagaggtttttatgatttttgttttttctgctgctaccacccaccatgggcatgagacggtttggtttcctggcagcagagctgtgtaggaggttcagtctgttcccctaccacacctaaaactctttcaaccaaacctgcctcaggctgggaagatacagaattttcaacagaggggggagattcactcgggctggtcactggagcttagcagtgcagattaaatcaccccaagaccacagacactgtgttcccaggagttgcatggtctttggtccctaaaaatctgagggctggcagactctggacagtttctgcgggtctccagccagcatgacactggcttgtaccccagggcctggagctgctgcctatatatgctctatatagtaggcataggcaggttttagtatcaaaatattgtacctggctgatatttgtgaatttggattggtgaagtggttcttagcattggctgtgctagagtcaaactctcctagacaggaaggagcttgggtattttaaaaaaaaaaaaaaagagccaaattactggtggctcaacagctgaaaacaatgggagcagaagtgaaatggtggctggggtaaagccaagaatccatttaaggggtgactctacagagatgcatttacttattaagtcacgacttagctgtaggggaaggtgggggaaagacacatagttctgccctcacantgttcagtntaatcaggacagggtatgtgcattcaggccttcctgcccgccacacgtgctgtttcctctgcatggaatgtccttctaccctttctttgtcccctctcctgctgtacttcaatgtatcacctccatggggtaataacatactcttaacgtgtataaggcactttatggtttaaaaagccctctcggccgggcgcagtggctcangcctgnaatcccagcactttgggaggccgaggngggtggatcatctgaggtcaggagttcgagaccagcctggccaacanggtgaaaccctatctctacnaaaaatacaaaaaattagctgggtgtggtgtcgggcgcctgttgtccnagcttctcaggaggcngaggcggaagaatcacntgaacccgggaggcggaggttgcagngatccaagattgcgccactgtactctagcctaggcaacagggtgagactctgtctcaaacagaaaagccttctcaagtacttagttcatttcactcccaccataaccaggcagggcaagaatgtcacttagctgttcagacacgagggcaggaaccagggtctcgatttctggcctggggcagagccatcctctggctcctgctgaaccccctgcagtactatgcatgcactgtgtgctcctaatgcaggaatttgaggcggggtgttgtggggtgcaatggatgggttttttctgcctctttagtgtagaccactagggttatggcgaaatcttacctagtgttgagatacatctttatccttccttccctctcctgccagcaaattggaaggaggttttactgaaacatatcagccctgaccaggtgcctgtggagtatgggggcaccatgactgaccctgatggaaaccccaagtgcaaatccaagggtatgagccgccagaggctagaggtgaacagggatgcctggctcaaatgcacattccagttcactccatgccatgcttctagatcaactacgggggtgacatccccaggaagtattatgtgcgagaccaggtgaaacagcagtatgaacacagcgtgcagatttcccgtggctcctcccaccaagtggagtatgagatcctcttccctggctgtgtcctcaggtggcagtttatgtcagatggagcggatgttggttttgggattttcctgaagaccaagatgggagagaggcagcgggcaggggagatgacagaggtgctgcccaaccagaggtacaactcccacctggtccctgaagatgggaccctcacctgcagtgatcctggcatctatgtcctgcggtttgacaacacctacagcttcattcatgccaagaaggtcaatttcactgtggaggtcctgcttccagacaaagcctcagaagagaagatgaaacagctgggggcaggcaccccgaaataacaccttctcctatagcaggcctggccccctcagtgtctccctgtcaatttctaccccttgtagcagtcattttcgcacaaccctgaagcccaaagaaactgggctggaggacagacctcaggagctttcatttcagttaggcagaggaagagcgactgcagtgggtctccgtgtctatcaaatacctaaggagtccccaggagctggctggccatcgtgataggatctgtctgtcctgtaaactgtgccaacttcacctgtccagggacagcgaagctgggggtggcggggggcatgtaccacagggtggcagcagggaaaaaaattagaaaagggtgaaagattgggacttaacacttcagggaagtcagctgccggggagaaacttgctcctaaatgaacacataagtttagatcgcaatgaggagtagcagggtagctggttgctagagttacggtggggatcagaaactcttccaaacattttagcactgaggctggggtagcttttggcttttcccaggtctcaggaggtggcctgagtcagcacacatcttcccactcggtagacaggctggcctctccctcactttgagactttggcaactcctgggccacacggcctgcctctttgattactaatgattgtcagtgactcagagcttcctgggacttcgggtacccacccgctgttctccatgcaaacaaagcgccagggaaatgacccacagggatcgcagctgcagggagggccagggaggttgggggtgggagtgaatgctaaaagcagatcgtccagtgcccttttcagtgctaccggcctctcaccaagcagtcctccatgtgagcaaccccgagacaaaaatgctaagtgggatcaagagagcagcactcggagagggtgtttgccagtctgagtgtcccgcggtgcccgccaacccgcttcctgactgacctgagcaaggtcttactaagcagtcccatctctgtgggaggcatgcaacgcgtgcagggagttcaggtgccggtcggcgtagccaggcctggaggccccccaggcaggaggccgcccaaaggcggggccggcgtctcgcagactaggggctgggggcggccacagacggcctcgaaaccacagcccttaccccaatcccacgagccccgccaacgaaccacaggtgctgggctttagagaacatgggaaggcggccccagacctggcgggaacgcctttccctcagagccaggccccggccccgtctgggaagctcatcttgcgaagctgagggagctcagggcaaaggccaggctagcgcggaccggaaggggccgaggctgcacgggcctctgccagaacgctcaggacatcccggcctgggtttacaacgctgttaggaaaattaaccaatgaataaagcaacgttcagtgcgcaaaaaaaagaaaaaatgcccaccgc

SEQ ID NO: 408649 - DNA, 2518 bp, Homo sapiens
cgctccctactccgcctctcgggatcctttaagaggcggggcttggctgccagctccgcggcccgggcaaaaggctgggactttactccgggtggcggcgaggacgagtctgtgctccatcagctgccgcacccgccgcctcccgcccccaaaccccatccccgcggttgagccacgatgagcggcagagtcggcgatctgagccccaggcagaaggaggcattggccaagtttcgggagaatgtccaggatgtgctgccggccctgccgaatccagatgactattttctcctgcgttggctccgagccagaagcttcgacctgcagaagtcggaggccatgctccggaagcatgtggagttccgaaagcaaaaggacattgacaacatcattagctggcagcctccagaggtgatccaacagtatctgtcagggggtatgtgtggctatgacctggatggctgcccagtctggtacgacataattggacctctggatgccaagggtctgctgttctcagcctccaaacaggacctgctgaggaccaagatgcgggagtgtgagctgcttctgcaagagtgtgcccaccagaccacaaagttggggaggaaggtggagaccatcaccataatttatgactgcgaggggcttggcctcaagcatctctggaagcctgctgtggaggcctatggagagtttctctgcatgtttgaggaaaattatcccgaaacactgaagcgtctttttgttgttaaagcccccaaactgtttcctgtggcctataacctcatcaaacccttcctgagtgaggacactcgtaagaagatcatggtcctgggagcaaattggaaggaggttttactgaaacatatcagccctgaccaggtgcctgtggagtatgggggcaccatgactgaccctgatggaaaccccaagtgcaaatccaagatcaactacgggggtgacatccccaggaagtattatgtgcgagaccaggtgaaacagcagtatgaacacagcgtgcagatttcccgtggctcctcccaccaagtggagtatgagatcctcttccctggctgtgtcctcaggtggcagtttatgtcagatggagcggatgttggttttgggattttcctgaagaccaagatgggagagaggcagcgggcaggggagatgacagaggtgctgcccaaccagaggtacaactcccacctggtccctgaagatgggaccctcacctgcagtgatcctggcatctatgtcctgcggtttgacaacacctacagcttcattcatgccaagaaggtcaatttcactgtggaggtcctgcttccagacaaagcctcagaagagaagatgaaacagctgggggcaggcaccccgaaataacaccttctcctatagcaggcctggccccctcagtgtctccctgtcaatttctaccccttgtagcagtcattttcgcacaaccctgaagcccaaagaaactgggctggaggacagacctcaggagctttcatttcagttaggcagaggaagagcgactgcagtgggtctccgtgtctatcaaatacctaaggagtccccaggagctggctggccatcgtgataggatctgtctgtcctgtaaactgtgccaacttcacctgtccagggacagcgaagctgggggtggcggggggcatgtaccacagggtggcagcagggaaaaaaattagaaaagggtgaaagattgggacttaacacttcagggaagtcagctgccggggagaaacttgctcctaaatgaacacataagtttagatcgcaatgaggagtagcagggtagctggttgctagagttacggtggggatcagaaactcttccaaacattttagcactgaggctggggtagcttttggcttttcccaggtctcaggaggtggcctgagtcagcacacatcttcccactcggtagacaggctggcctctccctcactttgagactttggcaactcctgggccacacggcctgcctctttgattactaatgattgtcagtgactcagagcttcctgggacttcgggtacccacccgctgttctccatgcaaacaaagcgccagggaaatgacccacagggatcgcagctgcagggagggccagggaggttgggggtgggagtgaatgctaaaagcagatcgtccagtgcccttttcagtgctaccggcctctcaccaagcagtcctccatgtgagcaaccccgagacaaaaatgctaagtgggatcaagagagcagcactcggagagggtgtttgccagtctgagtgtcccgcggtgcccgccaacccgcttcctgactgacctgagcaaggtcttactaagcagtcccatctctgtgggaggcatgcaacgcgctgcacgggcctctgccagaacgctcaggacatcccggcctgggtttacaacgctgttaggaaaattaaccaatgaataaagcaacgttcagtgcgcaaaaaaaagaaaaaatgcccaccgc

SEQ ID NO: 408650 - DNA, 229 bp, Homo sapiens
agtgtgcccaccagaccacaaaggtgagtggaccaccatggctagaaatgagttgaccacagcagaggcattccagcagaagcagggatgtcacacaggaatataagcacagcttcagggccaaggcccagcctttttttttttttttttaatttttaaaacttttttagtagagacggggtttcatcatgttggccaggctggtcttgaactcctgacctcaagtgat

SEQ ID NO: 408651 - DNA, 521 bp, Homo sapiens
ggatgggtgaggcaatgggggcagattctgagcctgctggaatcaagagtgattttgtttccacagtttctctgcatgtttgaggaaaattatcccgaaacactgaagcgtctttttgttgttaaaggtaagttgggaatttcttgtgataaagccagatggaaaagaggggtcaaaaacatgactgcggcagatggagggtcaaacagtgagccaaaagagggggtctgaggacatgttcagaagactgctgcccctgctagtgtgctggctcacgcctgtaaccccagcactttgggaggccgaggcaggaggctctcttgagcccaggagtttgagaccagcctgggtaacacagcaagacctcatctctataaaaaagttaaggaaatgagctgggtatggtggtgcatgcctgtagttccagtttctcaaaaggctgaggcaagagcattgcttgagtctaggagtttaaggctgcagtgagccatgattgtgccactgcactccagcctgggcga

SEQ ID NO: 408652 - DNA, 2846 bp, Homo sapiens
cgctccctactccgcctctcgggatcctttaagaggcggggcttggctgccagctccgcggcccgggcaaaaggctgggactttactccgggtggcggcgaggacgagtctgtgctccatcagctgccgcacccgccgcctcccgcccccaaaccccatccccgcggttgagccacgatgagcggcagagtcggcgatctgagccccaggcagaaggaggcattggccaagtttcgggagaatgtccaggatgtgctgccggccctgccgaatccagatgactattttctcctgcgttggctccgagccagaagcttcgacctgcagaagtcggaggccatgctccggaagcatgtggagttccgaaagcaaaaggacattgacaacatcattagctggcagcctccagaggtgatccaacagtatctgtcagggggtatgtgtggctatgacctggatggctgcccagtctggtacgacataattggacctctggatgccaagggtctgctgttctcagcctccaaacaggacctgctgaggaccaagatgcgggagtgtgagctgcttctgcaagagtgtgcccaccagaccacaaagttggggaggaaggtggagaccatcaccataatttatgactgcgaggggcttggcctcaagcatctctggaagcctgctgtggaggcctatggagagtttctctgcatgtttgaggaaaattatcccgaaacactgaagcgtctttttgttgttaaagcccccaaactgtttcctgtggcctataacctcatcaaacccttcctgagtgaggacactcgtaagaagatcatggtcctgggagcaaattggaaggaggttttactgaaacatatcagccctgaccaggtgcctgtggagtatgggggcaccatgactgaccctgatggaaaccccaagtgcaaatccaagatcaactacgggggtgacatccccaggaagtattatgtgcgagaccaggtgaaacagcagtatgaacacagcgtgcagatttcccgtggctcctcccaccaagtggagtatgagatcctcttccctggctgtgtcctcaggtggcagtttatgtcagatggagcggatgttggttttgggattttcctgaagaccaagatgggagagaggcagcgggcaggggagatgacagaggtgctgcccaaccagaggtacaactcccacctggtccctgaagatgggaccctcacctgcagtgatcctggcatctatgtcctgcggtttgacaacacctacagcttcattcatgccaagaaggtcaatttcactgtggaggtcctgcttccagacaaagcctcagaagagaagatgaaacagctgggggcaggcaccccgaaataacaccttctcctatagcaggcctggccccctcagtgtctccctgtcaatttctaccccttgtagcagtcattttcgcacaaccctgaagcccaaagaaactgggctggaggacagacctcaggagctttcatttcagttaggcagaggaagagcgactgcagtgggtctccgtgtctatcaaatacctaaggagtccccaggagctggctggccatcgtgataggatctgtctgtcctgtaaactgtgccaacttcacctgtccagggacagcgaagctgggggtggcggggggcatgtaccacagggtggcagcagggaaaaaaattagaaaagggtgaaagattgggacttaacacttcagggaagtcagctgccggggagaaacttgctcctaaatgaacacataagtttagatcgcaatgaggagtagcagggtagctggttgctagagttacggtggggatcagaaactcttccaaacattttagcactgaggctggggtagcttttggcttttcccaggtctcaggaggtggcctgagtcagcacacatcttcccactcggtagacaggctggcctctccctcactttgagactttggcaactcctgggccacacggcctgcctctttgattactaatgattgtcagtgactcagagcttcctgggacttcgggtacccacccgctgttctccatgcaaacaaagcgccagggaaatgacccacagggatcgcagctgcagggagggccagggaggttgggggtgggagtgaatgctaaaagcagatcgtccagtgcccttttcagtgctaccggcctctcaccaagcagtcctccatgtgagcaaccccgagacaaaaatgctaagtgggatcaagagagcagcactcggagagggtgtttgccagtctgagtgtcccgcggtgcccgccaacccgcttcctgactgacctgagcaaggtcttactaagcagtcccatctctgtgggaggcatgcaacgcgtgcagggagttcaggtgccggtcggcgtagccaggcctggaggccccccaggcaggaggccgcccaaaggcggggccggcgtctcgcagactaggggctgggggcggccacagacggcctcgaaaccacagcccttaccccaatcccacgagccccgccaacgaaccacaggtgctgggctttagagaacatgggaaggcggccccagacctggcgggaacgcctttccctcagagccaggccccggccccgtctgggaagctcatcttgcgaagctgagggagctcagggcaaaggccaggctagcgcggaccggaaggggccgaggctgcacgggcctctgccagaacgctcaggacatcccggcctgggtttacaacgctgttaggaaaattaaccaatgaataaagcaacgttcagtgcgcaaaaaaaagaaaaaatgcccaccgc

SEQ ID NO: 408653 - DNA, 2706 bp, Homo sapiens
cgctccctactccgcctctcgggatcctttaagaggcggggcttggctgccagctccgcggcccgggcaaaaggctgggactttactccgggtggcggcgaggacgagtctgtgctccatcagctgccgcacccgccgcctcccgcccccaaaccccatccccgcggttgagccacgatgagcggcagagtcggcgatctgagccccaggcagaaggaggcattggccaagtttcgggagaatgtccaggatgtgctgccggccctgccgaatccagatgactattttctcctgcgttggctccgagccagaagcttcgacctgcagaagtcggaggccatgctccggaagcatgtggagttccgaaagcaaaaggacattgacaacatcattagctggcagcctccagaggtgatccaacagtatctgtcagggggtatgtgtggctatgacctggatggctgcccagtctggtacgacataattggacctctggatgccaagggtctgctgttctcagcctccaaacaggacctgctgaggaccaagatgcgggagtgtgagctgcttctgcaagagtgtgcccaccagaccacaaagttggggaggaaggtggagaccatcaccataatttatgactgcgaggggcttggcctcaagcatctctggaagcctgctgtggaggcctatggagagtttctctgcatgtttgaggaaaattatcccgaaacactgaagcgtctttttgttgttaaagcccccaaactgtttcctgtggcctataacctcatcaaacccttcctgagtgaggacactcgtaagaagatcatggtcctgggagcaaattggaaggaggttttactgaaacatatcagccctgaccaggtgcctgtggagtatgggggcaccatgactgaccctgatggaaaccccaagtgcaaatccaaggtggcagtttatgtcagatggagcggatgttggttttgggattttcctgaagaccaagatgggagagaggcagcgggcaggggagatgacagaggtgctgcccaaccagaggtacaactcccacctggtccctgaagatgggaccctcacctgcagtgatcctggcatctatgtcctgcggtttgacaacacctacagcttcattcatgccaagaaggtcaatttcactgtggaggtcctgcttccagacaaagcctcagaagagaagatgaaacagctgggggcaggcaccccgaaataacaccttctcctatagcaggcctggccccctcagtgtctccctgtcaatttctaccccttgtagcagtcattttcgcacaaccctgaagcccaaagaaactgggctggaggacagacctcaggagctttcatttcagttaggcagaggaagagcgactgcagtgggtctccgtgtctatcaaatacctaaggagtccccaggagctggctggccatcgtgataggatctgtctgtcctgtaaactgtgccaacttcacctgtccagggacagcgaagctgggggtggcggggggcatgtaccacagggtggcagcagggaaaaaaattagaaaagggtgaaagattgggacttaacacttcagggaagtcagctgccggggagaaacttgctcctaaatgaacacataagtttagatcgcaatgaggagtagcagggtagctggttgctagagttacggtggggatcagaaactcttccaaacattttagcactgaggctggggtagcttttggcttttcccaggtctcaggaggtggcctgagtcagcacacatcttcccactcggtagacaggctggcctctccctcactttgagactttggcaactcctgggccacacggcctgcctctttgattactaatgattgtcagtgactcagagcttcctgggacttcgggtacccacccgctgttctccatgcaaacaaagcgccagggaaatgacccacagggatcgcagctgcagggagggccagggaggttgggggtgggagtgaatgctaaaagcagatcgtccagtgcccttttcagtgctaccggcctctcaccaagcagtcctccatgtgagcaaccccgagacaaaaatgctaagtgggatcaagagagcagcactcggagagggtgtttgccagtctgagtgtcccgcggtgcccgccaacccgcttcctgactgacctgagcaaggtcttactaagcagtcccatctctgtgggaggcatgcaacgcgtgcagggagttcaggtgccggtcggcgtagccaggcctggaggccccccaggcaggaggccgcccaaaggcggggccggcgtctcgcagactaggggctgggggcggccacagacggcctcgaaaccacagcccttaccccaatcccacgagccccgccaacgaaccacaggtgctgggctttagagaacatgggaaggcggccccagacctggcgggaacgcctttccctcagagccaggccccggccccgtctgggaagctcatcttgcgaagctgagggagctcagggcaaaggccaggctagcgcggaccggaaggggccgaggctgcacgggcctctgccagaacgctcaggacatcccggcctgggtttacaacgctgttaggaaaattaaccaatgaataaagcaacgttcagtgcgcaaaaaaaagaaaaaatgcccaccgc

SEQ ID NO: 408654 - DNA, 2591 bp, Homo sapiens
gtcctcgggcataagtggctctacgggtaccgtgcacagagcacacagtgactcaggaagggggaggccatcaggccaaactgcagaaccaaagccatctcagatgtcatctagatccacccagtcatgtactggaaaagaacacagagacctaggcaggaagagtgactcgcctagaccacaattctggcctggggtgattatctcagtttggaaaactctaggtccggccctaactagctctgattgctctctggatgcacagtgcaatcatttggcctggactggaacgggcttctgaagtaggacagcctgacaagacttcctgctctctgttccctgcagttggggaggaaggtggagaccatcaccataatttatgactgcgaggggcttggcctcaagcatctctggaagcctgctgtggaggcctatggagagtttctctgcatgtttgaggaaaattatcccgaaacactgaagcgtctttttgttgttaaagcccccaaactgtttcctgtggcctataacctcatcaaacccttcctgagtgaggacactcgtaagaagatcatggtcctgggagcaaattggaaggaggttttactgaaacatatcagccctgaccaggtgcctgtggagtatgggggcaccatgactgaccctgatggaaaccccaagtgcaaatccaagatcaactacgggggtgacatccccaggaagtattatgtgcgagaccaggtgaaacagcagtatgaacacagcgtgcagatttcccgtggctcctcccaccaagtggagtatgagatcctcttccctggctgtgtcctcaggtggcagtttatgtcagatggagcggatgttggttttgggattttcctgaagaccaagatgggagagaggcagcgggcaggggagatgacagaggtgctgcccaaccagaggtacaactcccacctggtccctgaagatgggaccctcacctgcagtgatcctggcatctatgtcctgcggtttgacaacacctacagcttcattcatgccaagaaggtcaatttcactgtggaggtcctgcttccagacaaagcctcagaagagaagatgaaacagctgggggcaggcaccccgaaataacaccttctcctatagcaggcctggccccctcagtgtctccctgtcaatttctaccccttgtagcagtcattttcgcacaaccctgaagcccaaagaaactgggctggaggacagacctcaggagctttcatttcagttaggcagaggaagagcgactgcagtgggtctccgtgtctatcaaatacctaaggagtccccaggagctggctggccatcgtgataggatctgtctgtcctgtaaactgtgccaacttcacctgtccagggacagcgaagctgggggtggcggggggcatgtaccacagggtggcagcagggaaaaaaattagaaaagggtgaaagattgggacttaacacttcagggaagtcagctgccggggagaaacttgctcctaaatgaacacataagtttagatcgcaatgaggagtagcagggtagctggttgctagagttacggtggggatcagaaactcttccaaacattttagcactgaggctggggtagcttttggcttttcccaggtctcaggaggtggcctgagtcagcacacatcttcccactcggtagacaggctggcctctccctcactttgagactttggcaactcctgggccacacggcctgcctctttgattactaatgattgtcagtgactcagagcttcctgggacttcgggtacccacccgctgttctccatgcaaacaaagcgccagggaaatgacccacagggatcgcagctgcagggagggccagggaggttgggggtgggagtgaatgctaaaagcagatcgtccagtgcccttttcagtgctaccggcctctcaccaagcagtcctccatgtgagcaaccccgagacaaaaatgctaagtgggatcaagagagcagcactcggagagggtgtttgccagtctgagtgtcccgcggtgcccgccaacccgcttcctgactgacctgagcaaggtcttactaagcagtcccatctctgtgggaggcatgcaacgcgtgcagggagttcaggtgccggtcggcgtagccaggcctggaggccccccaggcaggaggccgcccaaaggcggggccggcgtctcgcagactaggggctgggggcggccacagacggcctcgaaaccacagcccttaccccaatcccacgagccccgccaacgaaccacaggtgctgggctttagagaacatgggaaggcggccccagacctggcgggaacgcctttccctcagagccaggccccggccccgtctgggaagctcatcttgcgaagctgagggagctcagggcaaaggccaggctagcgcggaccggaaggggccgaggctgcacgggcctctgccagaacgctcaggacatcccggcctgggtttacaacgctgttaggaaaattaaccaatgaataaagcaacgttcagtgcgcaaaaaaaagaaaaaatgcccaccgc

SEQ ID NO: 408655 - DNA, 3072 bp, Homo sapiens
  misc_feature (1315)..(1315): n is a, c, g, or t
  misc_feature (1440)..(1440): n is a, c, g, or t
cgctccctactccgcctctcgggatcctttaagaggcggggcttggctgccagctccgcggcccgggcaaaaggctgggactttactccgggtggcggcgaggacgagtctgtgctccatcagctgccgcacccgccgcctcccgcccccaaaccccatccccgcggttgagccacgatgagcggcagagtcggcgatctgagccccaggcagaaggaggcattggccaagtttcgggagaatgtccaggatgtgctgccggccctgccgaatccagatgactattttctcctgcgttggctccgagccagaagcttcgacctgcagaagtcggaggccatgctccggaagcatgtggagttccgaaagcaaaaggacattgacaacatcattagctggcagcctccagaggtgatccaacagtatctgtcagggggtatgtgtggctatgacctggatggctgcccagtctggtacgacataattggacctctggatgccaagggtctgctgttctcagcctccaaacaggacctgctgaggaccaagatgcgggagtgtgagctgcttctgcaagagtgtgcccaccagaccacaaagttggggaggaaggtggagaccatcaccataatttatgactgcgaggggcttggcctcaagcatctctggaagcctgctgtggaggcctatggagagtttctctgcatgtttgaggaaaattatcccgaaacactgaagcgtctttttgttgttaaagcccccaaactgtttcctgtggcctataacctcatcaaacccttcctgagtgaggacactcgtaagaagatcatggtcctgggagcaaattggaaggaggttttactgaaacatatcagccctgaccaggtgcctgtggagtatgggggcaccatgactgaccctgatggaaaccccaagtgcaaatccaagatcaactacgggggtgacatccccaggaagtattatgtgcgagaccaggtgaaacagcagtatgaacacagcgtgcagatttcccgtggctcctcccaccaagtggagtatgagatcctcttccctggctgtgtcctcaggtggcagtttatgtcagatggagcggatgttggttttgggattttcctgaagaccaagatgggagagaggcagcgggcaggggagatgacagaggtgctgcccaaccagaggtacaactcccacctggtccctgaagatgggaccctcacctgcagtgatcctggcatctagttttgctcttgttgcccaggatggaatgtaatggctcgatctcgactcactgcanccttcgcctcccaggttcaagtgattctcctgcctcagcctcccaagtagctgggattacaggcatgggccaccacgcctggctaattttgtatttttagtagagatggggtttctccgtgttcnttaggctggtcttgaactcccggcctcaggtgatccacccgcctcagcctcccaaagtgctgggattacaggcgtgagccaccacgcccagccaaattgtgtgctttcatcagattctcaagggggtcagttacccaactaaagttaaggagccttatcctggagggtgtctgggggctctgtgagtctatgattagtgtcaaaatgaaccatgcagactctggagctgcaatgactccacttccctctggcctgtggttctctgatcaacccctttcttgtttctgaggccaagtatcttgctaggcagggccattatcgacctagtacttggtgcaatgaatgcaaaggacctctcctccagcatggctgattctggttgctaagactctatcatccagggcagagatgaagcttcactcttgccagagggactattggctctgaaagacctctagtacaggggaaaaatagatgactaacaccttcaccatgaggaaagagtgggtggtgtgtctaccctttgtctaaactatgcattttgtccagggtcaggaaaaggttaagtcttaggattaaatacaggatattttttttcttgctgagaacagtgagagaagaccgggatagggatggggcagaactagtgtttttgttttcacattcagttctcctgaagcggtgtttggctgaaatggaacaacttctcaaagaaacagggttagattaaaagcagcctgttcctctgccaaagtgtggaagctttctctgccaagtgcatgcccattttctctttccagaggaaaccactgctaatgtctattatcctatcaaatatcttccatctagaagcattacatgtttccataataaacagggcatacagtgctcgctttgtcagcacatacactaaaattgaaacaatacagagattagcatggcccctgcgcgaggatgacaatcaggttatcttaaataaataaatagaaaacaggacatacacaaacacacacacacacacacacacacacaatattcacaggaattgtctgtcattcactgtatgtttgaaggaattttgaaactgtcaaactcatcgcaggatttcaggaaactttcccattaggacaagcaccagagtggtatcatcagagaatctgggagtctaagcagacaaagaagtaaagccaaaagtatttttacctatgtagttacaaaaatgttacaaactgtttacatactgttctgcaacttgttttggcctcaggacacattgtggacagtttcctgtcacttctgtggagctaacctcttttttaaaaaatatatcagtattctatcacatggattacaacataaaattgttgaagcaattctcctttgatgaacatttgagttttcccaatctcttattattacaaatagggatgcaacgagcatctctgtccatttacctttttgcaggataaattcctggttcacaaagtttgcacattttaccttttgtcagaaattgaagagggccaggttttccagggtccaagtcaggcagaacaaatgcagcaatgtggaacagacggaaactccagctctgtcatttcctcactgtgtgtcaccagagtcacaccacct

SEQ ID NO: 408656 - DNA, 232 bp, Homo sapiens
aatcgagcccggtacccctagttttagaagtttcactagcatcctctgaaacttccacaggttctctttgtaaagaatccttttctggtcaagtttcttcttcatcactcatgccacttactccattctggaccctccttcagtcaaatgttcctgtgcttcaacctccattacccttggaaatgccaccacccccaggcagcaatgtgctattgaaacttctaaaactagg

SEQ ID NO: 408657 - DNA, 479 bp, Homo sapiens
  misc_feature (53)..(53): n is a, c, g, or t
  misc_feature (64)..(64): n is a, c, g, or t
tgtctgtgtaaccgcgctggttttgcccgcacaagaggatggccgttactatnatacaaagtancctagttttactttttttcttttttgcattgtagtttcagattggagaactggcaaataccctgacaagtaaattcgagtttctaggcattaatagacaatccatctccaactttcatgtgctgctcttacagactgaggtaagtctttttttttttttttttgggcataaacagttaagtttttggaatgaaatgctgtatgtgttaacgattctgtcttgcttacattttaagcctaaatttaaatttttaacccttgaagaatatttgagccgacaatccaggaaataaaactgtgttaaccaaagcacagtaaatagacttttttctcacaatttaaaattatattatcatggtcagatgaggccatgtaatgttgaagttactttgtttaatattaaagcattataagtc

SEQ ID NO: 408658 - DNA, 10155 bp, Homo sapiens
  misc_feature (4113)..(4113): n is a, c, g, or t
gctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacaggtacgcactcttctccccttttcacctttcacctttgacatctcagacatgatttgtgatcaccaccatctgacgacatgacagcctgtctggagactgagagcagctgcagttagcggtgctgggcaggcaaagcaccgcaagcacaaagtttggccagccacacattggagaaacaaaagcaatgtttaaagtgttccatgtaacggattttttcccaagatatggacaaagctggtttttactctccagagtgttgcacggagtagggcgggcttgggggttaagcgcatgcgagagctctgtgcgctttacaggacctctggaagcaactactcctgattaacctcggtgaagttaaggaaaacttcgtggctgaagatgtgaatgaagaacaagattactatcctctgccagcaggtcagatgaaaacatttctttatatatttggcttttcttgatttttttttcgttatttgaaatctttgctcttttatttttcagctcccagatcctctccctctctttagctttcactgtgtttgatatcaagaatatgaaatgtgaattccacggtccaagaggggaagagtcacctttcacaaacttcgttgttctcttctttggaagggaaattagtgttctaggcgattgagtcccttcattaatgaaacttgaaaccctgttatgcattggcaaatcacaaaaaaagagaaaagtgttttctaagtctcatctgttggagtgagagggttcagggctgtattcacagagttgctggcagtgcaaatagctttgaattatccttggttctccattctcaattgtcaaagctctttgttgcctttgtgaatagcagtccattaagaggttcgtccctgtgaaagcagactgctgtcctgggacaggaccaaatggaagtgtctttgtaggagaacgggttttaaaacatgtgttttctttcttgtaatttagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggtgagacaatttaccttgtactaattcagccaaaatgactttagaggaaaaatcttattaatttacattattaaaagattttatgtcataataatataagcttctgattgagaatagtggtgtgaactaaaacaaggaatgcatgagttattatggttggaaatcagcatactattgttatcacgtgtaaaactgtgccccaaagtgaaaagataggctaacagattttgattttaaaaaattgttttataaccattctatcatgccactgactaagctgtgggtctccaaaaataggaatgcttgtgctgaggaactagatagttgaactgtcaatatatgtggcatgctgagatttgttatacatttctatacaacacttagtctgttcatattgcaacctcatttctcacctccactaatcttacaaaaagcgtggttggtacaaatcaaaatgatatgaagaaatgccattagtacttgtttcagagaagcaaaataattgatcatgaaaaatcaccagcaatcttctggtctaaaacaattggcaataggatgtctcattccatttttaaggtactcttggaagaatttagtttagttacatacattttttaaaagataggctttcatgctcctcagttcctttagtttttaaaaagtttccaatgtgtaaagaaacttccacctgttaatcttaagaattggtagctatttgttaaactgatggcatatgaaggcaagagtctatgagtcgtttctaaagtaatagatctttgaaaattttaaaaagtgaaatttgtcaataacagagttaagagctgaattcttttgtctaaaacttatcgaaattgatgcttgtactctactggctccctgatgatagtagaaaagcactagtaatgtaccaaatgaaactggttgtgtaccagatgattttgttaacttcttaaatagcctagaaatcgtcagcaggtcacatacaactgcagtgataatttcagaacatagcaaaaggctgattttattctacttcacattttagaagtgcattttctcaagttacagggcatttcacttcccttttacatgaagagattttcttttgaatatttttcctctcttttggtagcagtgatagacatgactaataatatattggttctttttgtttgctttttagcagttaatgaactgaagaggcttgatcgtagttctggataggtggctccactcctgaccactgtcaacatcccttatatgttccaaagttgaaaattccactgttaccaattctgaatgttctgtgaacactttagatgagtattaagctgttttctccctttatgacacacatagttgatactgtctggtaaaaggaggctcttgagccattcctatttaattaaaacagaactagttgtagtgtaggaaaaagccactgataaaacaggttatattcttaagcctctctttattgagaacccctagaattgcaggataaacttgatcgaagtaaaatccaaatcttanactaagttctgtgagatttaagagcaataatcaacagttctaagcctaataaagagagctcttaatcagctcagtggtggttaaaaccagctatcttttaaagaagagaaaaaacaaaacacagcaatgccctgtctcttcagaaaattgttttaaaaagttagccaggcatagttagtggcccacgcctgtagtccgagctgtttgggaggttgaggtgggaagattggttgagcccaagattttgaggctgcagtaagccataattgtaccactgcactccagcctgagcgacagagaacaagaccctgtctcaaaaataaagtgggggaaggggtgcaaaattacactgtgagaagccaagaagtttcaaagttctatttatttttctaagtcatttttaatcattatttgttgtttcagtgtttgaatttaacattatgtttttaaagatggagtggattctaaagatgagttgggttcaagatatccaacatatcttttatattgggcttatgtcacttaggtgaagttgagctcctttttctttttaatctccatggaacaatttgtataatttcttgatttaaattgctaaactgagctcttcattcaaaatactaaacaataatttctctttggggggaaaattaaggaaggctttctatacatagaaataaagatgcctaggccgggtgcagtggctcatgcctgtaatcccaatactttggggggctgaggcgggtggatcacctgaggtcaagagttcaagaccagcctgggcaacatggtgaaaccctgcctctactaaaagtacaaaaattagctgggcgtggtggcagctgcctgtaatcccagctactcggaggctgaggcacgagaatcacttgaacctgggaggcgaaggttgcagtgaaccaagatcatgccattgcactccagcctgggcgacagagcaaaactctttatctaaaaaaaaaaaaaaaaaaaagacgcctacagaagcaaggttcttaggtgcagtgactcatgcctgtaattccagcactttgggagtttgaggcaagaggatcacttgagctcaggaattcaaaaccagcctgggcaatatggcaagaccccatctttgcagaatattagcctagcttggtagcacgagtatgtggtcctagctacttggaaggctgaggtgggaaggatcacttgagcctggtaggttgaagctgcagtgagctatattcacaccattgcactctagcttgaacaacaaagtgagatcctgtctcaaaaagaaaaaggaaaaattacagctcacggctgtaatcccagcactttgggaggccaaggcgcgcagatcacttgaggtcaggagtttgagaccagccaacatggtatcaccctgtctctactaaaaatacaaaaattagccaggtgtcgtggcgggtgcctgtaatcccagctactcgggaggctgaggcaggagaatcgcttgaacccaggaggcagagattacagtgaaccaagatgacacctctgcactccagcctgggcaacaggcttaaagactccgtcttaaaaaaaaattaagaatttgtattctcataacatattcagttttaagcttgtagcttttaaatctttgagcacgtaataaaagctgcgtaggccaagtgtggtggctcatgcttgtaatcccagcactttgggaggctgaggcaggaggatcacctgaggtcgggagttcaagagcagcttacccaatatgtagaaaccccgcctctactaaaaatacaaaattagccaggcgtggtcgcatgcctgtaatcctagctactcgggaggctgaggcaggagaatcattgaacccaggaggcggaggttgtggtgggccaatatcacaccattgcactccaacctgggcaacaagagcaagagtccatctaaaaaaagagctgtatataccactttaatctgtccttgggcttcagacttaaatattctcttaaacagcaaaaatactaactaagttaaatttaaaagcaaggagaagcatcattgtaatacgacatccatgtgtattcaaactagaattttctgatggtcttcgtaagataaaggagataattgtcatttctatgacacagcttttataatttgaataaacttagttggagattggagtatttttattatttattttcatgtgagatgggtaatgtgctgacctcataacaaagtttgagggagacacattgtatgtgagaatttgaagtgcttatgaagtacaaaagcagaggccaggtgctcacatctgtaatcccagcactttgggaggccaaggcacacagatcacttgaggtcaggagtttgagaccagcctggccaacatggcgaaaacccctctcttactaaaaatacaaaaattagctggatgtggtggtgtgggcctgtaatcccagctactcgcgaggctgaggcaggagaatcgcttgaacctggcaggcagaggttgcggtgagccaagattgcgtcactgcactccggcgtggacaagagagtgagactccgtcacaaaaaaaaaaaaaaaagaagaaaagtattggattcacatattctaaaaatgctcgtcatttgtggctaattttatcaagtctagtttaatctcatatttacagagtttagttaattctaattagctttgttggaggtcataaaccacattattaaccttgaaccgactctgtgtttacttgagttcctctgcataatagcatgtcaccaccatcataaacatgttggtattgcattatgcttctagaggagacatccaccaatatttgaaaatctggctggtccgagtgcagtggtgtttacaactaattgatcacaaccagttacagactttgtttcttctccagtcctgctgcttcacttgactagccttttaaaaaaaagaaagaaaatagagaaaatcttaacttatatttacttactgtatgttgtgattagtttaatagaagggagtttaatccttaataattaagttagtcctcaacgtttattgacttagttctgatgtagtccttgtgtactattgtataatgtagactacttggccatacttgattttgtctaaaagttaatgcataaattaatattaaatatggccaaatataaaagtttaatgagtcatttgaggtcatttagccagaaaactgcatttatgttcctggtgaatttttttcaatgtccttttccaaaagtggcagtaagcagctgtcttaaaataaggagacagtgggaatgatgttgttaaagtcttttatacaatgtattgtctgtctgttccataaaaagtaaaactactctattcgtgaccagcttgggcaacatagtgagactgtctctttaaaaaaaaaaaaaaaattaaaaattagcaggtgtggtgatgcacacctgtagtcctagcaattcgggaagctgaggtaggaagatcgcttgagccaagtgtttgaggttagaatgagctatgatcgcaccacctacactccagcctgggcaacagagcaagacccaaatggctcatggttgctttgtttgttttaccttgttgagtgccagtgtgtattttgagcaaagcagtgtaaatggccttcttgccctagagtctttcataattgagccttatttaatctaccacttttgaccatgaaatttaacaggtgacttcttctgggtatctactccaggtgaagtgatattttttttgactgagatgtctaaagctcttggattcctggtatctcaccaggacatcttagtaaaacagcaagtatcagatgaggaatcagacttgagttctagctctggtctggccactaacattgatatgatcttgggcaagttagttcctgcctgggtttcattacctttaactgaggaggttgaaatagatgatttctcatgtctcttctactcctaaattctatgattttagggagaaaatccccttcaacattcctgggatatatatctaatagtcccatatattgtgaaacttccctattgacgataaagagggctggggaaggctacaagttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccaccagctcccaaaatgccaccacctgaaaagacaaaaaaaggaaggaaagacaaggcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaaatgctaattttgaagcccttcctgaggattggagagcaaggctgaagagaaggaaaatggctccaaacacatagtttttaagtttttaaaacttttttgtattattgtttgttttgtgttcagttcaaagtcttaaccagttttattgtcaaataaactataaatgttatgggggagatcttataaatttcctgggcaagagtgtatgcatacaaagttttcacttttgtgaaatgtaatttttctgtttttgcaaagggatgaggtgattggaattgctttgaccatgctgcctttattctcaaactggcaaacttagcatgttaggtgtattaacctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcaggtaaaagtcactttaaactgaggaaacggcaaattgtgttttaaagctctttgtatttctccagtttctgaccttgtaaatttgtatatatgcactaataaagctttttttataa

SEQ ID NO: 408659 - DNA, 10071 bp, Homo sapiens
  misc_feature (4029)..(4029): n is a, c, g, or t
gctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacaggtacgcactcttctccccttttcacctttcacctttgacatctcagacatgatttgtgatcaccaccatctgacgacatgacagcctgtctggagactgagagcagctgcagttagcggtgctgggcaggcaaagcaccgcaagcacaaagtttggccagccacacattggagaaacaaaagcaatgtttaaagtgttccatgtaacggattttttcccaagatatggacaaagctggtttttactctccagagtgttgcacggagtagggcgggcttgggggttaagcgcatgcgagagctctgtgcgctttacaggacctctggaagcaactactcctgattaacctcggtgaagttaaggaaaacttcgtggctgaagatgtgaatgaagaacaagattactatcctctgccagcagctcccagatcctctccctctctttagctttcactgtgtttgatatcaagaatatgaaatgtgaattccacggtccaagaggggaagagtcacctttcacaaacttcgttgttctcttctttggaagggaaattagtgttctaggcgattgagtcccttcattaatgaaacttgaaaccctgttatgcattggcaaatcacaaaaaaagagaaaagtgttttctaagtctcatctgttggagtgagagggttcagggctgtattcacagagttgctggcagtgcaaatagctttgaattatccttggttctccattctcaattgtcaaagctctttgttgcctttgtgaatagcagtccattaagaggttcgtccctgtgaaagcagactgctgtcctgggacaggaccaaatggaagtgtctttgtaggagaacgggttttaaaacatgtgttttctttcttgtaatttagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggtgagacaatttaccttgtactaattcagccaaaatgactttagaggaaaaatcttattaatttacattattaaaagattttatgtcataataatataagcttctgattgagaatagtggtgtgaactaaaacaaggaatgcatgagttattatggttggaaatcagcatactattgttatcacgtgtaaaactgtgccccaaagtgaaaagataggctaacagattttgattttaaaaaattgttttataaccattctatcatgccactgactaagctgtgggtctccaaaaataggaatgcttgtgctgaggaactagatagttgaactgtcaatatatgtggcatgctgagatttgttatacatttctatacaacacttagtctgttcatattgcaacctcatttctcacctccactaatcttacaaaaagcgtggttggtacaaatcaaaatgatatgaagaaatgccattagtacttgtttcagagaagcaaaataattgatcatgaaaaatcaccagcaatcttctggtctaaaacaattggcaataggatgtctcattccatttttaaggtactcttggaagaatttagtttagttacatacattttttaaaagataggctttcatgctcctcagttcctttagtttttaaaaagtttccaatgtgtaaagaaacttccacctgttaatcttaagaattggtagctatttgttaaactgatggcatatgaaggcaagagtctatgagtcgtttctaaagtaatagatctttgaaaattttaaaaagtgaaatttgtcaataacagagttaagagctgaattcttttgtctaaaacttatcgaaattgatgcttgtactctactggctccctgatgatagtagaaaagcactagtaatgtaccaaatgaaactggttgtgtaccagatgattttgttaacttcttaaatagcctagaaatcgtcagcaggtcacatacaactgcagtgataatttcagaacatagcaaaaggctgattttattctacttcacattttagaagtgcattttctcaagttacagggcatttcacttcccttttacatgaagagattttcttttgaatatttttcctctcttttggtagcagtgatagacatgactaataatatattggttctttttgtttgctttttagcagttaatgaactgaagaggcttgatcgtagttctggataggtggctccactcctgaccactgtcaacatcccttatatgttccaaagttgaaaattccactgttaccaattctgaatgttctgtgaacactttagatgagtattaagctgttttctccctttatgacacacatagttgatactgtctggtaaaaggaggctcttgagccattcctatttaattaaaacagaactagttgtagtgtaggaaaaagccactgataaaacaggttatattcttaagcctctctttattgagaacccctagaattgcaggataaacttgatcgaagtaaaatccaaatcttanactaagttctgtgagatttaagagcaataatcaacagttctaagcctaataaagagagctcttaatcagctcagtggtggttaaaaccagctatcttttaaagaagagaaaaaacaaaacacagcaatgccctgtctcttcagaaaattgttttaaaaagttagccaggcatagttagtggcccacgcctgtagtccgagctgtttgggaggttgaggtgggaagattggttgagcccaagattttgaggctgcagtaagccataattgtaccactgcactccagcctgagcgacagagaacaagaccctgtctcaaaaataaagtgggggaaggggtgcaaaattacactgtgagaagccaagaagtttcaaagttctatttatttttctaagtcatttttaatcattatttgttgtttcagtgtttgaatttaacattatgtttttaaagatggagtggattctaaagatgagttgggttcaagatatccaacatatcttttatattgggcttatgtcacttaggtgaagttgagctcctttttctttttaatctccatggaacaatttgtataatttcttgatttaaattgctaaactgagctcttcattcaaaatactaaacaataatttctctttggggggaaaattaaggaaggctttctatacatagaaataaagatgcctaggccgggtgcagtggctcatgcctgtaatcccaatactttggggggctgaggcgggtggatcacctgaggtcaagagttcaagaccagcctgggcaacatggtgaaaccctgcctctactaaaagtacaaaaattagctgggcgtggtggcagctgcctgtaatcccagctactcggaggctgaggcacgagaatcacttgaacctgggaggcgaaggttgcagtgaaccaagatcatgccattgcactccagcctgggcgacagagcaaaactctttatctaaaaaaaaaaaaaaaaaaaagacgcctacagaagcaaggttcttaggtgcagtgactcatgcctgtaattccagcactttgggagtttgaggcaagaggatcacttgagctcaggaattcaaaaccagcctgggcaatatggcaagaccccatctttgcagaatattagcctagcttggtagcacgagtatgtggtcctagctacttggaaggctgaggtgggaaggatcacttgagcctggtaggttgaagctgcagtgagctatattcacaccattgcactctagcttgaacaacaaagtgagatcctgtctcaaaaagaaaaaggaaaaattacagctcacggctgtaatcccagcactttgggaggccaaggcgcgcagatcacttgaggtcaggagtttgagaccagccaacatggtatcaccctgtctctactaaaaatacaaaaattagccaggtgtcgtggcgggtgcctgtaatcccagctactcgggaggctgaggcaggagaatcgcttgaacccaggaggcagagattacagtgaaccaagatgacacctctgcactccagcctgggcaacaggcttaaagactccgtcttaaaaaaaaattaagaatttgtattctcataacatattcagttttaagcttgtagcttttaaatctttgagcacgtaataaaagctgcgtaggccaagtgtggtggctcatgcttgtaatcccagcactttgggaggctgaggcaggaggatcacctgaggtcgggagttcaagagcagcttacccaatatgtagaaaccccgcctctactaaaaatacaaaattagccaggcgtggtcgcatgcctgtaatcctagctactcgggaggctgaggcaggagaatcattgaacccaggaggcggaggttgtggtgggccaatatcacaccattgcactccaacctgggcaacaagagcaagagtccatctaaaaaaagagctgtatataccactttaatctgtccttgggcttcagacttaaatattctcttaaacagcaaaaatactaactaagttaaatttaaaagcaaggagaagcatcattgtaatacgacatccatgtgtattcaaactagaattttctgatggtcttcgtaagataaaggagataattgtcatttctatgacacagcttttataatttgaataaacttagttggagattggagtatttttattatttattttcatgtgagatgggtaatgtgctgacctcataacaaagtttgagggagacacattgtatgtgagaatttgaagtgcttatgaagtacaaaagcagaggccaggtgctcacatctgtaatcccagcactttgggaggccaaggcacacagatcacttgaggtcaggagtttgagaccagcctggccaacatggcgaaaacccctctcttactaaaaatacaaaaattagctggatgtggtggtgtgggcctgtaatcccagctactcgcgaggctgaggcaggagaatcgcttgaacctggcaggcagaggttgcggtgagccaagattgcgtcactgcactccggcgtggacaagagagtgagactccgtcacaaaaaaaaaaaaaaaagaagaaaagtattggattcacatattctaaaaatgctcgtcatttgtggctaattttatcaagtctagtttaatctcatatttacagagtttagttaattctaattagctttgttggaggtcataaaccacattattaaccttgaaccgactctgtgtttacttgagttcctctgcataatagcatgtcaccaccatcataaacatgttggtattgcattatgcttctagaggagacatccaccaatatttgaaaatctggctggtccgagtgcagtggtgtttacaactaattgatcacaaccagttacagactttgtttcttctccagtcctgctgcttcacttgactagccttttaaaaaaaagaaagaaaatagagaaaatcttaacttatatttacttactgtatgttgtgattagtttaatagaagggagtttaatccttaataattaagttagtcctcaacgtttattgacttagttctgatgtagtccttgtgtactattgtataatgtagactacttggccatacttgattttgtctaaaagttaatgcataaattaatattaaatatggccaaatataaaagtttaatgagtcatttgaggtcatttagccagaaaactgcatttatgttcctggtgaatttttttcaatgtccttttccaaaagtggcagtaagcagctgtcttaaaataaggagacagtgggaatgatgttgttaaagtcttttatacaatgtattgtctgtctgttccataaaaagtaaaactactctattcgtgaccagcttgggcaacatagtgagactgtctctttaaaaaaaaaaaaaaaattaaaaattagcaggtgtggtgatgcacacctgtagtcctagcaattcgggaagctgaggtaggaagatcgcttgagccaagtgtttgaggttagaatgagctatgatcgcaccacctacactccagcctgggcaacagagcaagacccaaatggctcatggttgctttgtttgttttaccttgttgagtgccagtgtgtattttgagcaaagcagtgtaaatggccttcttgccctagagtctttcataattgagccttatttaatctaccacttttgaccatgaaatttaacaggtgacttcttctgggtatctactccaggtgaagtgatattttttttgactgagatgtctaaagctcttggattcctggtatctcaccaggacatcttagtaaaacagcaagtatcagatgaggaatcagacttgagttctagctctggtctggccactaacattgatatgatcttgggcaagttagttcctgcctgggtttcattacctttaactgaggaggttgaaatagatgatttctcatgtctcttctactcctaaattctatgattttagggagaaaatccccttcaacattcctgggatatatatctaatagtcccatatattgtgaaacttccctattgacgataaagagggctggggaaggctacaagttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccaccagctcccaaaatgccaccacctgaaaagacaaaaaaaggaaggaaagacaaggcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaaatgctaattttgaagcccttcctgaggattggagagcaaggctgaagagaaggaaaatggctccaaacacatagtttttaagtttttaaaacttttttgtattattgtttgttttgtgttcagttcaaagtcttaaccagttttattgtcaaataaactataaatgttatgggggagatcttataaatttcctgggcaagagtgtatgcatacaaagttttcacttttgtgaaatgtaatttttctgtttttgcaaagggatgaggtgattggaattgctttgaccatgctgcctttattctcaaactggcaaacttagcatgttaggtgtattaacctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcaggtaaaagtcactttaaactgaggaaacggcaaattgtgttttaaagctctttgtatttctccagtttctgaccttgtaaatttgtatatatgcactaataaagctttttttataa

SEQ ID NO: 408660 - DNA, 9180 bp, Homo sapiens
  misc_feature (3138)..(3138): n is a, c, g, or t
gctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggtgagacaatttaccttgtactaattcagccaaaatgactttagaggaaaaatcttattaatttacattattaaaagattttatgtcataataatataagcttctgattgagaatagtggtgtgaactaaaacaaggaatgcatgagttattatggttggaaatcagcatactattgttatcacgtgtaaaactgtgccccaaagtgaaaagataggctaacagattttgattttaaaaaattgttttataaccattctatcatgccactgactaagctgtgggtctccaaaaataggaatgcttgtgctgaggaactagatagttgaactgtcaatatatgtggcatgctgagatttgttatacatttctatacaacacttagtctgttcatattgcaacctcatttctcacctccactaatcttacaaaaagcgtggttggtacaaatcaaaatgatatgaagaaatgccattagtacttgtttcagagaagcaaaataattgatcatgaaaaatcaccagcaatcttctggtctaaaacaattggcaataggatgtctcattccatttttaaggtactcttggaagaatttagtttagttacatacattttttaaaagataggctttcatgctcctcagttcctttagtttttaaaaagtttccaatgtgtaaagaaacttccacctgttaatcttaagaattggtagctatttgttaaactgatggcatatgaaggcaagagtctatgagtcgtttctaaagtaatagatctttgaaaattttaaaaagtgaaatttgtcaataacagagttaagagctgaattcttttgtctaaaacttatcgaaattgatgcttgtactctactggctccctgatgatagtagaaaagcactagtaatgtaccaaatgaaactggttgtgtaccagatgattttgttaacttcttaaatagcctagaaatcgtcagcaggtcacatacaactgcagtgataatttcagaacatagcaaaaggctgattttattctacttcacattttagaagtgcattttctcaagttacagggcatttcacttcccttttacatgaagagattttcttttgaatatttttcctctcttttggtagcagtgatagacatgactaataatatattggttctttttgtttgctttttagcagttaatgaactgaagaggcttgatcgtagttctggataggtggctccactcctgaccactgtcaacatcccttatatgttccaaagttgaaaattccactgttaccaattctgaatgttctgtgaacactttagatgagtattaagctgttttctccctttatgacacacatagttgatactgtctggtaaaaggaggctcttgagccattcctatttaattaaaacagaactagttgtagtgtaggaaaaagccactgataaaacaggttatattcttaagcctctctttattgagaacccctagaattgcaggataaacttgatcgaagtaaaatccaaatcttanactaagttctgtgagatttaagagcaataatcaacagttctaagcctaataaagagagctcttaatcagctcagtggtggttaaaaccagctatcttttaaagaagagaaaaaacaaaacacagcaatgccctgtctcttcagaaaattgttttaaaaagttagccaggcatagttagtggcccacgcctgtagtccgagctgtttgggaggttgaggtgggaagattggttgagcccaagattttgaggctgcagtaagccataattgtaccactgcactccagcctgagcgacagagaacaagaccctgtctcaaaaataaagtgggggaaggggtgcaaaattacactgtgagaagccaagaagtttcaaagttctatttatttttctaagtcatttttaatcattatttgttgtttcagtgtttgaatttaacattatgtttttaaagatggagtggattctaaagatgagttgggttcaagatatccaacatatcttttatattgggcttatgtcacttaggtgaagttgagctcctttttctttttaatctccatggaacaatttgtataatttcttgatttaaattgctaaactgagctcttcattcaaaatactaaacaataatttctctttggggggaaaattaaggaaggctttctatacatagaaataaagatgcctaggccgggtgcagtggctcatgcctgtaatcccaatactttggggggctgaggcgggtggatcacctgaggtcaagagttcaagaccagcctgggcaacatggtgaaaccctgcctctactaaaagtacaaaaattagctgggcgtggtggcagctgcctgtaatcccagctactcggaggctgaggcacgagaatcacttgaacctgggaggcgaaggttgcagtgaaccaagatcatgccattgcactccagcctgggcgacagagcaaaactctttatctaaaaaaaaaaaaaaaaaaaagacgcctacagaagcaaggttcttaggtgcagtgactcatgcctgtaattccagcactttgggagtttgaggcaagaggatcacttgagctcaggaattcaaaaccagcctgggcaatatggcaagaccccatctttgcagaatattagcctagcttggtagcacgagtatgtggtcctagctacttggaaggctgaggtgggaaggatcacttgagcctggtaggttgaagctgcagtgagctatattcacaccattgcactctagcttgaacaacaaagtgagatcctgtctcaaaaagaaaaaggaaaaattacagctcacggctgtaatcccagcactttgggaggccaaggcgcgcagatcacttgaggtcaggagtttgagaccagccaacatggtatcaccctgtctctactaaaaatacaaaaattagccaggtgtcgtggcgggtgcctgtaatcccagctactcgggaggctgaggcaggagaatcgcttgaacccaggaggcagagattacagtgaaccaagatgacacctctgcactccagcctgggcaacaggcttaaagactccgtcttaaaaaaaaattaagaatttgtattctcataacatattcagttttaagcttgtagcttttaaatctttgagcacgtaataaaagctgcgtaggccaagtgtggtggctcatgcttgtaatcccagcactttgggaggctgaggcaggaggatcacctgaggtcgggagttcaagagcagcttacccaatatgtagaaaccccgcctctactaaaaatacaaaattagccaggcgtggtcgcatgcctgtaatcctagctactcgggaggctgaggcaggagaatcattgaacccaggaggcggaggttgtggtgggccaatatcacaccattgcactccaacctgggcaacaagagcaagagtccatctaaaaaaagagctgtatataccactttaatctgtccttgggcttcagacttaaatattctcttaaacagcaaaaatactaactaagttaaatttaaaagcaaggagaagcatcattgtaatacgacatccatgtgtattcaaactagaattttctgatggtcttcgtaagataaaggagataattgtcatttctatgacacagcttttataatttgaataaacttagttggagattggagtatttttattatttattttcatgtgagatgggtaatgtgctgacctcataacaaagtttgagggagacacattgtatgtgagaatttgaagtgcttatgaagtacaaaagcagaggccaggtgctcacatctgtaatcccagcactttgggaggccaaggcacacagatcacttgaggtcaggagtttgagaccagcctggccaacatggcgaaaacccctctcttactaaaaatacaaaaattagctggatgtggtggtgtgggcctgtaatcccagctactcgcgaggctgaggcaggagaatcgcttgaacctggcaggcagaggttgcggtgagccaagattgcgtcactgcactccggcgtggacaagagagtgagactccgtcacaaaaaaaaaaaaaaaagaagaaaagtattggattcacatattctaaaaatgctcgtcatttgtggctaattttatcaagtctagtttaatctcatatttacagagtttagttaattctaattagctttgttggaggtcataaaccacattattaaccttgaaccgactctgtgtttacttgagttcctctgcataatagcatgtcaccaccatcataaacatgttggtattgcattatgcttctagaggagacatccaccaatatttgaaaatctggctggtccgagtgcagtggtgtttacaactaattgatcacaaccagttacagactttgtttcttctccagtcctgctgcttcacttgactagccttttaaaaaaaagaaagaaaatagagaaaatcttaacttatatttacttactgtatgttgtgattagtttaatagaagggagtttaatccttaataattaagttagtcctcaacgtttattgacttagttctgatgtagtccttgtgtactattgtataatgtagactacttggccatacttgattttgtctaaaagttaatgcataaattaatattaaatatggccaaatataaaagtttaatgagtcatttgaggtcatttagccagaaaactgcatttatgttcctggtgaatttttttcaatgtccttttccaaaagtggcagtaagcagctgtcttaaaataaggagacagtgggaatgatgttgttaaagtcttttatacaatgtattgtctgtctgttccataaaaagtaaaactactctattcgtgaccagcttgggcaacatagtgagactgtctctttaaaaaaaaaaaaaaaattaaaaattagcaggtgtggtgatgcacacctgtagtcctagcaattcgggaagctgaggtaggaagatcgcttgagccaagtgtttgaggttagaatgagctatgatcgcaccacctacactccagcctgggcaacagagcaagacccaaatggctcatggttgctttgtttgttttaccttgttgagtgccagtgtgtattttgagcaaagcagtgtaaatggccttcttgccctagagtctttcataattgagccttatttaatctaccacttttgaccatgaaatttaacaggtgacttcttctgggtatctactccaggtgaagtgatattttttttgactgagatgtctaaagctcttggattcctggtatctcaccaggacatcttagtaaaacagcaagtatcagatgaggaatcagacttgagttctagctctggtctggccactaacattgatatgatcttgggcaagttagttcctgcctgggtttcattacctttaactgaggaggttgaaatagatgatttctcatgtctcttctactcctaaattctatgattttagggagaaaatccccttcaacattcctgggatatatatctaatagtcccatatattgtgaaacttccctattgacgataaagagggctggggaaggctacaagttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccaccagctcccaaaatgccaccacctgaaaagacaaaaaaaggaaggaaagacaaggcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaaatgctaattttgaagcccttcctgaggattggagagcaaggctgaagagaaggaaaatggctccaaacacatagtttttaagtttttaaaacttttttgtattattgtttgttttgtgttcagttcaaagtcttaaccagttttattgtcaaataaactataaatgttatgggggagatcttataaatttcctgggcaagagtgtatgcatacaaagttttcacttttgtgaaatgtaatttttctgtttttgcaaagggatgaggtgattggaattgctttgaccatgctgcctttattctcaaactggcaaacttagcatgttaggtgtattaacctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcaggtaaaagtcactttaaactgaggaaacggcaaattgtgttttaaagctctttgtatttctccagtttctgaccttgtaaatttgtatatatgcactaataaagctttttttataa

SEQ ID NO: 408661 - DNA, 9814 bp, Homo sapiens
  misc_feature (4113)..(4113): n is a, c, g, or t
gctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacaggtacgcactcttctccccttttcacctttcacctttgacatctcagacatgatttgtgatcaccaccatctgacgacatgacagcctgtctggagactgagagcagctgcagttagcggtgctgggcaggcaaagcaccgcaagcacaaagtttggccagccacacattggagaaacaaaagcaatgtttaaagtgttccatgtaacggattttttcccaagatatggacaaagctggtttttactctccagagtgttgcacggagtagggcgggcttgggggttaagcgcatgcgagagctctgtgcgctttacaggacctctggaagcaactactcctgattaacctcggtgaagttaaggaaaacttcgtggctgaagatgtgaatgaagaacaagattactatcctctgccagcaggtcagatgaaaacatttctttatatatttggcttttcttgatttttttttcgttatttgaaatctttgctcttttatttttcagctcccagatcctctccctctctttagctttcactgtgtttgatatcaagaatatgaaatgtgaattccacggtccaagaggggaagagtcacctttcacaaacttcgttgttctcttctttggaagggaaattagtgttctaggcgattgagtcccttcattaatgaaacttgaaaccctgttatgcattggcaaatcacaaaaaaagagaaaagtgttttctaagtctcatctgttggagtgagagggttcagggctgtattcacagagttgctggcagtgcaaatagctttgaattatccttggttctccattctcaattgtcaaagctctttgttgcctttgtgaatagcagtccattaagaggttcgtccctgtgaaagcagactgctgtcctgggacaggaccaaatggaagtgtctttgtaggagaacgggttttaaaacatgtgttttctttcttgtaatttagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggtgagacaatttaccttgtactaattcagccaaaatgactttagaggaaaaatcttattaatttacattattaaaagattttatgtcataataatataagcttctgattgagaatagtggtgtgaactaaaacaaggaatgcatgagttattatggttggaaatcagcatactattgttatcacgtgtaaaactgtgccccaaagtgaaaagataggctaacagattttgattttaaaaaattgttttataaccattctatcatgccactgactaagctgtgggtctccaaaaataggaatgcttgtgctgaggaactagatagttgaactgtcaatatatgtggcatgctgagatttgttatacatttctatacaacacttagtctgttcatattgcaacctcatttctcacctccactaatcttacaaaaagcgtggttggtacaaatcaaaatgatatgaagaaatgccattagtacttgtttcagagaagcaaaataattgatcatgaaaaatcaccagcaatcttctggtctaaaacaattggcaataggatgtctcattccatttttaaggtactcttggaagaatttagtttagttacatacattttttaaaagataggctttcatgctcctcagttcctttagtttttaaaaagtttccaatgtgtaaagaaacttccacctgttaatcttaagaattggtagctatttgttaaactgatggcatatgaaggcaagagtctatgagtcgtttctaaagtaatagatctttgaaaattttaaaaagtgaaatttgtcaataacagagttaagagctgaattcttttgtctaaaacttatcgaaattgatgcttgtactctactggctccctgatgatagtagaaaagcactagtaatgtaccaaatgaaactggttgtgtaccagatgattttgttaacttcttaaatagcctagaaatcgtcagcaggtcacatacaactgcagtgataatttcagaacatagcaaaaggctgattttattctacttcacattttagaagtgcattttctcaagttacagggcatttcacttcccttttacatgaagagattttcttttgaatatttttcctctcttttggtagcagtgatagacatgactaataatatattggttctttttgtttgctttttagcagttaatgaactgaagaggcttgatcgtagttctggataggtggctccactcctgaccactgtcaacatcccttatatgttccaaagttgaaaattccactgttaccaattctgaatgttctgtgaacactttagatgagtattaagctgttttctccctttatgacacacatagttgatactgtctggtaaaaggaggctcttgagccattcctatttaattaaaacagaactagttgtagtgtaggaaaaagccactgataaaacaggttatattcttaagcctctctttattgagaacccctagaattgcaggataaacttgatcgaagtaaaatccaaatcttanactaagttctgtgagatttaagagcaataatcaacagttctaagcctaataaagagagctcttaatcagctcagtggtggttaaaaccagctatcttttaaagaagagaaaaaacaaaacacagcaatgccctgtctcttcagaaaattgttttaaaaagttagccaggcatagttagtggcccacgcctgtagtccgagctgtttgggaggttgaggtgggaagattggttgagcccaagattttgaggctgcagtaagccataattgtaccactgcactccagcctgagcgacagagaacaagaccctgtctcaaaaataaagtgggggaaggggtgcaaaattacactgtgagaagccaagaagtttcaaagttctatttatttttctaagtcatttttaatcattatttgttgtttcagtgtttgaatttaacattatgtttttaaagatggagtggattctaaagatgagttgggttcaagatatccaacatatcttttatattgggcttatgtcacttaggtgaagttgagctcctttttctttttaatctccatggaacaatttgtataatttcttgatttaaattgctaaactgagctcttcattcaaaatactaaacaataatttctctttggggggaaaattaaggaaggctttctatacatagaaataaagatgcctaggccgggtgcagtggctcatgcctgtaatcccaatactttggggggctgaggcgggtggatcacctgaggtcaagagttcaagaccagcctgggcaacatggtgaaaccctgcctctactaaaagtacaaaaattagctgggcgtggtggcagctgcctgtaatcccagctactcggaggctgaggcacgagaatcacttgaacctgggaggcgaaggttgcagtgaaccaagatcatgccattgcactccagcctgggcgacagagcaaaactctttatctaaaaaaaaaaaaaaaaaaaagacgcctacagaagcaaggttcttaggtgcagtgactcatgcctgtaattccagcactttgggagtttgaggcaagaggatcacttgagctcaggaattcaaaaccagcctgggcaatatggcaagaccccatctttgcagaatattagcctagcttggtagcacgagtatgtggtcctagctacttggaaggctgaggtgggaaggatcacttgagcctggtaggttgaagctgcagtgagctatattcacaccattgcactctagcttgaacaacaaagtgagatcctgtctcaaaaagaaaaaggaaaaattacagctcacggctgtaatcccagcactttgggaggccaaggcgcgcagatcacttgaggtcaggagtttgagaccagccaacatggtatcaccctgtctctactaaaaatacaaaaattagccaggtgtcgtggcgggtgcctgtaatcccagctactcgggaggctgaggcaggagaatcgcttgaacccaggaggcagagattacagtgaaccaagatgacacctctgcactccagcctgggcaacaggcttaaagactccgtcttaaaaaaaaattaagaatttgtattctcataacatattcagttttaagcttgtagcttttaaatctttgagcacgtaataaaagctgcgtaggccaagtgtggtggctcatgcttgtaatcccagcactttgggaggctgaggcaggaggatcacctgaggtcgggagttcaagagcagcttacccaatatgtagaaaccccgcctctactaaaaatacaaaattagccaggcgtggtcgcatgcctgtaatcctagctactcgggaggctgaggcaggagaatcattgaacccaggaggcggaggttgtggtgggccaatatcacaccattgcactccaacctgggcaacaagagcaagagtccatctaaaaaaagagctgtatataccactttaatctgtccttgggcttcagacttaaatattctcttaaacagcaaaaatactaactaagttaaatttaaaagcaaggagaagcatcattgtaatacgacatccatgtgtattcaaactagaattttctgatggtcttcgtaagataaaggagataattgtcatttctatgacacagcttttataatttgaataaacttagttggagattggagtatttttattatttattttcatgtgagatgggtaatgtgctgacctcataacaaagtttgagggagacacattgtatgtgagaatttgaagtgcttatgaagtacaaaagcagaggccaggtgctcacatctgtaatcccagcactttgggaggccaaggcacacagatcacttgaggtcaggagtttgagaccagcctggccaacatggcgaaaacccctctcttactaaaaatacaaaaattagctggatgtggtggtgtgggcctgtaatcccagctactcgcgaggctgaggcaggagaatcgcttgaacctggcaggcagaggttgcggtgagccaagattgcgtcactgcactccggcgtggacaagagagtgagactccgtcacaaaaaaaaaaaaaaaagaagaaaagtattggattcacatattctaaaaatgctcgtcatttgtggctaattttatcaagtctagtttaatctcatatttacagagtttagttaattctaattagctttgttggaggtcataaaccacattattaaccttgaaccgactctgtgtttacttgagttcctctgcataatagcatgtcaccaccatcataaacatgttggtattgcattatgcttctagaggagacatccaccaatatttgaaaatctggctggtccgagtgcagtggtgtttacaactaattgatcacaaccagttacagactttgtttcttctccagtcctgctgcttcacttgactagccttttaaaaaaaagaaagaaaatagagaaaatcttaacttatatttacttactgtatgttgtgattagtttaatagaagggagtttaatccttaataattaagttagtcctcaacgtttattgacttagttctgatgtagtccttgtgtactattgtataatgtagactacttggccatacttgattttgtctaaaagttaatgcataaattaatattaaatatggccaaatataaaagtttaatgagtcatttgaggtcatttagccagaaaactgcatttatgttcctggtgaatttttttcaatgtccttttccaaaagtggcagtaagcagctgtcttaaaataaggagacagtgggaatgatgttgttaaagtcttttatacaatgtattgtctgtctgttccataaaaagtaaaactactctattcgtgaccagcttgggcaacatagtgagactgtctctttaaaaaaaaaaaaaaaattaaaaattagcaggtgtggtgatgcacacctgtagtcctagcaattcgggaagctgaggtaggaagatcgcttgagccaagtgtttgaggttagaatgagctatgatcgcaccacctacactccagcctgggcaacagagcaagacccaaatggctcatggttgctttgtttgttttaccttgttgagtgccagtgtgtattttgagcaaagcagtgtaaatggccttcttgccctagagtctttcataattgagccttatttaatctaccacttttgaccatgaaatttaacaggtgacttcttctgggtatctactccaggtgaagtgatattttttttgactgagatgtctaaagctcttggattcctggtatctcaccaggacatcttagtaaaacagcaagtatcagatgaggaatcagacttgagttctagctctggtctggccactaacattgatatgatcttgggcaagttagttcctgcctgggtttcattacctttaactgaggaggttgaaatagatgatttctcatgtctcttctactcctaaattctatgattttagggagaaaatccccttcaacattcctgggatatatatctaatagtcccatatattgtgaaacttccctattgacgataaagagggctggggaaggctacaagttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaaatgctaattttgaagcccttcctgaggattggagagcaaggctgaagagaaggaaaatggctccaaacacatagtttttaagtttttaaaacttttttgtattattgtttgttttgtgttcagttcaaagtcttaaccagttttattgtcaaataaactataaatgttatgggggagatcttataaatttcctgggcaagagtgtatgcatacaaagttttcacttttgtgaaatgtaatttttctgtttttgcaaagggatgaggtgattggaattgctttgaccatgctgcctttattctcaaactggcaaacttagcatgttaggtgtattaacctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcaggtaaaagtcactttaaactgaggaaacggcaaattgtgttttaaagctctttgtatttctccagtttctgaccttgtaaatttgtatatatgcactaataaagctttttttataa

SEQ ID NO: 408662 - DNA, 10306 bp, Homo sapiens
  misc_feature (4113)..(4113): n is a, c, g, or t
gctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacaggtacgcactcttctccccttttcacctttcacctttgacatctcagacatgatttgtgatcaccaccatctgacgacatgacagcctgtctggagactgagagcagctgcagttagcggtgctgggcaggcaaagcaccgcaagcacaaagtttggccagccacacattggagaaacaaaagcaatgtttaaagtgttccatgtaacggattttttcccaagatatggacaaagctggtttttactctccagagtgttgcacggagtagggcgggcttgggggttaagcgcatgcgagagctctgtgcgctttacaggacctctggaagcaactactcctgattaacctcggtgaagttaaggaaaacttcgtggctgaagatgtgaatgaagaacaagattactatcctctgccagcaggtcagatgaaaacatttctttatatatttggcttttcttgatttttttttcgttatttgaaatctttgctcttttatttttcagctcccagatcctctccctctctttagctttcactgtgtttgatatcaagaatatgaaatgtgaattccacggtccaagaggggaagagtcacctttcacaaacttcgttgttctcttctttggaagggaaattagtgttctaggcgattgagtcccttcattaatgaaacttgaaaccctgttatgcattggcaaatcacaaaaaaagagaaaagtgttttctaagtctcatctgttggagtgagagggttcagggctgtattcacagagttgctggcagtgcaaatagctttgaattatccttggttctccattctcaattgtcaaagctctttgttgcctttgtgaatagcagtccattaagaggttcgtccctgtgaaagcagactgctgtcctgggacaggaccaaatggaagtgtctttgtaggagaacgggttttaaaacatgtgttttctttcttgtaatttagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggtgagacaatttaccttgtactaattcagccaaaatgactttagaggaaaaatcttattaatttacattattaaaagattttatgtcataataatataagcttctgattgagaatagtggtgtgaactaaaacaaggaatgcatgagttattatggttggaaatcagcatactattgttatcacgtgtaaaactgtgccccaaagtgaaaagataggctaacagattttgattttaaaaaattgttttataaccattctatcatgccactgactaagctgtgggtctccaaaaataggaatgcttgtgctgaggaactagatagttgaactgtcaatatatgtggcatgctgagatttgttatacatttctatacaacacttagtctgttcatattgcaacctcatttctcacctccactaatcttacaaaaagcgtggttggtacaaatcaaaatgatatgaagaaatgccattagtacttgtttcagagaagcaaaataattgatcatgaaaaatcaccagcaatcttctggtctaaaacaattggcaataggatgtctcattccatttttaaggtactcttggaagaatttagtttagttacatacattttttaaaagataggctttcatgctcctcagttcctttagtttttaaaaagtttccaatgtgtaaagaaacttccacctgttaatcttaagaattggtagctatttgttaaactgatggcatatgaaggcaagagtctatgagtcgtttctaaagtaatagatctttgaaaattttaaaaagtgaaatttgtcaataacagagttaagagctgaattcttttgtctaaaacttatcgaaattgatgcttgtactctactggctccctgatgatagtagaaaagcactagtaatgtaccaaatgaaactggttgtgtaccagatgattttgttaacttcttaaatagcctagaaatcgtcagcaggtcacatacaactgcagtgataatttcagaacatagcaaaaggctgattttattctacttcacattttagaagtgcattttctcaagttacagggcatttcacttcccttttacatgaagagattttcttttgaatatttttcctctcttttggtagcagtgatagacatgactaataatatattggttctttttgtttgctttttagcagttaatgaactgaagaggcttgatcgtagttctggataggtggctccactcctgaccactgtcaacatcccttatatgttccaaagttgaaaattccactgttaccaattctgaatgttctgtgaacactttagatgagtattaagctgttttctccctttatgacacacatagttgatactgtctggtaaaaggaggctcttgagccattcctatttaattaaaacagaactagttgtagtgtaggaaaaagccactgataaaacaggttatattcttaagcctctctttattgagaacccctagaattgcaggataaacttgatcgaagtaaaatccaaatcttanactaagttctgtgagatttaagagcaataatcaacagttctaagcctaataaagagagctcttaatcagctcagtggtggttaaaaccagctatcttttaaagaagagaaaaaacaaaacacagcaatgccctgtctcttcagaaaattgttttaaaaagttagccaggcatagttagtggcccacgcctgtagtccgagctgtttgggaggttgaggtgggaagattggttgagcccaagattttgaggctgcagtaagccataattgtaccactgcactccagcctgagcgacagagaacaagaccctgtctcaaaaataaagtgggggaaggggtgcaaaattacactgtgagaagccaagaagtttcaaagttctatttatttttctaagtcatttttaatcattatttgttgtttcagtgtttgaatttaacattatgtttttaaagatggagtggattctaaagatgagttgggttcaagatatccaacatatcttttatattgggcttatgtcacttaggtgaagttgagctcctttttctttttaatctccatggaacaatttgtataatttcttgatttaaattgctaaactgagctcttcattcaaaatactaaacaataatttctctttggggggaaaattaaggaaggctttctatacatagaaataaagatgcctaggccgggtgcagtggctcatgcctgtaatcccaatactttggggggctgaggcgggtggatcacctgaggtcaagagttcaagaccagcctgggcaacatggtgaaaccctgcctctactaaaagtacaaaaattagctgggcgtggtggcagctgcctgtaatcccagctactcggaggctgaggcacgagaatcacttgaacctgggaggcgaaggttgcagtgaaccaagatcatgccattgcactccagcctgggcgacagagcaaaactctttatctaaaaaaaaaaaaaaaaaaaagacgcctacagaagcaaggttcttaggtgcagtgactcatgcctgtaattccagcactttgggagtttgaggcaagaggatcacttgagctcaggaattcaaaaccagcctgggcaatatggcaagaccccatctttgcagaatattagcctagcttggtagcacgagtatgtggtcctagctacttggaaggctgaggtgggaaggatcacttgagcctggtaggttgaagctgcagtgagctatattcacaccattgcactctagcttgaacaacaaagtgagatcctgtctcaaaaagaaaaaggaaaaattacagctcacggctgtaatcccagcactttgggaggccaaggcgcgcagatcacttgaggtcaggagtttgagaccagccaacatggtatcaccctgtctctactaaaaatacaaaaattagccaggtgtcgtggcgggtgcctgtaatcccagctactcgggaggctgaggcaggagaatcgcttgaacccaggaggcagagattacagtgaaccaagatgacacctctgcactccagcctgggcaacaggcttaaagactccgtcttaaaaaaaaattaagaatttgtattctcataacatattcagttttaagcttgtagcttttaaatctttgagcacgtaataaaagctgcgtaggccaagtgtggtggctcatgcttgtaatcccagcactttgggaggctgaggcaggaggatcacctgaggtcgggagttcaagagcagcttacccaatatgtagaaaccccgcctctactaaaaatacaaaattagccaggcgtggtcgcatgcctgtaatcctagctactcgggaggctgaggcaggagaatcattgaacccaggaggcggaggttgtggtgggccaatatcacaccattgcactccaacctgggcaacaagagcaagagtccatctaaaaaaagagctgtatataccactttaatctgtccttgggcttcagacttaaatattctcttaaacagcaaaaatactaactaagttaaatttaaaagcaaggagaagcatcattgtaatacgacatccatgtgtattcaaactagaattttctgatggtcttcgtaagataaaggagataattgtcatttctatgacacagcttttataatttgaataaacttagttggagattggagtatttttattatttattttcatgtgagatgggtaatgtgctgacctcataacaaagtttgagggagacacattgtatgtgagaatttgaagtgcttatgaagtacaaaagcagaggccaggtgctcacatctgtaatcccagcactttgggaggccaaggcacacagatcacttgaggtcaggagtttgagaccagcctggccaacatggcgaaaacccctctcttactaaaaatacaaaaattagctggatgtggtggtgtgggcctgtaatcccagctactcgcgaggctgaggcaggagaatcgcttgaacctggcaggcagaggttgcggtgagccaagattgcgtcactgcactccggcgtggacaagagagtgagactccgtcacaaaaaaaaaaaaaaaagaagaaaagtattggattcacatattctaaaaatgctcgtcatttgtggctaattttatcaagtctagtttaatctcatatttacagagtttagttaattctaattagctttgttggaggtcataaaccacattattaaccttgaaccgactctgtgtttacttgagttcctctgcataatagcatgtcaccaccatcataaacatgttggtattgcattatgcttctagaggagacatccaccaatatttgaaaatctggctggtccgagtgcagtggtgtttacaactaattgatcacaaccagttacagactttgtttcttctccagtcctgctgcttcacttgactagccttttaaaaaaaagaaagaaaatagagaaaatcttaacttatatttacttactgtatgttgtgattagtttaatagaagggagtttaatccttaataattaagttagtcctcaacgtttattgacttagttctgatgtagtccttgtgtactattgtataatgtagactacttggccatacttgattttgtctaaaagttaatgcataaattaatattaaatatggccaaatataaaagtttaatgagtcatttgaggtcatttagccagaaaactgcatttatgttcctggtgaatttttttcaatgtccttttccaaaagtggcagtaagcagctgtcttaaaataaggagacagtgggaatgatgttgttaaagtcttttatacaatgtattgtctgtctgttccataaaaagtaaaactactctattcgtgaccagcttgggcaacatagtgagactgtctctttaaaaaaaaaaaaaaaattaaaaattagcaggtgtggtgatgcacacctgtagtcctagcaattcgggaagctgaggtaggaagatcgcttgagccaagtgtttgaggttagaatgagctatgatcgcaccacctacactccagcctgggcaacagagcaagacccaaatggctcatggttgctttgtttgttttaccttgttgagtgccagtgtgtattttgagcaaagcagtgtaaatggccttcttgccctagagtctttcataattgagccttatttaatctaccacttttgaccatgaaatttaacaggtgacttcttctgggtatctactccaggtgaagtgatattttttttgactgagatgtctaaagctcttggattcctggtatctcaccaggacatcttagtaaaacagcaagtatcagatgaggaatcagacttgagttctagctctggtctggccactaacattgatatgatcttgggcaagttagttcctgcctgggtttcattacctttaactgaggaggttgaaatagatgatttctcatgtctcttctactcctaaattctatgattttagggagaaaatccccttcaacattcctgggatatatatctaatagtcccatatattgtgaaacttccctattgacgataaagagggctggggaaggctacaagttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccaccagctcccaaaatgccaccacctgaaaagacaaaaaaaggaaggaaagacaaggcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaaatgctaattttgaagcccttcctgaggattggagagcaaggctgaagagaaggaaaatggctccaaacacatagtttttaagtttttaaaacttttttgtattattgtttgttttgtgttcagttcaaagtcttaaccagttttattgtcaaataaactataaatgttatgggggagatcttataaatttcctgggcaagagtgtatgcatacaaagttttcacttttgtgaaatgtaatttttctgtttttgcaaagggatgaggtgattggaattgctttgaccatgctgcctttattctcaaactggcaaacttagcatgttaggtgtattaacctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcaggtaaaagtcactttaaactgaggaaacggcaaattgtgttttaaagctctttgtatttctccagtttctgaccttgtaaatttgtatatatgcactaataaagctttttttataaaaggagaacaaatcagaacaagcaaacgggaaagaaaatgaggacgacggaaaccaaagacaacagaagacaacgaaggacggagcggagaagagagagaacaaaccagagagacacagcgacggagaggaaagagagagtgaaaaagaag

SEQ ID NO: 408663 - DNA, 10175 bp, Homo sapiens
  misc_feature (4113)..(4113): n is a, c, g, or t
gctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacaggtacgcactcttctccccttttcacctttcacctttgacatctcagacatgatttgtgatcaccaccatctgacgacatgacagcctgtctggagactgagagcagctgcagttagcggtgctgggcaggcaaagcaccgcaagcacaaagtttggccagccacacattggagaaacaaaagcaatgtttaaagtgttccatgtaacggattttttcccaagatatggacaaagctggtttttactctccagagtgttgcacggagtagggcgggcttgggggttaagcgcatgcgagagctctgtgcgctttacaggacctctggaagcaactactcctgattaacctcggtgaagttaaggaaaacttcgtggctgaagatgtgaatgaagaacaagattactatcctctgccagcaggtcagatgaaaacatttctttatatatttggcttttcttgatttttttttcgttatttgaaatctttgctcttttatttttcagctcccagatcctctccctctctttagctttcactgtgtttgatatcaagaatatgaaatgtgaattccacggtccaagaggggaagagtcacctttcacaaacttcgttgttctcttctttggaagggaaattagtgttctaggcgattgagtcccttcattaatgaaacttgaaaccctgttatgcattggcaaatcacaaaaaaagagaaaagtgttttctaagtctcatctgttggagtgagagggttcagggctgtattcacagagttgctggcagtgcaaatagctttgaattatccttggttctccattctcaattgtcaaagctctttgttgcctttgtgaatagcagtccattaagaggttcgtccctgtgaaagcagactgctgtcctgggacaggaccaaatggaagtgtctttgtaggagaacgggttttaaaacatgtgttttctttcttgtaatttagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggtgagacaatttaccttgtactaattcagccaaaatgactttagaggaaaaatcttattaatttacattattaaaagattttatgtcataataatataagcttctgattgagaatagtggtgtgaactaaaacaaggaatgcatgagttattatggttggaaatcagcatactattgttatcacgtgtaaaactgtgccccaaagtgaaaagataggctaacagattttgattttaaaaaattgttttataaccattctatcatgccactgactaagctgtgggtctccaaaaataggaatgcttgtgctgaggaactagatagttgaactgtcaatatatgtggcatgctgagatttgttatacatttctatacaacacttagtctgttcatattgcaacctcatttctcacctccactaatcttacaaaaagcgtggttggtacaaatcaaaatgatatgaagaaatgccattagtacttgtttcagagaagcaaaataattgatcatgaaaaatcaccagcaatcttctggtctaaaacaattggcaataggatgtctcattccatttttaaggtactcttggaagaatttagtttagttacatacattttttaaaagataggctttcatgctcctcagttcctttagtttttaaaaagtttccaatgtgtaaagaaacttccacctgttaatcttaagaattggtagctatttgttaaactgatggcatatgaaggcaagagtctatgagtcgtttctaaagtaatagatctttgaaaattttaaaaagtgaaatttgtcaataacagagttaagagctgaattcttttgtctaaaacttatcgaaattgatgcttgtactctactggctccctgatgatagtagaaaagcactagtaatgtaccaaatgaaactggttgtgtaccagatgattttgttaacttcttaaatagcctagaaatcgtcagcaggtcacatacaactgcagtgataatttcagaacatagcaaaaggctgattttattctacttcacattttagaagtgcattttctcaagttacagggcatttcacttcccttttacatgaagagattttcttttgaatatttttcctctcttttggtagcagtgatagacatgactaataatatattggttctttttgtttgctttttagcagttaatgaactgaagaggcttgatcgtagttctggataggtggctccactcctgaccactgtcaacatcccttatatgttccaaagttgaaaattccactgttaccaattctgaatgttctgtgaacactttagatgagtattaagctgttttctccctttatgacacacatagttgatactgtctggtaaaaggaggctcttgagccattcctatttaattaaaacagaactagttgtagtgtaggaaaaagccactgataaaacaggttatattcttaagcctctctttattgagaacccctagaattgcaggataaacttgatcgaagtaaaatccaaatcttanactaagttctgtgagatttaagagcaataatcaacagttctaagcctaataaagagagctcttaatcagctcagtggtggttaaaaccagctatcttttaaagaagagaaaaaacaaaacacagcaatgccctgtctcttcagaaaattgttttaaaaagttagccaggcatagttagtggcccacgcctgtagtccgagctgtttgggaggttgaggtgggaagattggttgagcccaagattttgaggctgcagtaagccataattgtaccactgcactccagcctgagcgacagagaacaagaccctgtctcaaaaataaagtgggggaaggggtgcaaaattacactgtgagaagccaagaagtttcaaagttctatttatttttctaagtcatttttaatcattatttgttgtttcagtgtttgaatttaacattatgtttttaaagatggagtggattctaaagatgagttgggttcaagatatccaacatatcttttatattgggcttatgtcacttaggtgaagttgagctcctttttctttttaatctccatggaacaatttgtataatttcttgatttaaattgctaaactgagctcttcattcaaaatactaaacaataatttctctttggggggaaaattaaggaaggctttctatacatagaaataaagatgcctaggccgggtgcagtggctcatgcctgtaatcccaatactttggggggctgaggcgggtggatcacctgaggtcaagagttcaagaccagcctgggcaacatggtgaaaccctgcctctactaaaagtacaaaaattagctgggcgtggtggcagctgcctgtaatcccagctactcggaggctgaggcacgagaatcacttgaacctgggaggcgaaggttgcagtgaaccaagatcatgccattgcactccagcctgggcgacagagcaaaactctttatctaaaaaaaaaaaaaaaaaaaagacgcctacagaagcaaggttcttaggtgcagtgactcatgcctgtaattccagcactttgggagtttgaggcaagaggatcacttgagctcaggaattcaaaaccagcctgggcaatatggcaagaccccatctttgcagaatattagcctagcttggtagcacgagtatgtggtcctagctacttggaaggctgaggtgggaaggatcacttgagcctggtaggttgaagctgcagtgagctatattcacaccattgcactctagcttgaacaacaaagtgagatcctgtctcaaaaagaaaaaggaaaaattacagctcacggctgtaatcccagcactttgggaggccaaggcgcgcagatcacttgaggtcaggagtttgagaccagccaacatggtatcaccctgtctctactaaaaatacaaaaattagccaggtgtcgtggcgggtgcctgtaatcccagctactcgggaggctgaggcaggagaatcgcttgaacccaggaggcagagattacagtgaaccaagatgacacctctgcactccagcctgggcaacaggcttaaagactccgtcttaaaaaaaaattaagaatttgtattctcataacatattcagttttaagcttgtagcttttaaatctttgagcacgtaataaaagctgcgtaggccaagtgtggtggctcatgcttgtaatcccagcactttgggaggctgaggcaggaggatcacctgaggtcgggagttcaagagcagcttacccaatatgtagaaaccccgcctctactaaaaatacaaaattagccaggcgtggtcgcatgcctgtaatcctagctactcgggaggctgaggcaggagaatcattgaacccaggaggcggaggttgtggtgggccaatatcacaccattgcactccaacctgggcaacaagagcaagagtccatctaaaaaaagagctgtatataccactttaatctgtccttgggcttcagacttaaatattctcttaaacagcaaaaatactaactaagttaaatttaaaagcaaggagaagcatcattgtaatacgacatccatgtgtattcaaactagaattttctgatggtcttcgtaagataaaggagataattgtcatttctatgacacagcttttataatttgaataaacttagttggagattggagtatttttattatttattttcatgtgagatgggtaatgtgctgacctcataacaaagtttgagggagacacattgtatgtgagaatttgaagtgcttatgaagtacaaaagcagaggccaggtgctcacatctgtaatcccagcactttgggaggccaaggcacacagatcacttgaggtcaggagtttgagaccagcctggccaacatggcgaaaacccctctcttactaaaaatacaaaaattagctggatgtggtggtgtgggcctgtaatcccagctactcgcgaggctgaggcaggagaatcgcttgaacctggcaggcagaggttgcggtgagccaagattgcgtcactgcactccggcgtggacaagagagtgagactccgtcacaaaaaaaaaaaaaaaagaagaaaagtattggattcacatattctaaaaatgctcgtcatttgtggctaattttatcaagtctagtttaatctcatatttacagagtttagttaattctaattagctttgttggaggtcataaaccacattattaaccttgaaccgactctgtgtttacttgagttcctctgcataatagcatgtcaccaccatcataaacatgttggtattgcattatgcttctagaggagacatccaccaatatttgaaaatctggctggtccgagtgcagtggtgtttacaactaattgatcacaaccagttacagactttgtttcttctccagtcctgctgcttcacttgactagccttttaaaaaaaagaaagaaaatagagaaaatcttaacttatatttacttactgtatgttgtgattagtttaatagaagggagtttaatccttaataattaagttagtcctcaacgtttattgacttagttctgatgtagtccttgtgtactattgtataatgtagactacttggccatacttgattttgtctaaaagttaatgcataaattaatattaaatatggccaaatataaaagtttaatgagtcatttgaggtcatttagccagaaaactgcatttatgttcctggtgaatttttttcaatgtccttttccaaaagtggcagtaagcagctgtcttaaaataaggagacagtgggaatgatgttgttaaagtcttttatacaatgtattgtctgtctgttccataaaaagtaaaactactctattcgtgaccagcttgggcaacatagtgagactgtctctttaaaaaaaaaaaaaaaattaaaaattagcaggtgtggtgatgcacacctgtagtcctagcaattcgggaagctgaggtaggaagatcgcttgagccaagtgtttgaggttagaatgagctatgatcgcaccacctacactccagcctgggcaacagagcaagacccaaatggctcatggttgctttgtttgttttaccttgttgagtgccagtgtgtattttgagcaaagcagtgtaaatggccttcttgccctagagtctttcataattgagccttatttaatctaccacttttgaccatgaaatttaacaggtgacttcttctgggtatctactccaggtgaagtgatattttttttgactgagatgtctaaagctcttggattcctggtatctcaccaggacatcttagtaaaacagcaagtatcagatgaggaatcagacttgagttctagctctggtctggccactaacattgatatgatcttgggcaagttagttcctgcctgggtttcattacctttaactgaggaggttgaaatagatgatttctcatgtctcttctactcctaaattctatgattttagggagaaaatccccttcaacattcctgggatatatatctaatagtcccatatattgtgaaacttccctattgacgataaagagggctggggaaggctacaagttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccaccagctcccaaaatgccaccacctgaaaagacaaaaaaaggaaggaaagacaaggcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaaatgctaattttgaagcccttcctgaggattggagagcaaggctgaagagaaggaaaatggctccaaacacatagtttttaagtttttaaaacttttttgtattattgtttgttttgtgttcagttcaaagtcttaaccagttttattgtcaaataaactataaatgttatgggggagatcttataaatttcctgggcaagagtgtatgcatacaaagttttcacttttgtgaaatgtaatttttctgtttttgcaaagggatgaggtgattggaattgctttgaccatgctgcctttattctcaaactggcaaacttagcatgttaggtgtattaacctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcaggtaaaagtcactttaaactgaggaaacggcaaattgtgttttaaagctctttgtatttctccagtttctgaccttgtaaatttgtatatatgcactaataaagctttttttataatcctgatgggttaaaatttt

SEQ ID NO: 408664 - DNA, 4525 bp, Homo sapiens
gctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacaggtacgcactcttctccccttttcacctttcacctttgacatctcagacatgatttgtgatcaccaccatctgacgacatgacagcctgtctggagactgagagcagctgcagttagcggtgctgggcaggcaaagcaccgcaagcacaaagtttggccagccacacattggagaaacaaaagcaatgtttaaagtgttccatgtaacggattttttcccaagatatggacaaagctggtttttactctccagagtgttgcacggagtagggcgggcttgggggttaagcgcatgcgagagctctgtgcgctttacaggacctctggaagcaactactcctgattaacctcggtgaagttaaggaaaacttcgtggctgaagatgtgaatgaagaacaagattactatcctctgccagcaggtcagatgaaaacatttctttatatatttggcttttcttgatttttttttcgttatttgaaatctttgctcttttatttttcagctcccagatcctctccctctctttagctttcactgtgtttgatatcaagaatatgaaatgtgaattccacggtccaagaggggaagagtcacctttcacaaacttcgttgttctcttctttggaagggaaattagtgttctaggcgattgagtcccttcattaatgaaacttgaaaccctgttatgcattggcaaatcacaaaaaaagagaaaagtgttttctaagtctcatctgttggagtgagagggttcagggctgtattcacagagttgctggcagtgcaaatagctttgaattatccttggttctccattctcaattgtcaaagctctttgttgcctttgtgaatagcagtccattaagaggttcgtccctgtgaaagcagactgctgtcctgggacaggaccaaatggaagtgtctttgtaggagaacgggttttaaaacatgtgttttctttcttgtaatttagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccaccagctcccaaaatgccaccacctgaaaagacaaaaaaaggaaggaaagacaaggcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaaatgctaattttgaagcccttcctgaggattggagagcaaggctgaagagaaggaaaatggctccaaacacatagtttttaagtttttaaaacttttttgtattattgtttgttttgtgttcagttcaaagtcttaaccagttttattgtcaaataaactataaatgttatgggggagatcttataaatttcctgggcaagagtgtatgcatacaaagttttcacttttgtgaaatgtaatttttctgtttttgcaaagggatgaggtgattggaattgctttgaccatgctgcctttattctcaaactggcaaacttagcatgttaggtgtattaacctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcaggtaaaagtcactttaaactgaggaaacggcaaattgtgttttaaagctctttgtatttctccagtttctgaccttgtaaatttgtatatatgcactaataaagctttttttataa

SEQ ID NO: 408665 - DNA, 9897 bp, Homo sapiens
  misc_feature (4113)..(4113): n is a, c, g, or t
gctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacaggtacgcactcttctccccttttcacctttcacctttgacatctcagacatgatttgtgatcaccaccatctgacgacatgacagcctgtctggagactgagagcagctgcagttagcggtgctgggcaggcaaagcaccgcaagcacaaagtttggccagccacacattggagaaacaaaagcaatgtttaaagtgttccatgtaacggattttttcccaagatatggacaaagctggtttttactctccagagtgttgcacggagtagggcgggcttgggggttaagcgcatgcgagagctctgtgcgctttacaggacctctggaagcaactactcctgattaacctcggtgaagttaaggaaaacttcgtggctgaagatgtgaatgaagaacaagattactatcctctgccagcaggtcagatgaaaacatttctttatatatttggcttttcttgatttttttttcgttatttgaaatctttgctcttttatttttcagctcccagatcctctccctctctttagctttcactgtgtttgatatcaagaatatgaaatgtgaattccacggtccaagaggggaagagtcacctttcacaaacttcgttgttctcttctttggaagggaaattagtgttctaggcgattgagtcccttcattaatgaaacttgaaaccctgttatgcattggcaaatcacaaaaaaagagaaaagtgttttctaagtctcatctgttggagtgagagggttcagggctgtattcacagagttgctggcagtgcaaatagctttgaattatccttggttctccattctcaattgtcaaagctctttgttgcctttgtgaatagcagtccattaagaggttcgtccctgtgaaagcagactgctgtcctgggacaggaccaaatggaagtgtctttgtaggagaacgggttttaaaacatgtgttttctttcttgtaatttagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggtgagacaatttaccttgtactaattcagccaaaatgactttagaggaaaaatcttattaatttacattattaaaagattttatgtcataataatataagcttctgattgagaatagtggtgtgaactaaaacaaggaatgcatgagttattatggttggaaatcagcatactattgttatcacgtgtaaaactgtgccccaaagtgaaaagataggctaacagattttgattttaaaaaattgttttataaccattctatcatgccactgactaagctgtgggtctccaaaaataggaatgcttgtgctgaggaactagatagttgaactgtcaatatatgtggcatgctgagatttgttatacatttctatacaacacttagtctgttcatattgcaacctcatttctcacctccactaatcttacaaaaagcgtggttggtacaaatcaaaatgatatgaagaaatgccattagtacttgtttcagagaagcaaaataattgatcatgaaaaatcaccagcaatcttctggtctaaaacaattggcaataggatgtctcattccatttttaaggtactcttggaagaatttagtttagttacatacattttttaaaagataggctttcatgctcctcagttcctttagtttttaaaaagtttccaatgtgtaaagaaacttccacctgttaatcttaagaattggtagctatttgttaaactgatggcatatgaaggcaagagtctatgagtcgtttctaaagtaatagatctttgaaaattttaaaaagtgaaatttgtcaataacagagttaagagctgaattcttttgtctaaaacttatcgaaattgatgcttgtactctactggctccctgatgatagtagaaaagcactagtaatgtaccaaatgaaactggttgtgtaccagatgattttgttaacttcttaaatagcctagaaatcgtcagcaggtcacatacaactgcagtgataatttcagaacatagcaaaaggctgattttattctacttcacattttagaagtgcattttctcaagttacagggcatttcacttcccttttacatgaagagattttcttttgaatatttttcctctcttttggtagcagtgatagacatgactaataatatattggttctttttgtttgctttttagcagttaatgaactgaagaggcttgatcgtagttctggataggtggctccactcctgaccactgtcaacatcccttatatgttccaaagttgaaaattccactgttaccaattctgaatgttctgtgaacactttagatgagtattaagctgttttctccctttatgacacacatagttgatactgtctggtaaaaggaggctcttgagccattcctatttaattaaaacagaactagttgtagtgtaggaaaaagccactgataaaacaggttatattcttaagcctctctttattgagaacccctagaattgcaggataaacttgatcgaagtaaaatccaaatcttanactaagttctgtgagatttaagagcaataatcaacagttctaagcctaataaagagagctcttaatcagctcagtggtggttaaaaccagctatcttttaaagaagagaaaaaacaaaacacagcaatgccctgtctcttcagaaaattgttttaaaaagttagccaggcatagttagtggcccacgcctgtagtccgagctgtttgggaggttgaggtgggaagattggttgagcccaagattttgaggctgcagtaagccataattgtaccactgcactccagcctgagcgacagagaacaagaccctgtctcaaaaataaagtgggggaaggggtgcaaaattacactgtgagaagccaagaagtttcaaagttctatttatttttctaagtcatttttaatcattatttgttgtttcagtgtttgaatttaacattatgtttttaaagatggagtggattctaaagatgagttgggttcaagatatccaacatatcttttatattgggcttatgtcacttaggtgaagttgagctcctttttctttttaatctccatggaacaatttgtataatttcttgatttaaattgctaaactgagctcttcattcaaaatactaaacaataatttctctttggggggaaaattaaggaaggctttctatacatagaaataaagatgcctaggccgggtgcagtggctcatgcctgtaatcccaatactttggggggctgaggcgggtggatcacctgaggtcaagagttcaagaccagcctgggcaacatggtgaaaccctgcctctactaaaagtacaaaaattagctgggcgtggtggcagctgcctgtaatcccagctactcggaggctgaggcacgagaatcacttgaacctgggaggcgaaggttgcagtgaaccaagatcatgccattgcactccagcctgggcgacagagcaaaactctttatctaaaaaaaaaaaaaaaaaaaagacgcctacagaagcaaggttcttaggtgcagtgactcatgcctgtaattccagcactttgggagtttgaggcaagaggatcacttgagctcaggaattcaaaaccagcctgggcaatatggcaagaccccatctttgcagaatattagcctagcttggtagcacgagtatgtggtcctagctacttggaaggctgaggtgggaaggatcacttgagcctggtaggttgaagctgcagtgagctatattcacaccattgcactctagcttgaacaacaaagtgagatcctgtctcaaaaagaaaaaggaaaaattacagctcacggctgtaatcccagcactttgggaggccaaggcgcgcagatcacttgaggtcaggagtttgagaccagccaacatggtatcaccctgtctctactaaaaatacaaaaattagccaggtgtcgtggcgggtgcctgtaatcccagctactcgggaggctgaggcaggagaatcgcttgaacccaggaggcagagattacagtgaaccaagatgacacctctgcactccagcctgggcaacaggcttaaagactccgtcttaaaaaaaaattaagaatttgtattctcataacatattcagttttaagcttgtagcttttaaatctttgagcacgtaataaaagctgcgtaggccaagtgtggtggctcatgcttgtaatcccagcactttgggaggctgaggcaggaggatcacctgaggtcgggagttcaagagcagcttacccaatatgtagaaaccccgcctctactaaaaatacaaaattagccaggcgtggtcgcatgcctgtaatcctagctactcgggaggctgaggcaggagaatcattgaacccaggaggcggaggttgtggtgggccaatatcacaccattgcactccaacctgggcaacaagagcaagagtccatctaaaaaaagagctgtatataccactttaatctgtccttgggcttcagacttaaatattctcttaaacagcaaaaatactaactaagttaaatttaaaagcaaggagaagcatcattgtaatacgacatccatgtgtattcaaactagaattttctgatggtcttcgtaagataaaggagataattgtcatttctatgacacagcttttataatttgaataaacttagttggagattggagtatttttattatttattttcatgtgagatgggtaatgtgctgacctcataacaaagtttgagggagacacattgtatgtgagaatttgaagtgcttatgaagtacaaaagcagaggccaggtgctcacatctgtaatcccagcactttgggaggccaaggcacacagatcacttgaggtcaggagtttgagaccagcctggccaacatggcgaaaacccctctcttactaaaaatacaaaaattagctggatgtggtggtgtgggcctgtaatcccagctactcgcgaggctgaggcaggagaatcgcttgaacctggcaggcagaggttgcggtgagccaagattgcgtcactgcactccggcgtggacaagagagtgagactccgtcacaaaaaaaaaaaaaaaagaagaaaagtattggattcacatattctaaaaatgctcgtcatttgtggctaattttatcaagtctagtttaatctcatatttacagagtttagttaattctaattagctttgttggaggtcataaaccacattattaaccttgaaccgactctgtgtttacttgagttcctctgcataatagcatgtcaccaccatcataaacatgttggtattgcattatgcttctagaggagacatccaccaatatttgaaaatctggctggtccgagtgcagtggtgtttacaactaattgatcacaaccagttacagactttgtttcttctccagtcctgctgcttcacttgactagccttttaaaaaaaagaaagaaaatagagaaaatcttaacttatatttacttactgtatgttgtgattagtttaatagaagggagtttaatccttaataattaagttagtcctcaacgtttattgacttagttctgatgtagtccttgtgtactattgtataatgtagactacttggccatacttgattttgtctaaaagttaatgcataaattaatattaaatatggccaaatataaaagtttaatgagtcatttgaggtcatttagccagaaaactgcatttatgttcctggtgaatttttttcaatgtccttttccaaaagtggcagtaagcagctgtcttaaaataaggagacagtgggaatgatgttgttaaagtcttttatacaatgtattgtctgtctgttccataaaaagtaaaactactctattcgtgaccagcttgggcaacatagtgagactgtctctttaaaaaaaaaaaaaaaattaaaaattagcaggtgtggtgatgcacacctgtagtcctagcaattcgggaagctgaggtaggaagatcgcttgagccaagtgtttgaggttagaatgagctatgatcgcaccacctacactccagcctgggcaacagagcaagacccaaatggctcatggttgctttgtttgttttaccttgttgagtgccagtgtgtattttgagcaaagcagtgtaaatggccttcttgccctagagtctttcataattgagccttatttaatctaccacttttgaccatgaaatttaacaggtgacttcttctgggtatctactccaggtgaagtgatattttttttgactgagatgtctaaagctcttggattcctggtatctcaccaggacatcttagtaaaacagcaagtatcagatgaggaatcagacttgagttctagctctggtctggccactaacattgatatgatcttgggcaagttagttcctgcctgggtttcattacctttaactgaggaggttgaaatagatgatttctcatgtctcttctactcctaaattctatgattttagggagaaaatccccttcaacattcctgggatatatatctaatagtcccatatattgtgaaacttccctattgacgataaagagggctggggaaggctacaagttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccaccagctcccaaaatgccaccacctgaaaagacaaaaaaaggaaggaaagacaaggcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaaatgctaattttgaagcccttcctgaggattggagagcaaggctgaagagaaggaaaatggctccaaacacatagtttttaagtttttaaaacttttttgtattattgtttgttttgtgttcagttcaaagtcttaaccagttttattgtcaaataaactataaatgttatgggggagatcttataaatttcctgggcaagagtgtatgcatacaaagttttcacttttgtgaaatgtaatttttctgtttttgcaaagggatgagttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcagtttctccagtttctgaccttgtaaatttgtatatatgcactaataaagctttttttataa

SEQ ID NO: 408666 - DNA, 3701 bp, Homo sapiens
gctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccaccagctcccaaaatgccaccacctgaaaagacaaaaaaaggaaggaaagacaaggcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaaatgctaattttgaagcccttcctgaggattggagagcaaggctgaagagaaggaaaatggctccaaacacatagtttttaagtttttaaaacttttttgtattattgtttgttttgtgttcagttcaaagtcttaaccagttttattgtcaaataaactataaatgttatgggggagatcttataaatttcctgggcaagagtgtatgcatacaaagttttcacttttgtgaaatgtaatttttctgtttttgcaaagggatgaggtgattggaattgctttgaccatgctgcctttattctcaaactggcaaacttagcatgttaggtgtattaacctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcaggtaaaagtcactttaaactgaggaaacggcaaattgtgttttaaagctctttgtatttctccagtttctgaccttgtaaatttgtatatatgcactaataaagctttttttataaaaggagaacaaatcagaacaagcaaacgggaaagaaaatgaggacgacggaaaccaaagacaacagaagacaacgaaggacggagcggagaagagagagaacaaaccagagagacacagcgacggagaggaaagagagagtgaaaaagaag

SEQ ID NO: 408667 - DNA, 9317 bp, Homo sapiens
  misc_feature (4113)..(4113): n is a, c, g, or t
gctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacaggtacgcactcttctccccttttcacctttcacctttgacatctcagacatgatttgtgatcaccaccatctgacgacatgacagcctgtctggagactgagagcagctgcagttagcggtgctgggcaggcaaagcaccgcaagcacaaagtttggccagccacacattggagaaacaaaagcaatgtttaaagtgttccatgtaacggattttttcccaagatatggacaaagctggtttttactctccagagtgttgcacggagtagggcgggcttgggggttaagcgcatgcgagagctctgtgcgctttacaggacctctggaagcaactactcctgattaacctcggtgaagttaaggaaaacttcgtggctgaagatgtgaatgaagaacaagattactatcctctgccagcaggtcagatgaaaacatttctttatatatttggcttttcttgatttttttttcgttatttgaaatctttgctcttttatttttcagctcccagatcctctccctctctttagctttcactgtgtttgatatcaagaatatgaaatgtgaattccacggtccaagaggggaagagtcacctttcacaaacttcgttgttctcttctttggaagggaaattagtgttctaggcgattgagtcccttcattaatgaaacttgaaaccctgttatgcattggcaaatcacaaaaaaagagaaaagtgttttctaagtctcatctgttggagtgagagggttcagggctgtattcacagagttgctggcagtgcaaatagctttgaattatccttggttctccattctcaattgtcaaagctctttgttgcctttgtgaatagcagtccattaagaggttcgtccctgtgaaagcagactgctgtcctgggacaggaccaaatggaagtgtctttgtaggagaacgggttttaaaacatgtgttttctttcttgtaatttagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggtgagacaatttaccttgtactaattcagccaaaatgactttagaggaaaaatcttattaatttacattattaaaagattttatgtcataataatataagcttctgattgagaatagtggtgtgaactaaaacaaggaatgcatgagttattatggttggaaatcagcatactattgttatcacgtgtaaaactgtgccccaaagtgaaaagataggctaacagattttgattttaaaaaattgttttataaccattctatcatgccactgactaagctgtgggtctccaaaaataggaatgcttgtgctgaggaactagatagttgaactgtcaatatatgtggcatgctgagatttgttatacatttctatacaacacttagtctgttcatattgcaacctcatttctcacctccactaatcttacaaaaagcgtggttggtacaaatcaaaatgatatgaagaaatgccattagtacttgtttcagagaagcaaaataattgatcatgaaaaatcaccagcaatcttctggtctaaaacaattggcaataggatgtctcattccatttttaaggtactcttggaagaatttagtttagttacatacattttttaaaagataggctttcatgctcctcagttcctttagtttttaaaaagtttccaatgtgtaaagaaacttccacctgttaatcttaagaattggtagctatttgttaaactgatggcatatgaaggcaagagtctatgagtcgtttctaaagtaatagatctttgaaaattttaaaaagtgaaatttgtcaataacagagttaagagctgaattcttttgtctaaaacttatcgaaattgatgcttgtactctactggctccctgatgatagtagaaaagcactagtaatgtaccaaatgaaactggttgtgtaccagatgattttgttaacttcttaaatagcctagaaatcgtcagcaggtcacatacaactgcagtgataatttcagaacatagcaaaaggctgattttattctacttcacattttagaagtgcattttctcaagttacagggcatttcacttcccttttacatgaagagattttcttttgaatatttttcctctcttttggtagcagtgatagacatgactaataatatattggttctttttgtttgctttttagcagttaatgaactgaagaggcttgatcgtagttctggataggtggctccactcctgaccactgtcaacatcccttatatgttccaaagttgaaaattccactgttaccaattctgaatgttctgtgaacactttagatgagtattaagctgttttctccctttatgacacacatagttgatactgtctggtaaaaggaggctcttgagccattcctatttaattaaaacagaactagttgtagtgtaggaaaaagccactgataaaacaggttatattcttaagcctctctttattgagaacccctagaattgcaggataaacttgatcgaagtaaaatccaaatcttanactaagttctgtgagatttaagagcaataatcaacagttctaagcctaataaagagagctcttaatcagctcagtggtggttaaaaccagctatcttttaaagaagagaaaaaacaaaacacagcaatgccctgtctcttcagaaaattgttttaaaaagttagccaggcatagttagtggcccacgcctgtagtccgagctgtttgggaggttgaggtgggaagattggttgagcccaagattttgaggctgcagtaagccataattgtaccactgcactccagcctgagcgacagagaacaagaccctgtctcaaaaataaagtgggggaaggggtgcaaaattacactgtgagaagccaagaagtttcaaagttctatttatttttctaagtcatttttaatcattatttgttgtttcagtgtttgaatttaacattatgtttttaaagatggagtggattctaaagatgagttgggttcaagatatccaacatatcttttatattgggcttatgtcacttaggtgaagttgagctcctttttctttttaatctccatggaacaatttgtataatttcttgatttaaattgctaaactgagctcttcattcaaaatactaaacaataatttctctttggggggaaaattaaggaaggctttctatacatagaaataaagatgcctaggccgggtgcagtggctcatgcctgtaatcccaatactttggggggctgaggcgggtggatcacctgaggtcaagagttcaagaccagcctgggcaacatggtgaaaccctgcctctactaaaagtacaaaaattagctgggcgtggtggcagctgcctgtaatcccagctactcggaggctgaggcacgagaatcacttgaacctgggaggcgaaggttgcagtgaaccaagatcatgccattgcactccagcctgggcgacagagcaaaactctttatctaaaaaaaaaaaaaaaaaaaagacgcctacagaagcaaggttcttaggtgcagtgactcatgcctgtaattccagcactttgggagtttgaggcaagaggatcacttgagctcaggaattcaaaaccagcctgggcaatatggcaagaccccatctttgcagaatattagcctagcttggtagcacgagtatgtggtcctagctacttggaaggctgaggtgggaaggatcacttgagcctggtaggttgaagctgcagtgagctatattcacaccattgcactctagcttgaacaacaaagtgagatcctgtctcaaaaagaaaaaggaaaaattacagctcacggctgtaatcccagcactttgggaggccaaggcgcgcagatcacttgaggtcaggagtttgagaccagccaacatggtatcaccctgtctctactaaaaatacaaaaattagccaggtgtcgtggcgggtgcctgtaatcccagctactcgggaggctgaggcaggagaatcgcttgaacccaggaggcagagattacagtgaaccaagatgacacctctgcactccagcctgggcaacaggcttaaagactccgtcttaaaaaaaaattaagaatttgtattctcataacatattcagttttaagcttgtagcttttaaatctttgagcacgtaataaaagctgcgtaggccaagtgtggtggctcatgcttgtaatcccagcactttgggaggctgaggcaggaggatcacctgaggtcgggagttcaagagcagcttacccaatatgtagaaaccccgcctctactaaaaatacaaaattagccaggcgtggtcgcatgcctgtaatcctagctactcgggaggctgaggcaggagaatcattgaacccaggaggcggaggttgtggtgggccaatatcacaccattgcactccaacctgggcaacaagagcaagagtccatctaaaaaaagagctgtatataccactttaatctgtccttgggcttcagacttaaatattctcttaaacagcaaaaatactaactaagttaaatttaaaagcaaggagaagcatcattgtaatacgacatccatgtgtattcaaactagaattttctgatggtcttcgtaagataaaggagataattgtcatttctatgacacagcttttataatttgaataaacttagttggagattggagtatttttattatttattttcatgtgagatgggtaatgtgctgacctcataacaaagtttgagggagacacattgtatgtgagaatttgaagtgcttatgaagtacaaaagcagaggccaggtgctcacatctgtaatcccagcactttgggaggccaaggcacacagatcacttgaggtcaggagtttgagaccagcctggccaacatggcgaaaacccctctcttactaaaaatacaaaaattagctggatgtggtggtgtgggcctgtaatcccagctactcgcgaggctgaggcaggagaatcgcttgaacctggcaggcagaggttgcggtgagccaagattgcgtcactgcactccggcgtggacaagagagtgagactccgtcacaaaaaaaaaaaaaaaagaagaaaagtattggattcacatattctaaaaatgctcgtcatttgtggctaattttatcaagtctagtttaatctcatatttacagagtttagttaattctaattagctttgttggaggtcataaaccacattattaaccttgaaccgactctgtgtttacttgagttcctctgcataatagcatgtcaccaccatcataaacatgttggtattgcattatgcttctagaggagacatccaccaatatttgaaaatctggctggtccgagtgcagtggtgtttacaactaattgatcacaaccagttacagactttgtttcttctccagtcctgctgcttcacttgactagccttttaaaaaaaagaaagaaaatagagaaaatcttaacttatatttacttactgtatgttgtgattagtttaatagaagggagtttaatccttaataattaagttagtcctcaacgtttattgacttagttctgatgtagtccttgtgtactattgtataatgtagactacttggccatacttgattttgtctaaaagttaatgcataaattaatattaaatatggccaaatataaaagtttaatgagtcatttgaggtcatttagccagaaaactgcatttatgttcctggtgaatttttttcaatgtccttttccaaaagtggcagtaagcagctgtcttaaaataaggagacagtgggaatgatgttgttaaagtcttttatacaatgtattgtctgtctgttccataaaaagtaaaactactctattcgtgaccagcttgggcaacatagtgagactgtctctttaaaaaaaaaaaaaaaattaaaaattagcaggtgtggtgatgcacacctgtagtcctagcaattcgggaagctgaggtaggaagatcgcttgagccaagtgtttgaggttagaatgagctatgatcgcaccacctacactccagcctgggcaacagagcaagacccaaatggctcatggttgctttgtttgttttaccttgttgagtgccagtgtgtattttgagcaaagcagtgtaaatggccttcttgccctagagtctttcataattgagccttatttaatctaccacttttgaccatgaaatttaacaggtgacttcttctgggtatctactccaggtgaagtgatattttttttgactgagatgtctaaagctcttggattcctggtatctcaccaggacatcttagtaaaacagcaagtatcagatgaggaatcagacttgagttctagctctggtctggccactaacattgatatgatcttgggcaagttagttcctgcctgggtttcattacctttaactgaggaggttgaaatagatgatttctcatgtctcttctactcctaaattctatgattttagggagaaaatccccttcaacattcctgggatatatatctaatagtcccatatattgtgaaacttccctattgacgataaagagggctggggaaggctacaagttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccacctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcaggtaaaagtcactttaaactgaggaaacggcaaattgtgttttaaagctctttgtatttctccagtttctgaccttgtaaatttgtatatatgcactaataaagctttttttataa

SEQ ID NO: 408668 - DNA, 3958 bp, Homo sapiens
gctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacaggtacgcactcttctccccttttcacctttcacctttgacatctcagacatgatttgtgatcaccaccatctgacgacatgacagcctgtctggagactgagagcagctgcagttagcggtgctgggcaggcaaagcaccgcaagcacaaagtttggccagccacacattggagaaacaaaagcaatgtttaaagtgttccatgtaacggattttttcccaagatatggacaaagctggtttttactctccagagtgttgcacggagtagggcgggcttgggggttaagcgcatgcgagagctctgtgcgctttacaggacctctggaagcaactactcctgattaacctcggtgaagttaaggaaaacttcgtggctgaagatgtgaatgaagaacaagattactatcctctgccagcaggtcagatgaaaacatttctttatatatttggcttttcttgatttttttttcgttatttgaaatctttgctcttttatttttcagctcccagatcctctccctctctttagctttcactgtgtttgatatcaagaatatgaaatgtgaattccacggtccaagaggggaagagtcacctttcacaaacttcgttgttctcttctttggaagggaaattagtgttctaggcgattgagtcccttcattaatgaaacttgaaaccctgttatgcattggcaaatcacaaaaaaagagaaaagtgttttctaagtctcatctgttggagtgagagggttcagggctgtattcacagagttgctggcagtgcaaatagctttgaattatccttggttctccattctcaattgtcaaagctctttgttgcctttgtgaatagcagtccattaagaggttcgtccctgtgaaagcagactgctgtcctgggacaggaccaaatggaagtgtctttgtaggagaacgggttttaaaacatgtgttttctttcttgtaatttagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccaccagctcccaaaatgccaccacctgaaaagacaaaaaaaggaaggaaagacaaggcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaaatgctaattttgaagcccttcctgaggattggagagcaaggctgaagagaaggaaaatggctccaaacacatagtttttaagtttttaaaacttttttgtattattgtttgttttgtgttcagttcaaagtcttaaccagttttattgtcaaataaactataaatgttatgggggagatcttataaatttcctgggcaagagtgtatgcatacaaagttttcacttttgtgaaatgtaatttttctgtttttgcaaagggatgaggtgattggaattgctttgaccatgctgcctttattctcaaactggcaaacttagcatgttaggtgtattaacctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcaggtaaaagtcactttaaactgaggaaacggcaaattgtgttttaaagctctttgtatttctccagtttctgaccttgtaaatttgtatatatgcactaataaagctttttttataa

SEQ ID NO: 408669 - DNA, 8559 bp, Homo sapiens
  misc_feature (4113)..(4113): n is a, c, g, or t
gctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacaggtacgcactcttctccccttttcacctttcacctttgacatctcagacatgatttgtgatcaccaccatctgacgacatgacagcctgtctggagactgagagcagctgcagttagcggtgctgggcaggcaaagcaccgcaagcacaaagtttggccagccacacattggagaaacaaaagcaatgtttaaagtgttccatgtaacggattttttcccaagatatggacaaagctggtttttactctccagagtgttgcacggagtagggcgggcttgggggttaagcgcatgcgagagctctgtgcgctttacaggacctctggaagcaactactcctgattaacctcggtgaagttaaggaaaacttcgtggctgaagatgtgaatgaagaacaagattactatcctctgccagcaggtcagatgaaaacatttctttatatatttggcttttcttgatttttttttcgttatttgaaatctttgctcttttatttttcagctcccagatcctctccctctctttagctttcactgtgtttgatatcaagaatatgaaatgtgaattccacggtccaagaggggaagagtcacctttcacaaacttcgttgttctcttctttggaagggaaattagtgttctaggcgattgagtcccttcattaatgaaacttgaaaccctgttatgcattggcaaatcacaaaaaaagagaaaagtgttttctaagtctcatctgttggagtgagagggttcagggctgtattcacagagttgctggcagtgcaaatagctttgaattatccttggttctccattctcaattgtcaaagctctttgttgcctttgtgaatagcagtccattaagaggttcgtccctgtgaaagcagactgctgtcctgggacaggaccaaatggaagtgtctttgtaggagaacgggttttaaaacatgtgttttctttcttgtaatttagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggtgagacaatttaccttgtactaattcagccaaaatgactttagaggaaaaatcttattaatttacattattaaaagattttatgtcataataatataagcttctgattgagaatagtggtgtgaactaaaacaaggaatgcatgagttattatggttggaaatcagcatactattgttatcacgtgtaaaactgtgccccaaagtgaaaagataggctaacagattttgattttaaaaaattgttttataaccattctatcatgccactgactaagctgtgggtctccaaaaataggaatgcttgtgctgaggaactagatagttgaactgtcaatatatgtggcatgctgagatttgttatacatttctatacaacacttagtctgttcatattgcaacctcatttctcacctccactaatcttacaaaaagcgtggttggtacaaatcaaaatgatatgaagaaatgccattagtacttgtttcagagaagcaaaataattgatcatgaaaaatcaccagcaatcttctggtctaaaacaattggcaataggatgtctcattccatttttaaggtactcttggaagaatttagtttagttacatacattttttaaaagataggctttcatgctcctcagttcctttagtttttaaaaagtttccaatgtgtaaagaaacttccacctgttaatcttaagaattggtagctatttgttaaactgatggcatatgaaggcaagagtctatgagtcgtttctaaagtaatagatctttgaaaattttaaaaagtgaaatttgtcaataacagagttaagagctgaattcttttgtctaaaacttatcgaaattgatgcttgtactctactggctccctgatgatagtagaaaagcactagtaatgtaccaaatgaaactggttgtgtaccagatgattttgttaacttcttaaatagcctagaaatcgtcagcaggtcacatacaactgcagtgataatttcagaacatagcaaaaggctgattttattctacttcacattttagaagtgcattttctcaagttacagggcatttcacttcccttttacatgaagagattttcttttgaatatttttcctctcttttggtagcagtgatagacatgactaataatatattggttctttttgtttgctttttagcagttaatgaactgaagaggcttgatcgtagttctggataggtggctccactcctgaccactgtcaacatcccttatatgttccaaagttgaaaattccactgttaccaattctgaatgttctgtgaacactttagatgagtattaagctgttttctccctttatgacacacatagttgatactgtctggtaaaaggaggctcttgagccattcctatttaattaaaacagaactagttgtagtgtaggaaaaagccactgataaaacaggttatattcttaagcctctctttattgagaacccctagaattgcaggataaacttgatcgaagtaaaatccaaatcttanactaagttctgtgagatttaagagcaataatcaacagttctaagcctaataaagagagctcttaatcagctcagtggtggttaaaaccagctatcttttaaagaagagaaaaaacaaaacacagcaatgccctgtctcttcagaaaattgttttaaaaagttagccaggcatagttagtggcccacgcctgtagtccgagctgtttgggaggttgaggtgggaagattggttgagcccaagattttgaggctgcagtaagccataattgtaccactgcactccagcctgagcgacagagaacaagaccctgtctcaaaaataaagtgggggaaggggtgcaaaattacactgtgagaagccaagaagtttcaaagttctatttatttttctaagtcatttttaatcattatttgttgtttcagtgtttgaatttaacattatgtttttaaagatggagtggattctaaagatgagttgggttcaagatatccaacatatcttttatattgggcttatgtcacttaggtgaagttgagctcctttttctttttaatctccatggaacaatttgtataatttcttgatttaaattgctaaactgagctcttcattcaaaatactaaacaataatttctctttggggggaaaattaaggaaggctttctatacatagaaataaagatgcctaggccgggtgcagtggctcatgcctgtaatcccaatactttggggggctgaggcgggtggatcacctgaggtcaagagttcaagaccagcctgggcaacatggtgaaaccctgcctctactaaaagtacaaaaattagctgggcgtggtggcagctgcctgtaatcccagctactcggaggctgaggcacgagaatcacttgaacctgggaggcgaaggttgcagtgaaccaagatcatgccattgcactccagcctgggcgacagagcaaaactctttatctaaaaaaaaaaaaaaaaaaaagacgcctacagaagcaaggttcttaggtgcagtgactcatgcctgtaattccagcactttgggagtttgaggcaagaggatcacttgagctcaggaattcaaaaccagcctgggcaatatggcaagaccccatctttgcagaatattagcctagcttggtagcacgagtatgtggtcctagctacttggaaggctgaggtgggaaggatcacttgagcctggtaggttgaagctgcagtgagctatattcacaccattgcactctagcttgaacaacaaagtgagatcctgtctcaaaaagaaaaaggaaaaattacagctcacggctgtaatcccagcactttgggaggccaaggcgcgcagatcacttgaggtcaggagtttgagaccagccaacatggtatcaccctgtctctactaaaaatacaaaaattagccaggtgtcgtggcgggtgcctgtaatcccagctactcgggaggctgaggcaggagaatcgcttgaacccaggaggcagagattacagtgaaccaagatgacacctctgcactccagcctgggcaacaggcttaaagactccgtcttaaaaaaaaattaagaatttgtattctcataacatattcagttttaagcttgtagcttttaaatctttgagcacgtaataaaagctgcgtaggccaagtgtggtggctcatgcttgtaatcccagcactttgggaggctgaggcaggaggatcacctgaggtcgggagttcaagagcagcttacccaatatgtagaaaccccgcctctactaaaaatacaaaattagccaggcgtggtcgcatgcctgtaatcctagctactcgggaggctgaggcaggagaatcattgaacccaggaggcggaggttgtggtgggccaatatcacaccattgcactccaacctgggcaacaagagcaagagtccatctaaaaaaagagctgtatataccactttaatctgtccttgggcttcagacttaaatattctcttaaacagcaaaaatactaactaagttaaatttaaaagcaaggagaagcatcattgtaatacgacatccatgtgtattcaaactagaattttctgatggtcttcgtaagataaaggagataattgtcatttctatgacacagcttttataatttgaataaacttagttggagattggagtatttttattatttattttcatgtgagatgggtaatgtgctgacctcataacaaagtttgagggagacacattgtatgtgagaatttgaagtgcttatgaagtacaaaagcagaggccaggtgctcacatctgtaatcccagcactttgggaggccaaggcacacagatcacttgaggtcaggagtttgagaccagcctggccaacatggcgaaaacccctctcttactaaaaatacaaaaattagctggatgtggtggtgtgggcctgtaatcccagctactcgcgaggctgaggcaggagaatcgcttgaacctggcaggcagaggttgcggtgagccaagattgcgtcactgcactccggcgtggacaagagagtgagactccgtcacaaaaaaaaaaaaaaaagaagaaaagtattggattcacatattctaaaaatgctcgtcatttgtggctaattttatcaagtctagtttaatctcatatttacagagtttagttaattctaattagctttgttggaggtcataaaccacattattaaccttgaaccgactctgtgtttacttgagttcctctgcataatagcatgtcaccaccatcataaacatgttggtattgcattatgcttctagaggagacatccaccaatatttgaaaatctggctggtccgagtgcagtggtgtttacaactaattgatcacaaccagttacagactttgtttcttctccagtcctgctgcttcacttgactagccttttaaaaaaaagaaagaaaatagagaaaatcttaacttatatttacttactgtatgttgtgattagtttaatagaagggagtttaatccttaataattaagttagtcctcaacgtttattgacttagttctgatgtagtccttgtgtactattgtataatgtagactacttggccatacttgattttgtctaaaagttaatgcataaattaatattaaatatggccaaatataaaagtttaatgagtcatttgaggtcatttagccagaaaactgcatttatgttcctggtgaatttttttcaatgtccttttccaaaagtggcagtaagcagctgtcttaaaataaggagacagtgggaatgatgttgttaaagtcttttatacaatgtattgtctgtctgttccataaaaagtaaaactactctattcgtgaccagcttgggcaacatagtgagactgtctctttaaaaaaaaaaaaaaaattaaaaattagcaggtgtggtgatgcacacctgtagtcctagcaattcgggaagctgaggtaggaagatcgcttgagccaagtgtttgaggttagaatgagctatgatcgcaccacctacactccagcctgggcaacagagcaagacccaaatggctcatggttgctttgtttgttttaccttgttgagtgccagtgtgtattttgagcaaagcagtgtaaatggccttcttgccctagagtctttcataattgagccttatttaatctaccacttttgaccatgaaatttaacaggtgacttcttctgggtatctactccaggtgaagtgatattttttttgactgagatgtctaaagctcttggattcctggtatctcaccaggacatcttagtaaaacagcaagtatcagatgaggaatcagacttgagttctagctctggtctggccactaacattgatatgatcttgggcaagttagttcctgcctgggtttcattacctttaactgaggaggttgaaatagatgatttctcatgtctcttctactcctaaattctatgattttagggagttccctattgacgataaagagggctggggaaggctacaagtaagtatatcctattttctctaatctttaaaggttttcccagcagagaaaagacagtaatcaatgatggcttttacaaagtttgaggaaagctgatcctgcaacttttcagctgcaatttcgtaatgtagacttcagcaacagcaatttcaaaaccactgcagttttaaaaaatctgagttatatactttgaagatttatcttcctaaatttctcttttatcgcaaaagtaaaaattgccatccctaacttgtgtctctgtgatatcacaaatgaatgtaatgtatgcaagggtgtgaaggaatgatatagttgacagtagcaccttgcaaatggattttttaaatttagtaacccaaattaaacacaatgggtagaactttcccgagtattttgaatgaatatt

SEQ ID NO: 408670 - DNA, 6986 bp, Homo sapiens
  misc_feature (4113)..(4113): n is a, c, g, or t
gctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacaggtacgcactcttctccccttttcacctttcacctttgacatctcagacatgatttgtgatcaccaccatctgacgacatgacagcctgtctggagactgagagcagctgcagttagcggtgctgggcaggcaaagcaccgcaagcacaaagtttggccagccacacattggagaaacaaaagcaatgtttaaagtgttccatgtaacggattttttcccaagatatggacaaagctggtttttactctccagagtgttgcacggagtagggcgggcttgggggttaagcgcatgcgagagctctgtgcgctttacaggacctctggaagcaactactcctgattaacctcggtgaagttaaggaaaacttcgtggctgaagatgtgaatgaagaacaagattactatcctctgccagcaggtcagatgaaaacatttctttatatatttggcttttcttgatttttttttcgttatttgaaatctttgctcttttatttttcagctcccagatcctctccctctctttagctttcactgtgtttgatatcaagaatatgaaatgtgaattccacggtccaagaggggaagagtcacctttcacaaacttcgttgttctcttctttggaagggaaattagtgttctaggcgattgagtcccttcattaatgaaacttgaaaccctgttatgcattggcaaatcacaaaaaaagagaaaagtgttttctaagtctcatctgttggagtgagagggttcagggctgtattcacagagttgctggcagtgcaaatagctttgaattatccttggttctccattctcaattgtcaaagctctttgttgcctttgtgaatagcagtccattaagaggttcgtccctgtgaaagcagactgctgtcctgggacaggaccaaatggaagtgtctttgtaggagaacgggttttaaaacatgtgttttctttcttgtaatttagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggtgagacaatttaccttgtactaattcagccaaaatgactttagaggaaaaatcttattaatttacattattaaaagattttatgtcataataatataagcttctgattgagaatagtggtgtgaactaaaacaaggaatgcatgagttattatggttggaaatcagcatactattgttatcacgtgtaaaactgtgccccaaagtgaaaagataggctaacagattttgattttaaaaaattgttttataaccattctatcatgccactgactaagctgtgggtctccaaaaataggaatgcttgtgctgaggaactagatagttgaactgtcaatatatgtggcatgctgagatttgttatacatttctatacaacacttagtctgttcatattgcaacctcatttctcacctccactaatcttacaaaaagcgtggttggtacaaatcaaaatgatatgaagaaatgccattagtacttgtttcagagaagcaaaataattgatcatgaaaaatcaccagcaatcttctggtctaaaacaattggcaataggatgtctcattccatttttaaggtactcttggaagaatttagtttagttacatacattttttaaaagataggctttcatgctcctcagttcctttagtttttaaaaagtttccaatgtgtaaagaaacttccacctgttaatcttaagaattggtagctatttgttaaactgatggcatatgaaggcaagagtctatgagtcgtttctaaagtaatagatctttgaaaattttaaaaagtgaaatttgtcaataacagagttaagagctgaattcttttgtctaaaacttatcgaaattgatgcttgtactctactggctccctgatgatagtagaaaagcactagtaatgtaccaaatgaaactggttgtgtaccagatgattttgttaacttcttaaatagcctagaaatcgtcagcaggtcacatacaactgcagtgataatttcagaacatagcaaaaggctgattttattctacttcacattttagaagtgcattttctcaagttacagggcatttcacttcccttttacatgaagagattttcttttgaatatttttcctctcttttggtagcagtgatagacatgactaataatatattggttctttttgtttgctttttagcagttaatgaactgaagaggcttgatcgtagttctggataggtggctccactcctgaccactgtcaacatcccttatatgttccaaagttgaaaattccactgttaccaattctgaatgttctgtgaacactttagatgagtattaagctgttttctccctttatgacacacatagttgatactgtctggtaaaaggaggctcttgagccattcctatttaattaaaacagaactagttgtagtgtaggaaaaagccactgataaaacaggttatattcttaagcctctctttattgagaacccctagaattgcaggataaacttgatcgaagtaaaatccaaatcttanactaagttctgtgagatttaagagcaataatcaacagttctaagcctaataaagagagctcttaatcagctcagtggtggttaaaaccagctatcttttaaagaagagaaaaaacaaaacacagcaatgccctgtctcttcagaaaattgttttaaaaagttagccaggcatagttagtggcccacgcctgtagtccgagctgtttgggaggttgaggtgggaagattggttgagcccaagattttgaggctgcagtaagccataattgtaccactgcactccagcctgagcgacagagaacaagaccctgtctcaaaaataaagtgggggaaggggtgcaaaattacactgtgagaagccaagaagtttcaaagttctatttatttttctaagtcatttttaatcattatttgttgtttcagtgtttgaatttaacattatgtttttaaagatggagtggattctaaagatgagttgggttcaagatatccaacatatcttttatattgggcttatgtcacttaggtgaagttgagctcctttttctttttaatctccatggaacaatttgtataatttcttgatttaaattgctaaactgagctcttcattcaaaatactaaacaataatttctctttggggggaaaattaaggaaggctttctatacatagaaataaagatgcctaggccgggtgcagtggctcatgcctgtaatcccaatactttggggggctgaggcgggtggatcacctgaggtcaagagttcaagaccagcctgggcaacatggtgaaaccctgcctctactaaaagtacaaaaattagctgggcgtggtggcagctgcctgtaatcccagctactcggaggctgaggcacgagaatcacttgaacctgggaggcgaaggttgcagtgaaccaagatcatgccattgcactccagcctgggcgacagagcaaaactctttatctaaaaaaaaaaaaaaaaaaaagacgcctacagaagcaaggttcttaggtgcagtgactcatgcctgtaattccagcactttgggagtttgaggcaagaggatcacttgagctcaggaattcaaaaccagcctgggcaatatggcaagaccccatctttgcagaatattagcctagcttggtagcacgagtatgtggtcctagctacttggaaggctgaggtgggaaggatcacttgagcctggtaggttgaagctgcagtgagctatattcacaccattgcactctagcttgaacaacaaagtgagatcctgtctcaaaaagaaaaaggaaaaattacagctcacggctgtaatcccagcactttgggaggccaaggcgcgcagatcacttgaggtcaggagtttgagaccagccaacatggtatcaccctgtctctactaaaaatacaaaaattagccaggtgtcgtggcgggtgcctgtaatcccagctactcgggaggctgaggcaggagaatcgcttgaacccaggaggcagagattacagtgaaccaagatgacacctctgcactccagcctgggcaacaggcttaaagactccgtcttaaaaaaaaattaagaatttgtattctcataacatattcagttttaagcttgtagcttttaaatctttgagcacgtaataaaagctgcgtaggccaagtgtggtggctcatgcttgtaatcccagcactttgggaggctgaggcaggaggatcacctgaggtcgggagttcaagagcagcttacccaatatgtagaaaccccgcctctactaaaaatacaaaattagccaggcgtggtcgcatgcctgtaatcctagctactcgggaggctgaggcaggagaatcattgaacccaggaggcggaggttgtggtgggccaatatcacaccattgcactccaacctgggcaacaagagcaagagtccatctaaaaaaagagctgtatataccactttaatctgtccttgggcttcagacttaaatattctcttaaacagcaaaaatactaactaagttaaatttaaaagcaaggagaagcatcattgtaatacgacatccatgtgtattcaaactagaattttctgatggtcttcgtaagataaaggagataattgtcatttctatgacacagcttttataatttgaataaacttagttggagattggagtatttttattatttattttcatgtgagatgggtaatgtgctgacctcataacaaagtttgagggagacacattgtatgtgagaatttgaagtgcttatgaagtacaaaagcagaggccaggtgctcacatctgtaatcccagcactttgggaggccaaggcacacagatcacttgaggtcaggagtttgagaccagcctggccaacatggcgaaaacccctctcttactaaaaatacaaaaattagctggatgtggtggtgtgggcctgtaatcccagctactcgcgaggctgaggcaggagaatcgcttgaacctggcaggcagaggttgcggtgagccaagattgcgtcactgcactccggcgtggacaagagagtgagactccgtcacaaaaaaaaaaaaaaaagaagaaaagtattggattcacatattctaaaaatgctcgtcatttgtggctaattttatcaagtctagtttaatctcatatttacagagtttagttaattctaattagctttgttggaggtcataaaccacattattaaccttgaaccgactctgtgtttacttgagttcctctgcataatagcatgtcaccaccatcataaacatgttggtattgcattatgcttctagaggagacatccaccaatatttgtgtgattttacaaaaagcttttgtaatcagtta

SEQ ID NO: 408671 - DNA, 1578 bp, Homo sapiens
gctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactggtaatttgtgcttcacattaaacttcagagttgaaagatatagaggggaaggaaactcttgtctttttttgtttcctcttcaacaaaacaggagattgtacttttactctttgggagaagtgctgggaaggaagcttccatccacctctctaccttttccagatctttttctagtagaggagtaagagcctgagaggctgacacccactggatggtggtgtattcagagtccagtcccatttcttctctctgtctacgttgcccagcctctgtgtgggtgggtagagagtttgattgtgtcatgaggacccaagttgtcttcattcaggtaataaggaccttatcattcattcatggtaaggtcgaagagctcctgctgcattttttaatctattttcagagatccctggatgaagctaatattttaatctccatttggccctaattatttttttttcttttcctttttgagacggaggtctcactctgtcacacaggctggaagacaaaggcatgatcttggct

SEQ ID NO: 408672 - DNA, 1145 bp, Homo sapiens
aatcgagcccggtacccctagttttagaagtttcactagcatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctggaaattcaggaaaaaacaaggacggaaagacaaggcaaggaagaagttagacccaaatgccatcttgggtaaaaaaggtggccagagtatcccggcggggagttatgatagacgaggggcgcaatccctaagtttccccggttggaaaaaaaggggatcgggggaattccaattgggggcaaagaaaagggaaaatttggaccgactggggaccggcgaacacaggtgggttaactggggcgattgggctaggc

SEQ ID NO: 408673 - DNA, 192 bp, Homo sapiens
cctgggtgacagtgcgagactccatctcaaaaaaaaaaaaagtcgtttttaccttgagtattcagctactgaaaacagttaatatgaatgtgtgtgcaattgaatgtatgtgcaggtgagatttgtttcagaattaaatgagactaaattattttgttctttataggaagtaaatgaaggaattcaggctct

SEQ ID NO: 408674 - DNA, 377 bp, Homo sapiens
gcaagggtgcgcggggggacctgaactcgagctcagggcttgcggcctaggctcctcacggcgcctggccagacccggcgagggaggcgggcgaggtcggcttccgaggcctgcctgctgcgggcctgcaggcggggcggccctgggctccgggccgcagaagggccaggccgagttctgcgccctcggcccgggccaagcccgaggcgccatctgtggtgcagggcttgccccgggaacgtttgaaatatgaccgaagttcgggcatcctgagtctcccaaacgccccgggtcggttttgggtaacgcagagggtggatgtgaggatgagtttccgcgtgcgcggcctgtgactgtgggccaggcctttccacacg

SEQ ID NO: 408675 - DNA, 321 bp, Homo sapiens
attccgtctcaatcagtcaataataaataaataaatatgcacttagacatatacgtaaaactggggtagtgtttggttgacctatcagaatgaagaagtttgatgaagaatatactgatgtttggctgagaaacaaaagattttcataaacatagacgtgatagatcaggtttttaatttcagttagatttttatttgctgggaaatgaatacttttgttaatttttctttccactaaaataatctgtatgttgttttcacagtggcatggcagagagaaatgctaattttgaagcccttcctgaggattggagagcaagg

SEQ ID NO: 408676 - DNA, 284 bp, Homo sapiens
tccccttcaacattcctgggatatatatctaatagtcccatatattgtgaaacttccctattgacgataaagagggctggggaaggctacaagtaagtatatcctattttctctaatctttaaaggttttcccagcagagaaaagacagtaatcaatgatggcttttacaaagtttgaggaaagctgatcctgcaacttttcagctgcaatttcgtaatgtagacttcagcaacagcaatttcaaaaccactgcagttttaaaaaatctgagttatatactttg

SEQ ID NO: 408677 - DNA, 986 bp, Homo sapiens
caacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagtaagcttttgaaagttacttgtagaatgttttttcctcagtactactctacagggatcattgtgcttgacttacaaccattattgggattttgtttttcttatcccatcatctaggtatgttgaagcttatgcagcaaaaactttaaactacagaggtgtaggttttttggtccttgatgatacttttggtagttatcgggggaactcacccccaatatttcaacctaggttctttctattttccataagtgtcggccagctgagaaatagaaagagtataatgagaggaattttacagctgggccgccgggggtgacatcacatatcggtaggactatgatgcccacccgagcctcaaaccagcaagttttttattaagggtttcaaaaggggaggaggtgtaagaacagggagtagatcatgtgcttcaaagggcaaaaaggtactgataagggtctatgttcagcggtgcacatgttgtcttgataaacatcttaaacaacagaaaacagggttcaagagcagagaatcagtctgaccacagacttaccagggccgggtttttccccaccctaataagcctgagggtacttcaggagaccagggcgtatctcagtccttatctcaaccgcataggacagacattcccagagcggcagtttatagacctacccccaggaatgcattccttccccaggatattaatattaatattccttgctaggaaaagaatttagcgatatcttccctacttgcatgtccatttatgggctctatgcaagaagaaaaatatggctctttttgcctgaccctgcaggcagtgagaccttatggt

SEQ ID NO: 408678 - DNA, 436 bp, Homo sapiens
aagcaggaggattgcttaagcccaggaggctgcaatgagtcatgatctcaccactgcagcttgtgcaacagaatgagagcctgtctcaaaaaaaggaggtgggagcgggctatgtttaaccatggccttcagccactgataacaaatgtttgtgtttcagagttcagttgattccaccatctctagttcttcttccactaaaggaataaagaggaaagctacagaaattagcactgcagtggttcagaggtcagctaccattggcagttctccagttctctatagccagtcagctatagctacaggtaattgtgcatagagcgtggtttttcctcaatgtattgtttcttttcttttcagcattagatgccataaaaactaaagaaatgttaaaggctcttgattgcaaagactgtcagtatgcatttattttact

SEQ ID NO: 408679 - DNA, 4118 bp, Homo sapiens
aggcgcttgcgcaagcgcgtgctccgctggttgaaagcggatccgggctggaggcggtgtcacggtgtatgaatattgattacgcgtcgcagcgcccagggcccagcgcccagcctccagtgcccgcccctctcggccgcccgacgctctctgctcgcgcttgggctcgcgatggggaagaagtcccgggcggtacccggccgtaggcccatcctgcaactctctccgccgggtcctcggggcagcacgccgggccgggacccggagccggaacccgacactgagccggactcaaccgcggcggtccccagccagcccgccccgtcggcggcgacgaccaccgcggtgactgccgccgcggcctcggacgactcgccttcagaagatgaacaggaagcggtgcaggaggttcctagagttgttcagaatcctccaaaaccagtcatgaccactagacccacagctgttaaagcaacaggcggtctatgcttgcttggtgcttatgctgacagtgatgacgatgacaatgatgtttccgaaaaactagcacaatccaaagagacaaatggaaaccagtcaactgatattgatagtacattggccaacttcctagcggagatcgatgccataacagctcctcagcctgcagctcctgtaggagcttctgctccacctccaactccacctcgaccagagccaaaggaagcagcaacatctaccctttcttcttctacttcaaatggaacagactccacccaaacatctggttggcaatatgatactcagtgttcactggcaggagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccaccagctcccaaaatgccaccacctgaaaagacaaaaaaaggaaggaaagacaaggcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaaatgctaattttgaagcccttcctgaggattggagagcaaggctgaagagaaggaaaatggctccaaacacatagtttttaagtttttaaaacttttttgtattattgtttgttttgtgttcagttcaaagtcttaaccagttttattgtcaaataaactataaatgttatgggggagatcttataaatttcctgggcaagagtgtatgcatacaaagttttcacttttgtgaaatgtaatttttctgtttttgcaaagggatgaggtgattggaattgctttgaccatgctgcctttattctcaaactggcaaacttagcatgttaggtgtattaacctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcaggtaaaagtcactttaaactgaggaaacggcaaattgtgttttaaagctctttgtatttctccagtttctgaccttgtaaatttgtatatatgcactaataaagctttttttataa

SEQ ID NO: 408680 - DNA, 9838 bp, Homo sapiens
  misc_feature (3796)..(3796): n is a, c, g, or t
gctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacaggacctctggaagcaactactcctgattaacctcggtgaagttaaggaaaacttcgtggctgaagatgtgaatgaagaacaagattactatcctctgccagcaggtcagatgaaaacatttctttatatatttggcttttcttgatttttttttcgttatttgaaatctttgctcttttatttttcagctcccagatcctctccctctctttagctttcactgtgtttgatatcaagaatatgaaatgtgaattccacggtccaagaggggaagagtcacctttcacaaacttcgttgttctcttctttggaagggaaattagtgttctaggcgattgagtcccttcattaatgaaacttgaaaccctgttatgcattggcaaatcacaaaaaaagagaaaagtgttttctaagtctcatctgttggagtgagagggttcagggctgtattcacagagttgctggcagtgcaaatagctttgaattatccttggttctccattctcaattgtcaaagctctttgttgcctttgtgaatagcagtccattaagaggttcgtccctgtgaaagcagactgctgtcctgggacaggaccaaatggaagtgtctttgtaggagaacgggttttaaaacatgtgttttctttcttgtaatttagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggtgagacaatttaccttgtactaattcagccaaaatgactttagaggaaaaatcttattaatttacattattaaaagattttatgtcataataatataagcttctgattgagaatagtggtgtgaactaaaacaaggaatgcatgagttattatggttggaaatcagcatactattgttatcacgtgtaaaactgtgccccaaagtgaaaagataggctaacagattttgattttaaaaaattgttttataaccattctatcatgccactgactaagctgtgggtctccaaaaataggaatgcttgtgctgaggaactagatagttgaactgtcaatatatgtggcatgctgagatttgttatacatttctatacaacacttagtctgttcatattgcaacctcatttctcacctccactaatcttacaaaaagcgtggttggtacaaatcaaaatgatatgaagaaatgccattagtacttgtttcagagaagcaaaataattgatcatgaaaaatcaccagcaatcttctggtctaaaacaattggcaataggatgtctcattccatttttaaggtactcttggaagaatttagtttagttacatacattttttaaaagataggctttcatgctcctcagttcctttagtttttaaaaagtttccaatgtgtaaagaaacttccacctgttaatcttaagaattggtagctatttgttaaactgatggcatatgaaggcaagagtctatgagtcgtttctaaagtaatagatctttgaaaattttaaaaagtgaaatttgtcaataacagagttaagagctgaattcttttgtctaaaacttatcgaaattgatgcttgtactctactggctccctgatgatagtagaaaagcactagtaatgtaccaaatgaaactggttgtgtaccagatgattttgttaacttcttaaatagcctagaaatcgtcagcaggtcacatacaactgcagtgataatttcagaacatagcaaaaggctgattttattctacttcacattttagaagtgcattttctcaagttacagggcatttcacttcccttttacatgaagagattttcttttgaatatttttcctctcttttggtagcagtgatagacatgactaataatatattggttctttttgtttgctttttagcagttaatgaactgaagaggcttgatcgtagttctggataggtggctccactcctgaccactgtcaacatcccttatatgttccaaagttgaaaattccactgttaccaattctgaatgttctgtgaacactttagatgagtattaagctgttttctccctttatgacacacatagttgatactgtctggtaaaaggaggctcttgagccattcctatttaattaaaacagaactagttgtagtgtaggaaaaagccactgataaaacaggttatattcttaagcctctctttattgagaacccctagaattgcaggataaacttgatcgaagtaaaatccaaatcttanactaagttctgtgagatttaagagcaataatcaacagttctaagcctaataaagagagctcttaatcagctcagtggtggttaaaaccagctatcttttaaagaagagaaaaaacaaaacacagcaatgccctgtctcttcagaaaattgttttaaaaagttagccaggcatagttagtggcccacgcctgtagtccgagctgtttgggaggttgaggtgggaagattggttgagcccaagattttgaggctgcagtaagccataattgtaccactgcactccagcctgagcgacagagaacaagaccctgtctcaaaaataaagtgggggaaggggtgcaaaattacactgtgagaagccaagaagtttcaaagttctatttatttttctaagtcatttttaatcattatttgttgtttcagtgtttgaatttaacattatgtttttaaagatggagtggattctaaagatgagttgggttcaagatatccaacatatcttttatattgggcttatgtcacttaggtgaagttgagctcctttttctttttaatctccatggaacaatttgtataatttcttgatttaaattgctaaactgagctcttcattcaaaatactaaacaataatttctctttggggggaaaattaaggaaggctttctatacatagaaataaagatgcctaggccgggtgcagtggctcatgcctgtaatcccaatactttggggggctgaggcgggtggatcacctgaggtcaagagttcaagaccagcctgggcaacatggtgaaaccctgcctctactaaaagtacaaaaattagctgggcgtggtggcagctgcctgtaatcccagctactcggaggctgaggcacgagaatcacttgaacctgggaggcgaaggttgcagtgaaccaagatcatgccattgcactccagcctgggcgacagagcaaaactctttatctaaaaaaaaaaaaaaaaaaaagacgcctacagaagcaaggttcttaggtgcagtgactcatgcctgtaattccagcactttgggagtttgaggcaagaggatcacttgagctcaggaattcaaaaccagcctgggcaatatggcaagaccccatctttgcagaatattagcctagcttggtagcacgagtatgtggtcctagctacttggaaggctgaggtgggaaggatcacttgagcctggtaggttgaagctgcagtgagctatattcacaccattgcactctagcttgaacaacaaagtgagatcctgtctcaaaaagaaaaaggaaaaattacagctcacggctgtaatcccagcactttgggaggccaaggcgcgcagatcacttgaggtcaggagtttgagaccagccaacatggtatcaccctgtctctactaaaaatacaaaaattagccaggtgtcgtggcgggtgcctgtaatcccagctactcgggaggctgaggcaggagaatcgcttgaacccaggaggcagagattacagtgaaccaagatgacacctctgcactccagcctgggcaacaggcttaaagactccgtcttaaaaaaaaattaagaatttgtattctcataacatattcagttttaagcttgtagcttttaaatctttgagcacgtaataaaagctgcgtaggccaagtgtggtggctcatgcttgtaatcccagcactttgggaggctgaggcaggaggatcacctgaggtcgggagttcaagagcagcttacccaatatgtagaaaccccgcctctactaaaaatacaaaattagccaggcgtggtcgcatgcctgtaatcctagctactcgggaggctgaggcaggagaatcattgaacccaggaggcggaggttgtggtgggccaatatcacaccattgcactccaacctgggcaacaagagcaagagtccatctaaaaaaagagctgtatataccactttaatctgtccttgggcttcagacttaaatattctcttaaacagcaaaaatactaactaagttaaatttaaaagcaaggagaagcatcattgtaatacgacatccatgtgtattcaaactagaattttctgatggtcttcgtaagataaaggagataattgtcatttctatgacacagcttttataatttgaataaacttagttggagattggagtatttttattatttattttcatgtgagatgggtaatgtgctgacctcataacaaagtttgagggagacacattgtatgtgagaatttgaagtgcttatgaagtacaaaagcagaggccaggtgctcacatctgtaatcccagcactttgggaggccaaggcacacagatcacttgaggtcaggagtttgagaccagcctggccaacatggcgaaaacccctctcttactaaaaatacaaaaattagctggatgtggtggtgtgggcctgtaatcccagctactcgcgaggctgaggcaggagaatcgcttgaacctggcaggcagaggttgcggtgagccaagattgcgtcactgcactccggcgtggacaagagagtgagactccgtcacaaaaaaaaaaaaaaaagaagaaaagtattggattcacatattctaaaaatgctcgtcatttgtggctaattttatcaagtctagtttaatctcatatttacagagtttagttaattctaattagctttgttggaggtcataaaccacattattaaccttgaaccgactctgtgtttacttgagttcctctgcataatagcatgtcaccaccatcataaacatgttggtattgcattatgcttctagaggagacatccaccaatatttgaaaatctggctggtccgagtgcagtggtgtttacaactaattgatcacaaccagttacagactttgtttcttctccagtcctgctgcttcacttgactagccttttaaaaaaaagaaagaaaatagagaaaatcttaacttatatttacttactgtatgttgtgattagtttaatagaagggagtttaatccttaataattaagttagtcctcaacgtttattgacttagttctgatgtagtccttgtgtactattgtataatgtagactacttggccatacttgattttgtctaaaagttaatgcataaattaatattaaatatggccaaatataaaagtttaatgagtcatttgaggtcatttagccagaaaactgcatttatgttcctggtgaatttttttcaatgtccttttccaaaagtggcagtaagcagctgtcttaaaataaggagacagtgggaatgatgttgttaaagtcttttatacaatgtattgtctgtctgttccataaaaagtaaaactactctattcgtgaccagcttgggcaacatagtgagactgtctctttaaaaaaaaaaaaaaaattaaaaattagcaggtgtggtgatgcacacctgtagtcctagcaattcgggaagctgaggtaggaagatcgcttgagccaagtgtttgaggttagaatgagctatgatcgcaccacctacactccagcctgggcaacagagcaagacccaaatggctcatggttgctttgtttgttttaccttgttgagtgccagtgtgtattttgagcaaagcagtgtaaatggccttcttgccctagagtctttcataattgagccttatttaatctaccacttttgaccatgaaatttaacaggtgacttcttctgggtatctactccaggtgaagtgatattttttttgactgagatgtctaaagctcttggattcctggtatctcaccaggacatcttagtaaaacagcaagtatcagatgaggaatcagacttgagttctagctctggtctggccactaacattgatatgatcttgggcaagttagttcctgcctgggtttcattacctttaactgaggaggttgaaatagatgatttctcatgtctcttctactcctaaattctatgattttagggagaaaatccccttcaacattcctgggatatatatctaatagtcccatatattgtgaaacttccctattgacgataaagagggctggggaaggctacaagttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccaccagctcccaaaatgccaccacctgaaaagacaaaaaaaggaaggaaagacaaggcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaaatgctaattttgaagcccttcctgaggattggagagcaaggctgaagagaaggaaaatggctccaaacacatagtttttaagtttttaaaacttttttgtattattgtttgttttgtgttcagttcaaagtcttaaccagttttattgtcaaataaactataaatgttatgggggagatcttataaatttcctgggcaagagtgtatgcatacaaagttttcacttttgtgaaatgtaatttttctgtttttgcaaagggatgaggtgattggaattgctttgaccatgctgcctttattctcaaactggcaaacttagcatgttaggtgtattaacctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcaggtaaaagtcactttaaactgaggaaacggcaaattgtgttttaaagctctttgtatttctccagtttctgaccttgtaaatttgtatatatgcactaataaagctttttttataa

SEQ ID NO: 408681 - DNA, 9600 bp, Homo sapiens
  misc_feature (3558)..(3558): n is a, c, g, or t
gctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacaggtacgcactcttctccccttttcacctttcacctttgacatctcagacatgatttgtgatcaccaccatctgacgacatgacagcctgtctggagactgagagcagctgcagttagcggtgctgggcaggcaaagcaccgcaagcacaaagtttggccagccacacattggagaaacaaaagcaatgtttaaagtgttccatgtaacggattttttcccaagatatggacaaagctggtttttactctccagagtgttgcacggagtagggcgggcttgggggttaagcgcatgcgagagctctgtgcgctttacaggacctctggaagcaactactcctgattaacctcggtgaagttaaggaaaacttcgtggctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggtgagacaatttaccttgtactaattcagccaaaatgactttagaggaaaaatcttattaatttacattattaaaagattttatgtcataataatataagcttctgattgagaatagtggtgtgaactaaaacaaggaatgcatgagttattatggttggaaatcagcatactattgttatcacgtgtaaaactgtgccccaaagtgaaaagataggctaacagattttgattttaaaaaattgttttataaccattctatcatgccactgactaagctgtgggtctccaaaaataggaatgcttgtgctgaggaactagatagttgaactgtcaatatatgtggcatgctgagatttgttatacatttctatacaacacttagtctgttcatattgcaacctcatttctcacctccactaatcttacaaaaagcgtggttggtacaaatcaaaatgatatgaagaaatgccattagtacttgtttcagagaagcaaaataattgatcatgaaaaatcaccagcaatcttctggtctaaaacaattggcaataggatgtctcattccatttttaaggtactcttggaagaatttagtttagttacatacattttttaaaagataggctttcatgctcctcagttcctttagtttttaaaaagtttccaatgtgtaaagaaacttccacctgttaatcttaagaattggtagctatttgttaaactgatggcatatgaaggcaagagtctatgagtcgtttctaaagtaatagatctttgaaaattttaaaaagtgaaatttgtcaataacagagttaagagctgaattcttttgtctaaaacttatcgaaattgatgcttgtactctactggctccctgatgatagtagaaaagcactagtaatgtaccaaatgaaactggttgtgtaccagatgattttgttaacttcttaaatagcctagaaatcgtcagcaggtcacatacaactgcagtgataatttcagaacatagcaaaaggctgattttattctacttcacattttagaagtgcattttctcaagttacagggcatttcacttcccttttacatgaagagattttcttttgaatatttttcctctcttttggtagcagtgatagacatgactaataatatattggttctttttgtttgctttttagcagttaatgaactgaagaggcttgatcgtagttctggataggtggctccactcctgaccactgtcaacatcccttatatgttccaaagttgaaaattccactgttaccaattctgaatgttctgtgaacactttagatgagtattaagctgttttctccctttatgacacacatagttgatactgtctggtaaaaggaggctcttgagccattcctatttaattaaaacagaactagttgtagtgtaggaaaaagccactgataaaacaggttatattcttaagcctctctttattgagaacccctagaattgcaggataaacttgatcgaagtaaaatccaaatcttanactaagttctgtgagatttaagagcaataatcaacagttctaagcctaataaagagagctcttaatcagctcagtggtggttaaaaccagctatcttttaaagaagagaaaaaacaaaacacagcaatgccctgtctcttcagaaaattgttttaaaaagttagccaggcatagttagtggcccacgcctgtagtccgagctgtttgggaggttgaggtgggaagattggttgagcccaagattttgaggctgcagtaagccataattgtaccactgcactccagcctgagcgacagagaacaagaccctgtctcaaaaataaagtgggggaaggggtgcaaaattacactgtgagaagccaagaagtttcaaagttctatttatttttctaagtcatttttaatcattatttgttgtttcagtgtttgaatttaacattatgtttttaaagatggagtggattctaaagatgagttgggttcaagatatccaacatatcttttatattgggcttatgtcacttaggtgaagttgagctcctttttctttttaatctccatggaacaatttgtataatttcttgatttaaattgctaaactgagctcttcattcaaaatactaaacaataatttctctttggggggaaaattaaggaaggctttctatacatagaaataaagatgcctaggccgggtgcagtggctcatgcctgtaatcccaatactttggggggctgaggcgggtggatcacctgaggtcaagagttcaagaccagcctgggcaacatggtgaaaccctgcctctactaaaagtacaaaaattagctgggcgtggtggcagctgcctgtaatcccagctactcggaggctgaggcacgagaatcacttgaacctgggaggcgaaggttgcagtgaaccaagatcatgccattgcactccagcctgggcgacagagcaaaactctttatctaaaaaaaaaaaaaaaaaaaagacgcctacagaagcaaggttcttaggtgcagtgactcatgcctgtaattccagcactttgggagtttgaggcaagaggatcacttgagctcaggaattcaaaaccagcctgggcaatatggcaagaccccatctttgcagaatattagcctagcttggtagcacgagtatgtggtcctagctacttggaaggctgaggtgggaaggatcacttgagcctggtaggttgaagctgcagtgagctatattcacaccattgcactctagcttgaacaacaaagtgagatcctgtctcaaaaagaaaaaggaaaaattacagctcacggctgtaatcccagcactttgggaggccaaggcgcgcagatcacttgaggtcaggagtttgagaccagccaacatggtatcaccctgtctctactaaaaatacaaaaattagccaggtgtcgtggcgggtgcctgtaatcccagctactcgggaggctgaggcaggagaatcgcttgaacccaggaggcagagattacagtgaaccaagatgacacctctgcactccagcctgggcaacaggcttaaagactccgtcttaaaaaaaaattaagaatttgtattctcataacatattcagttttaagcttgtagcttttaaatctttgagcacgtaataaaagctgcgtaggccaagtgtggtggctcatgcttgtaatcccagcactttgggaggctgaggcaggaggatcacctgaggtcgggagttcaagagcagcttacccaatatgtagaaaccccgcctctactaaaaatacaaaattagccaggcgtggtcgcatgcctgtaatcctagctactcgggaggctgaggcaggagaatcattgaacccaggaggcggaggttgtggtgggccaatatcacaccattgcactccaacctgggcaacaagagcaagagtccatctaaaaaaagagctgtatataccactttaatctgtccttgggcttcagacttaaatattctcttaaacagcaaaaatactaactaagttaaatttaaaagcaaggagaagcatcattgtaatacgacatccatgtgtattcaaactagaattttctgatggtcttcgtaagataaaggagataattgtcatttctatgacacagcttttataatttgaataaacttagttggagattggagtatttttattatttattttcatgtgagatgggtaatgtgctgacctcataacaaagtttgagggagacacattgtatgtgagaatttgaagtgcttatgaagtacaaaagcagaggccaggtgctcacatctgtaatcccagcactttgggaggccaaggcacacagatcacttgaggtcaggagtttgagaccagcctggccaacatggcgaaaacccctctcttactaaaaatacaaaaattagctggatgtggtggtgtgggcctgtaatcccagctactcgcgaggctgaggcaggagaatcgcttgaacctggcaggcagaggttgcggtgagccaagattgcgtcactgcactccggcgtggacaagagagtgagactccgtcacaaaaaaaaaaaaaaaagaagaaaagtattggattcacatattctaaaaatgctcgtcatttgtggctaattttatcaagtctagtttaatctcatatttacagagtttagttaattctaattagctttgttggaggtcataaaccacattattaaccttgaaccgactctgtgtttacttgagttcctctgcataatagcatgtcaccaccatcataaacatgttggtattgcattatgcttctagaggagacatccaccaatatttgaaaatctggctggtccgagtgcagtggtgtttacaactaattgatcacaaccagttacagactttgtttcttctccagtcctgctgcttcacttgactagccttttaaaaaaaagaaagaaaatagagaaaatcttaacttatatttacttactgtatgttgtgattagtttaatagaagggagtttaatccttaataattaagttagtcctcaacgtttattgacttagttctgatgtagtccttgtgtactattgtataatgtagactacttggccatacttgattttgtctaaaagttaatgcataaattaatattaaatatggccaaatataaaagtttaatgagtcatttgaggtcatttagccagaaaactgcatttatgttcctggtgaatttttttcaatgtccttttccaaaagtggcagtaagcagctgtcttaaaataaggagacagtgggaatgatgttgttaaagtcttttatacaatgtattgtctgtctgttccataaaaagtaaaactactctattcgtgaccagcttgggcaacatagtgagactgtctctttaaaaaaaaaaaaaaaattaaaaattagcaggtgtggtgatgcacacctgtagtcctagcaattcgggaagctgaggtaggaagatcgcttgagccaagtgtttgaggttagaatgagctatgatcgcaccacctacactccagcctgggcaacagagcaagacccaaatggctcatggttgctttgtttgttttaccttgttgagtgccagtgtgtattttgagcaaagcagtgtaaatggccttcttgccctagagtctttcataattgagccttatttaatctaccacttttgaccatgaaatttaacaggtgacttcttctgggtatctactccaggtgaagtgatattttttttgactgagatgtctaaagctcttggattcctggtatctcaccaggacatcttagtaaaacagcaagtatcagatgaggaatcagacttgagttctagctctggtctggccactaacattgatatgatcttgggcaagttagttcctgcctgggtttcattacctttaactgaggaggttgaaatagatgatttctcatgtctcttctactcctaaattctatgattttagggagaaaatccccttcaacattcctgggatatatatctaatagtcccatatattgtgaaacttccctattgacgataaagagggctggggaaggctacaagttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccaccagctcccaaaatgccaccacctgaaaagacaaaaaaaggaaggaaagacaaggcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaaatgctaattttgaagcccttcctgaggattggagagcaaggctgaagagaaggaaaatggctccaaacacatagtttttaagtttttaaaacttttttgtattattgtttgttttgtgttcagttcaaagtcttaaccagttttattgtcaaataaactataaatgttatgggggagatcttataaatttcctgggcaagagtgtatgcatacaaagttttcacttttgtgaaatgtaatttttctgtttttgcaaagggatgaggtgattggaattgctttgaccatgctgcctttattctcaaactggcaaacttagcatgttaggtgtattaacctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcaggtaaaagtcactttaaactgaggaaacggcaaattgtgttttaaagctctttgtatttctccagtttctgaccttgtaaatttgtatatatgcactaataaagctttttttataa

SEQ ID NO: 408682 - DNA, 10101 bp, Homo sapiens
  misc_feature (4113)..(4113): n is a, c, g, or t
gctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacaggtacgcactcttctccccttttcacctttcacctttgacatctcagacatgatttgtgatcaccaccatctgacgacatgacagcctgtctggagactgagagcagctgcagttagcggtgctgggcaggcaaagcaccgcaagcacaaagtttggccagccacacattggagaaacaaaagcaatgtttaaagtgttccatgtaacggattttttcccaagatatggacaaagctggtttttactctccagagtgttgcacggagtagggcgggcttgggggttaagcgcatgcgagagctctgtgcgctttacaggacctctggaagcaactactcctgattaacctcggtgaagttaaggaaaacttcgtggctgaagatgtgaatgaagaacaagattactatcctctgccagcaggtcagatgaaaacatttctttatatatttggcttttcttgatttttttttcgttatttgaaatctttgctcttttatttttcagctcccagatcctctccctctctttagctttcactgtgtttgatatcaagaatatgaaatgtgaattccacggtccaagaggggaagagtcacctttcacaaacttcgttgttctcttctttggaagggaaattagtgttctaggcgattgagtcccttcattaatgaaacttgaaaccctgttatgcattggcaaatcacaaaaaaagagaaaagtgttttctaagtctcatctgttggagtgagagggttcagggctgtattcacagagttgctggcagtgcaaatagctttgaattatccttggttctccattctcaattgtcaaagctctttgttgcctttgtgaatagcagtccattaagaggttcgtccctgtgaaagcagactgctgtcctgggacaggaccaaatggaagtgtctttgtaggagaacgggttttaaaacatgtgttttctttcttgtaatttagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggtgagacaatttaccttgtactaattcagccaaaatgactttagaggaaaaatcttattaatttacattattaaaagattttatgtcataataatataagcttctgattgagaatagtggtgtgaactaaaacaaggaatgcatgagttattatggttggaaatcagcatactattgttatcacgtgtaaaactgtgccccaaagtgaaaagataggctaacagattttgattttaaaaaattgttttataaccattctatcatgccactgactaagctgtgggtctccaaaaataggaatgcttgtgctgaggaactagatagttgaactgtcaatatatgtggcatgctgagatttgttatacatttctatacaacacttagtctgttcatattgcaacctcatttctcacctccactaatcttacaaaaagcgtggttggtacaaatcaaaatgatatgaagaaatgccattagtacttgtttcagagaagcaaaataattgatcatgaaaaatcaccagcaatcttctggtctaaaacaattggcaataggatgtctcattccatttttaaggtactcttggaagaatttagtttagttacatacattttttaaaagataggctttcatgctcctcagttcctttagtttttaaaaagtttccaatgtgtaaagaaacttccacctgttaatcttaagaattggtagctatttgttaaactgatggcatatgaaggcaagagtctatgagtcgtttctaaagtaatagatctttgaaaattttaaaaagtgaaatttgtcaataacagagttaagagctgaattcttttgtctaaaacttatcgaaattgatgcttgtactctactggctccctgatgatagtagaaaagcactagtaatgtaccaaatgaaactggttgtgtaccagatgattttgttaacttcttaaatagcctagaaatcgtcagcaggtcacatacaactgcagtgataatttcagaacatagcaaaaggctgattttattctacttcacattttagaagtgcattttctcaagttacagggcatttcacttcccttttacatgaagagattttcttttgaatatttttcctctcttttggtagcagtgatagacatgactaataatatattggttctttttgtttgctttttagcagttaatgaactgaagaggcttgatcgtagttctggataggtggctccactcctgaccactgtcaacatcccttatatgttccaaagttgaaaattccactgttaccaattctgaatgttctgtgaacactttagatgagtattaagctgttttctccctttatgacacacatagttgatactgtctggtaaaaggaggctcttgagccattcctatttaattaaaacagaactagttgtagtgtaggaaaaagccactgataaaacaggttatattcttaagcctctctttattgagaacccctagaattgcaggataaacttgatcgaagtaaaatccaaatcttanactaagttctgtgagatttaagagcaataatcaacagttctaagcctaataaagagagctcttaatcagctcagtggtggttaaaaccagctatcttttaaagaagagaaaaaacaaaacacagcaatgccctgtctcttcagaaaattgttttaaaaagttagccaggcatagttagtggcccacgcctgtagtccgagctgtttgggaggttgaggtgggaagattggttgagcccaagattttgaggctgcagtaagccataattgtaccactgcactccagcctgagcgacagagaacaagaccctgtctcaaaaataaagtgggggaaggggtgcaaaattacactgtgagaagccaagaagtttcaaagttctatttatttttctaagtcatttttaatcattatttgttgtttcagtgtttgaatttaacattatgtttttaaagatggagtggattctaaagatgagttgggttcaagatatccaacatatcttttatattgggcttatgtcacttaggtgaagttgagctcctttttctttttaatctccatggaacaatttgtataatttcttgatttaaattgctaaactgagctcttcattcaaaatactaaacaataatttctctttggggggaaaattaaggaaggctttctatacatagaaataaagatgcctaggccgggtgcagtggctcatgcctgtaatcccaatactttggggggctgaggcgggtggatcacctgaggtcaagagttcaagaccagcctgggcaacatggtgaaaccctgcctctactaaaagtacaaaaattagctgggcgtggtggcagctgcctgtaatcccagctactcggaggctgaggcacgagaatcacttgaacctgggaggcgaaggttgcagtgaaccaagatcatgccattgcactccagcctgggcgacagagcaaaactctttatctaaaaaaaaaaaaaaaaaaaagacgcctacagaagcaaggttcttaggtgcagtgactcatgcctgtaattccagcactttgggagtttgaggcaagaggatcacttgagctcaggaattcaaaaccagcctgggcaatatggcaagaccccatctttgcagaatattagcctagcttggtagcacgagtatgtggtcctagctacttggaaggctgaggtgggaaggatcacttgagcctggtaggttgaagctgcagtgagctatattcacaccattgcactctagcttgaacaacaaagtgagatcctgtctcaaaaagaaaaaggaaaaattacagctcacggctgtaatcccagcactttgggaggccaaggcgcgcagatcacttgaggtcaggagtttgagaccagccaacatggtatcaccctgtctctactaaaaatacaaaaattagccaggtgtcgtggcgggtgcctgtaatcccagctactcgggaggctgaggcaggagaatcgcttgaacccaggaggcagagattacagtgaaccaagatgacacctctgcactccagcctgggcaacaggcttaaagactccgtcttaaaaaaaaattaagaatttgtattctcataacatattcagttttaagcttgtagcttttaaatctttgagcacgtaataaaagctgcgtaggccaagtgtggtggctcatgcttgtaatcccagcactttgggaggctgaggcaggaggatcacctgaggtcgggagttcaagagcagcttacccaatatgtagaaaccccgcctctactaaaaatacaaaattagccaggcgtggtcgcatgcctgtaatcctagctactcgggaggctgaggcaggagaatcattgaacccaggaggcggaggttgtggtgggccaatatcacaccattgcactccaacctgggcaacaagagcaagagtccatctaaaaaaagagctgtatataccactttaatctgtccttgggcttcagacttaaatattctcttaaacagcaaaaatactaactaagttaaatttaaaagcaaggagaagcatcattgtaatacgacatccatgtgtattcaaactagaattttctgatggtcttcgtaagataaaggagataattgtcatttctatgacacagcttttataatttgaataaacttagttggagattggagtatttttattatttattttcatgtgagatgggtaatgtgctgacctcataacaaagtttgagggagacacattgtatgtgagaatttgaagtgcttatgaagtacaaaagcagaggccaggtgctcacatctgtaatcccagcactttgggaggccaaggcacacagatcacttgaggtcaggagtttgagaccagcctggccaacatggcgaaaacccctctcttactaaaaatacaaaaattagctggatgtggtggtgtgggcctgtaatcccagctactcgcgaggctgaggcaggagaatcgcttgaacctggcaggcagaggttgcggtgagccaagattgcgtcactgcactccggcgtggacaagagagtgagactccgtcacaaaaaaaaaaaaaaaagaagaaaagtattggattcacatattctaaaaatgctcgtcatttgtggctaattttatcaagtctagtttaatctcatatttacagagtttagttaattctaattagctttgttggaggtcataaaccacattattaaccttgaaccgactctgtgtttacttgagttcctctgcataatagcatgtcaccaccatcataaacatgttggtattgcattatgcttctagaggagacatccaccaatatttgaaaatctggctggtccgagtgcagtggtgtttacaactaattgatcacaaccagttacagactttgtttcttctccagtcctgctgcttcacttgactagccttttaaaaaaaagaaagaaaatagagaaaatcttaacttatatttacttactgtatgttgtgattagtttaatagaagggagtttaatccttaataattaagttagtcctcaacgtttattgacttagttctgatgtagtccttgtgtactattgtataatgtagactacttggccatacttgattttgtctaaaagttaatgcataaattaatattaaatatggccaaatataaaagtttaatgagtcatttgaggtcatttagccagaaaactgcatttatgttcctggtgaatttttttcaatgtccttttccaaaagtggcagtaagcagctgtcttaaaataaggagacagtgggaatgatgttgttaaagtcttttatacaatgtattgtctgtctgttccataaaaagtaaaactactctattcgtgaccagcttgggcaacatagtgagactgtctctttaaaaaaaaaaaaaaaattaaaaattagcaggtgtggtgatgcacacctgtagtcctagcaattcgggaagctgaggtaggaagatcgcttgagccaagtgtttgaggttagaatgagctatgatcgcaccacctacactccagcctgggcaacagagcaagacccaaatggctcatggttgctttgtttgttttaccttgttgagtgccagtgtgtattttgagcaaagcagtgtaaatggccttcttgccctagagtctttcataattgagccttatttaatctaccacttttgaccatgaaatttaacaggtgacttcttctgggtatctactccaggtgaagtgatattttttttgactgagatgtctaaagctcttggattcctggtatctcaccaggacatcttagtaaaacagcaagtatcagatgaggaatcagacttgagttctagctctggtctggccactaacattgatatgatcttgggcaagttagttcctgcctgggtttcattacctttaactgaggaggttgaaatagatgatttctcatgtctcttctactcctaaattctatgattttagggagaaaatccccttcaacattcctgggatatatatctaatagtcccatatattgtgaaacttccctattgacgataaagagggctggggaaggctacaagttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccaccagctcccaaaatgccaccacctgaaaagacaaaaaaaggaaggaaagacaaggcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaaatgctaattttgaagcccttcctgaggattggagagcaaggctgaagagaaggaaaatggctccaaacacatagtttttaagttttttttattgtcaaataaactataaatgttatgggggagatcttataaatttcctgggcaagagtgtatgcatacaaagttttcacttttgtgaaatgtaatttttctgtttttgcaaagggatgaggtgattggaattgctttgaccatgctgcctttattctcaaactggcaaacttagcatgttaggtgtattaacctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcaggtaaaagtcactttaaactgaggaaacggcaaattgtgttttaaagctctttgtatttctccagtttctgaccttgtaaatttgtatatatgcactaataaagctttttttataa

SEQ ID NO: 408683 - DNA, 3550 bp, Homo sapiens
gctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccaccagctcccaaaatgccaccacctgaaaagacaaaaaaaggaaggaaagacaaggcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaaatgctaattttgaagcccttcctgaggattggagagcaaggctgaagagaaggaaaatggctccaaacacatagtttttaagtttttaaaacttttttgtattattgtttgttttgtgttcagttcaaagtcttaaccagttttattgtcaaataaactataaatgttatgggggagatcttataaatttcctgggcaagagtgtatgcatacaaagttttcacttttgtgaaatgtaatttttctgtttttgcaaagggatgaggtgattggaattgctttgaccatgctgcctttattctcaaactggcaaacttagcatgttaggtgtattaacctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcaggtaaaagtcactttaaactgaggaaacggcaaattgtgttttaaagctctttgtatttctccagtttctgaccttgtaaatttgtatatatgcactaataaagctttttttataa

SEQ ID NO: 408684 - DNA, 8417 bp, Homo sapiens
  misc_feature (2375)..(2375): n is a, c, g, or t
gctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacaggtacgcactcttctccccttttcacctttcacctttgacatctcagacatgatttgtgatcaccaccatctgacgacatgacagcctgtctggagactgagagcagctgcagttagcggtgctgggcaggcaaagcaccgcaagcacaaagtttggccagccacacattggagaaacaaaagcaatgtttaaagtgttccatgtaacggattttttcccaagatatggacaaagctggtttttactctccagagtgttgcacggagtagggcgggcttgggggttaagcgcatgcgagagctctgtgcgctttacaggacctctggaagcaactactcctgattaacctcggtgaagttaaggaaaacttcgtggctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagcagttaatgaactgaagaggcttgatcgtagttctggataggtggctccactcctgaccactgtcaacatcccttatatgttccaaagttgaaaattccactgttaccaattctgaatgttctgtgaacactttagatgagtattaagctgttttctccctttatgacacacatagttgatactgtctggtaaaaggaggctcttgagccattcctatttaattaaaacagaactagttgtagtgtaggaaaaagccactgataaaacaggttatattcttaagcctctctttattgagaacccctagaattgcaggataaacttgatcgaagtaaaatccaaatcttanactaagttctgtgagatttaagagcaataatcaacagttctaagcctaataaagagagctcttaatcagctcagtggtggttaaaaccagctatcttttaaagaagagaaaaaacaaaacacagcaatgccctgtctcttcagaaaattgttttaaaaagttagccaggcatagttagtggcccacgcctgtagtccgagctgtttgggaggttgaggtgggaagattggttgagcccaagattttgaggctgcagtaagccataattgtaccactgcactccagcctgagcgacagagaacaagaccctgtctcaaaaataaagtgggggaaggggtgcaaaattacactgtgagaagccaagaagtttcaaagttctatttatttttctaagtcatttttaatcattatttgttgtttcagtgtttgaatttaacattatgtttttaaagatggagtggattctaaagatgagttgggttcaagatatccaacatatcttttatattgggcttatgtcacttaggtgaagttgagctcctttttctttttaatctccatggaacaatttgtataatttcttgatttaaattgctaaactgagctcttcattcaaaatactaaacaataatttctctttggggggaaaattaaggaaggctttctatacatagaaataaagatgcctaggccgggtgcagtggctcatgcctgtaatcccaatactttggggggctgaggcgggtggatcacctgaggtcaagagttcaagaccagcctgggcaacatggtgaaaccctgcctctactaaaagtacaaaaattagctgggcgtggtggcagctgcctgtaatcccagctactcggaggctgaggcacgagaatcacttgaacctgggaggcgaaggttgcagtgaaccaagatcatgccattgcactccagcctgggcgacagagcaaaactctttatctaaaaaaaaaaaaaaaaaaaagacgcctacagaagcaaggttcttaggtgcagtgactcatgcctgtaattccagcactttgggagtttgaggcaagaggatcacttgagctcaggaattcaaaaccagcctgggcaatatggcaagaccccatctttgcagaatattagcctagcttggtagcacgagtatgtggtcctagctacttggaaggctgaggtgggaaggatcacttgagcctggtaggttgaagctgcagtgagctatattcacaccattgcactctagcttgaacaacaaagtgagatcctgtctcaaaaagaaaaaggaaaaattacagctcacggctgtaatcccagcactttgggaggccaaggcgcgcagatcacttgaggtcaggagtttgagaccagccaacatggtatcaccctgtctctactaaaaatacaaaaattagccaggtgtcgtggcgggtgcctgtaatcccagctactcgggaggctgaggcaggagaatcgcttgaacccaggaggcagagattacagtgaaccaagatgacacctctgcactccagcctgggcaacaggcttaaagactccgtcttaaaaaaaaattaagaatttgtattctcataacatattcagttttaagcttgtagcttttaaatctttgagcacgtaataaaagctgcgtaggccaagtgtggtggctcatgcttgtaatcccagcactttgggaggctgaggcaggaggatcacctgaggtcgggagttcaagagcagcttacccaatatgtagaaaccccgcctctactaaaaatacaaaattagccaggcgtggtcgcatgcctgtaatcctagctactcgggaggctgaggcaggagaatcattgaacccaggaggcggaggttgtggtgggccaatatcacaccattgcactccaacctgggcaacaagagcaagagtccatctaaaaaaagagctgtatataccactttaatctgtccttgggcttcagacttaaatattctcttaaacagcaaaaatactaactaagttaaatttaaaagcaaggagaagcatcattgtaatacgacatccatgtgtattcaaactagaattttctgatggtcttcgtaagataaaggagataattgtcatttctatgacacagcttttataatttgaataaacttagttggagattggagtatttttattatttattttcatgtgagatgggtaatgtgctgacctcataacaaagtttgagggagacacattgtatgtgagaatttgaagtgcttatgaagtacaaaagcagaggccaggtgctcacatctgtaatcccagcactttgggaggccaaggcacacagatcacttgaggtcaggagtttgagaccagcctggccaacatggcgaaaacccctctcttactaaaaatacaaaaattagctggatgtggtggtgtgggcctgtaatcccagctactcgcgaggctgaggcaggagaatcgcttgaacctggcaggcagaggttgcggtgagccaagattgcgtcactgcactccggcgtggacaagagagtgagactccgtcacaaaaaaaaaaaaaaaagaagaaaagtattggattcacatattctaaaaatgctcgtcatttgtggctaattttatcaagtctagtttaatctcatatttacagagtttagttaattctaattagctttgttggaggtcataaaccacattattaaccttgaaccgactctgtgtttacttgagttcctctgcataatagcatgtcaccaccatcataaacatgttggtattgcattatgcttctagaggagacatccaccaatatttgaaaatctggctggtccgagtgcagtggtgtttacaactaattgatcacaaccagttacagactttgtttcttctccagtcctgctgcttcacttgactagccttttaaaaaaaagaaagaaaatagagaaaatcttaacttatatttacttactgtatgttgtgattagtttaatagaagggagtttaatccttaataattaagttagtcctcaacgtttattgacttagttctgatgtagtccttgtgtactattgtataatgtagactacttggccatacttgattttgtctaaaagttaatgcataaattaatattaaatatggccaaatataaaagtttaatgagtcatttgaggtcatttagccagaaaactgcatttatgttcctggtgaatttttttcaatgtccttttccaaaagtggcagtaagcagctgtcttaaaataaggagacagtgggaatgatgttgttaaagtcttttatacaatgtattgtctgtctgttccataaaaagtaaaactactctattcgtgaccagcttgggcaacatagtgagactgtctctttaaaaaaaaaaaaaaaattaaaaattagcaggtgtggtgatgcacacctgtagtcctagcaattcgggaagctgaggtaggaagatcgcttgagccaagtgtttgaggttagaatgagctatgatcgcaccacctacactccagcctgggcaacagagcaagacccaaatggctcatggttgctttgtttgttttaccttgttgagtgccagtgtgtattttgagcaaagcagtgtaaatggccttcttgccctagagtctttcataattgagccttatttaatctaccacttttgaccatgaaatttaacaggtgacttcttctgggtatctactccaggtgaagtgatattttttttgactgagatgtctaaagctcttggattcctggtatctcaccaggacatcttagtaaaacagcaagtatcagatgaggaatcagacttgagttctagctctggtctggccactaacattgatatgatcttgggcaagttagttcctgcctgggtttcattacctttaactgaggaggttgaaatagatgatttctcatgtctcttctactcctaaattctatgattttagggagaaaatccccttcaacattcctgggatatatatctaatagtcccatatattgtgaaacttccctattgacgataaagagggctggggaaggctacaagttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccaccagctcccaaaatgccaccacctgaaaagacaaaaaaaggaaggaaagacaaggcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaaatgctaattttgaagcccttcctgaggattggagagcaaggctgaagagaaggaaaatggctccaaacacatagtttttaagtttttaaaacttttttgtattattgtttgttttgtgttcagttcaaagtcttaaccagttttattgtcaaataaactataaatgttatgggggagatcttataaatttcctgggcaagagtgtatgcatacaaagttttcacttttgtgaaatgtaatttttctgtttttgcaaagggatgaggtgattggaattgctttgaccatgctgcctttattctcaaactggcaaacttagcatgttaggtgtattaacctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcaggtaaaagtcactttaaactgaggaaacggcaaattgtgttttaaagctctttgtatttctccagtttctgaccttgtaaatttgtatatatgcactaataaagctttttttataa

SEQ ID NO: 408685 - DNA, 5856 bp, Homo sapiens
ggctctttgcgtgcgaggcatacatagtcaatgagggagtatcattgagcccaagattttgaggctgcagtaagccataattgtaccactgcactccagcctgagcgacagagaacaagaccctgtctcaaaaataaagtgggggaaggggtgcaaaattacactgtgagaagccaagaagtttcaaagttctatttatttttctaagtcatttttaatcattatttgttgtttcagtgtttgaatttaacattatgtttttaaagatggagtggattctaaagatgagttgggttcaagatatccaacatatcttttatattgggcttatgtcacttaggtgaagttgagctcctttttctttttaatctccatggaacaatttgtataatttcttgatttaaattgctaaactgagctcttcattcaaaatactaaacaataatttctctttggggggaaaattaaggaaggctttctatacatagaaataaagatgcctaggccgggtgcagtggctcatgcctgtaatcccaatactttggggggctgaggcgggtggatcacctgaggtcaagagttcaagaccagcctgggcaacatggtgaaaccctgcctctactaaaagtacaaaaattagctgggcgtggtggcagctgcctgtaatcccagctactcggaggctgaggcacgagaatcacttgaacctgggaggcgaaggttgcagtgaaccaagatcatgccattgcactccagcctgggcgacagagcaaaactctttatctaaaaaaaaaaaaaaaaaaaagacgcctacagaagcaaggttcttaggtgcagtgactcatgcctgtaattccagcactttgggagtttgaggcaagaggatcacttgagctcaggaattcaaaaccagcctgggcaatatggcaagaccccatctttgcagaatattagcctagcttggtagcacgagtatgtggtcctagctacttggaaggctgaggtgggaaggatcacttgagcctggtaggttgaagctgcagtgagctatattcacaccattgcactctagcttgaacaacaaagtgagatcctgtctcaaaaagaaaaaggaaaaattacagctcacggctgtaatcccagcactttgggaggccaaggcgcgcagatcacttgaggtcaggagtttgagaccagccaacatggtatcaccctgtctctactaaaaatacaaaaattagccaggtgtcgtggcgggtgcctgtaatcccagctactcgggaggctgaggcaggagaatcgcttgaacccaggaggcagagattacagtgaaccaagatgacacctctgcactccagcctgggcaacaggcttaaagactccgtcttaaaaaaaaattaagaatttgtattctcataacatattcagttttaagcttgtagcttttaaatctttgagcacgtaataaaagctgcgtaggccaagtgtggtggctcatgcttgtaatcccagcactttgggaggctgaggcaggaggatcacctgaggtcgggagttcaagagcagcttacccaatatgtagaaaccccgcctctactaaaaatacaaaattagccaggcgtggtcgcatgcctgtaatcctagctactcgggaggctgaggcaggagaatcattgaacccaggaggcggaggttgtggtgggccaatatcacaccattgcactccaacctgggcaacaagagcaagagtccatctaaaaaaagagctgtatataccactttaatctgtccttgggcttcagacttaaatattctcttaaacagcaaaaatactaactaagttaaatttaaaagcaaggagaagcatcattgtaatacgacatccatgtgtattcaaactagaattttctgatggtcttcgtaagataaaggagataattgtcatttctatgacacagcttttataatttgaataaacttagttggagattggagtatttttattatttattttcatgtgagatgggtaatgtgctgacctcataacaaagtttgagggagacacattgtatgtgagaatttgaagtgcttatgaagtacaaaagcagaggccaggtgctcacatctgtaatcccagcactttgggaggccaaggcacacagatcacttgaggtcaggagtttgagaccagcctggccaacatggcgaaaacccctctcttactaaaaatacaaaaattagctggatgtggtggtgtgggcctgtaatcccagctactcgcgaggctgaggcaggagaatcgcttgaacctggcaggcagaggttgcggtgagccaagattgcgtcactgcactccggcgtggacaagagagtgagactccgtcacaaaaaaaaaaaaaaaagaagaaaagtattggattcacatattctaaaaatgctcgtcatttgtggctaattttatcaagtctagtttaatctcatatttacagagtttagttaattctaattagctttgttggaggtcataaaccacattattaaccttgaaccgactctgtgtttacttgagttcctctgcataatagcatgtcaccaccatcataaacatgttggtattgcattatgcttctagaggagacatccaccaatatttgaaaatctggctggtccgagtgcagtggtgtttacaactaattgatcacaaccagttacagactttgtttcttctccagtcctgctgcttcacttgactagccttttaaaaaaaagaaagaaaatagagaaaatcttaacttatatttacttactgtatgttgtgattagtttaatagaagggagtttaatccttaataattaagttagtcctcaacgtttattgacttagttctgatgtagtccttgtgtactattgtataatgtagactacttggccatacttgattttgtctaaaagttaatgcataaattaatattaaatatggccaaatataaaagtttaatgagtcatttgaggtcatttagccagaaaactgcatttatgttcctggtgaatttttttcaatgtccttttccaaaagtggcagtaagcagctgtcttaaaataaggagacagtgggaatgatgttgttaaagtcttttatacaatgtattgtctgtctgttccataaaaagtaaaactactctattcgtgaccagcttgggcaacatagtgagactgtctctttaaaaaaaaaaaaaaaattaaaaattagcaggtgtggtgatgcacacctgtagtcctagcaattcgggaagctgaggtaggaagatcgcttgagccaagtgtttgaggttagaatgagctatgatcgcaccacctacactccagcctgggcaacagagcaagacccaaatggctcatggttgctttgtttgttttaccttgttgagtgccagtgtgtattttgagcaaagcagtgtaaatggccttcttgccctagagtctttcataattgagccttatttaatctaccacttttgaccatgaaatttaacaggtgacttcttctgggtatctactccaggtgaagtgatattttttttgactgagatgtctaaagctcttggattcctggtatctcaccaggacatcttagtaaaacagcaagtatcagatgaggaatcagacttgagttctagctctggtctggccactaacattgatatgatcttgggcaagttagttcctgcctgggtttcattacctttaactgaggaggttgaaatagatgatttctcatgtctcttctactcctaaattctatgattttagggagaaaatccccttcaacattcctgggatatatatctaatagtcccatatattgtgaaacttccctattgacgataaagagggctggggaaggctacaagttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccaccagctcccaaaatgccaccacctgaaaagacaaaaaaaggaaggaaagacaaggcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaaatgctaattttgaagcccttcctgaggattggagagcaaggctgaagagaaggaaaatggctccaaacacatagtttttaagtttttaaaacttttttgtattattgtttgttttgtgttcagttcaaagtcttaaccagttttattgtcaaataaactataaatgttatgggggagatcttataaatttcctgggcaagagtgtatgcatacaaagttttcacttttgtgaaatgtaatttttctgtttttgcaaagggatgaggtgattggaattgctttgaccatgctgcctttattctcaaactggcaaacttagcatgttaggtgtattaacctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcaggtaaaagtcactttaaactgaggaaacggcaaattgtgttttaaagctctttgtatttctccagtttctgaccttgtaaatttgtatatatgcactaataaagctttttttataa

SEQ ID NO: 408686 - DNA, 3653 bp, Homo sapiens
gctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacaggacctctggaagcaactactcctgattaacctcggtgaagttaaggaaaacttcgtggctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccaccagctcccaaaatgccaccacctgaaaagacaaaaaaaggaaggaaagacaaggcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaaatgctaattttgaagcccttcctgaggattggagagcaaggctgaagagaaggaaaatggctccaaacacatagtttttaagtttttaaaacttttttgtattattgtttgttttgtgttcagttcaaagtcttaaccagttttattgtcaaataaactataaatgttatgggggagatcttataaatttcctgggcaagagtgtatgcatacaaagttttcacttttgtgaaatgtaatttttctgtttttgcaaagggatgaggtgattggaattgctttgaccatgctgcctttattctcaaactggcaaacttagcatgttaggtgtattaacctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcaggtaaaagtcactttaaactgaggaaacggcaaattgtgttttaaagctctttgtatttctccagtttctgaccttgtaaatttgtatatatgcactaataaagctttttttataa

SEQ ID NO: 408687 - DNA, 9274 bp, Homo sapiens
  misc_feature (4113)..(4113): n is a, c, g, or t
gctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacaggtacgcactcttctccccttttcacctttcacctttgacatctcagacatgatttgtgatcaccaccatctgacgacatgacagcctgtctggagactgagagcagctgcagttagcggtgctgggcaggcaaagcaccgcaagcacaaagtttggccagccacacattggagaaacaaaagcaatgtttaaagtgttccatgtaacggattttttcccaagatatggacaaagctggtttttactctccagagtgttgcacggagtagggcgggcttgggggttaagcgcatgcgagagctctgtgcgctttacaggacctctggaagcaactactcctgattaacctcggtgaagttaaggaaaacttcgtggctgaagatgtgaatgaagaacaagattactatcctctgccagcaggtcagatgaaaacatttctttatatatttggcttttcttgatttttttttcgttatttgaaatctttgctcttttatttttcagctcccagatcctctccctctctttagctttcactgtgtttgatatcaagaatatgaaatgtgaattccacggtccaagaggggaagagtcacctttcacaaacttcgttgttctcttctttggaagggaaattagtgttctaggcgattgagtcccttcattaatgaaacttgaaaccctgttatgcattggcaaatcacaaaaaaagagaaaagtgttttctaagtctcatctgttggagtgagagggttcagggctgtattcacagagttgctggcagtgcaaatagctttgaattatccttggttctccattctcaattgtcaaagctctttgttgcctttgtgaatagcagtccattaagaggttcgtccctgtgaaagcagactgctgtcctgggacaggaccaaatggaagtgtctttgtaggagaacgggttttaaaacatgtgttttctttcttgtaatttagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggtgagacaatttaccttgtactaattcagccaaaatgactttagaggaaaaatcttattaatttacattattaaaagattttatgtcataataatataagcttctgattgagaatagtggtgtgaactaaaacaaggaatgcatgagttattatggttggaaatcagcatactattgttatcacgtgtaaaactgtgccccaaagtgaaaagataggctaacagattttgattttaaaaaattgttttataaccattctatcatgccactgactaagctgtgggtctccaaaaataggaatgcttgtgctgaggaactagatagttgaactgtcaatatatgtggcatgctgagatttgttatacatttctatacaacacttagtctgttcatattgcaacctcatttctcacctccactaatcttacaaaaagcgtggttggtacaaatcaaaatgatatgaagaaatgccattagtacttgtttcagagaagcaaaataattgatcatgaaaaatcaccagcaatcttctggtctaaaacaattggcaataggatgtctcattccatttttaaggtactcttggaagaatttagtttagttacatacattttttaaaagataggctttcatgctcctcagttcctttagtttttaaaaagtttccaatgtgtaaagaaacttccacctgttaatcttaagaattggtagctatttgttaaactgatggcatatgaaggcaagagtctatgagtcgtttctaaagtaatagatctttgaaaattttaaaaagtgaaatttgtcaataacagagttaagagctgaattcttttgtctaaaacttatcgaaattgatgcttgtactctactggctccctgatgatagtagaaaagcactagtaatgtaccaaatgaaactggttgtgtaccagatgattttgttaacttcttaaatagcctagaaatcgtcagcaggtcacatacaactgcagtgataatttcagaacatagcaaaaggctgattttattctacttcacattttagaagtgcattttctcaagttacagggcatttcacttcccttttacatgaagagattttcttttgaatatttttcctctcttttggtagcagtgatagacatgactaataatatattggttctttttgtttgctttttagcagttaatgaactgaagaggcttgatcgtagttctggataggtggctccactcctgaccactgtcaacatcccttatatgttccaaagttgaaaattccactgttaccaattctgaatgttctgtgaacactttagatgagtattaagctgttttctccctttatgacacacatagttgatactgtctggtaaaaggaggctcttgagccattcctatttaattaaaacagaactagttgtagtgtaggaaaaagccactgataaaacaggttatattcttaagcctctctttattgagaacccctagaattgcaggataaacttgatcgaagtaaaatccaaatcttanactaagttctgtgagatttaagagcaataatcaacagttctaagcctaataaagagagctcttaatcagctcagtggtggttaaaaccagctatcttttaaagaagagaaaaaacaaaacacagcaatgccctgtctcttcagaaaattgttttaaaaagttagccaggcatagttagtggcccacgcctgtagtccgagctgtttgggaggttgaggtgggaagattggttgagcccaagattttgaggctgcagtaagccataattgtaccactgcactccagcctgagcgacagagaacaagaccctgtctcaaaaataaagtgggggaaggggtgcaaaattacactgtgagaagccaagaagtttcaaagttctatttatttttctaagtcatttttaatcattatttgttgtttcagtgtttgaatttaacattatgtttttaaagatggagtggattctaaagatgagttgggttcaagatatccaacatatcttttatattgggcttatgtcacttaggtgaagttgagctcctttttctttttaatctccatggaacaatttgtataatttcttgatttaaattgctaaactgagctcttcattcaaaatactaaacaataatttctctttggggggaaaattaaggaaggctttctatacatagaaataaagatgcctaggccgggtgcagtggctcatgcctgtaatcccaatactttggggggctgaggcgggtggatcacctgaggtcaagagttcaagaccagcctgggcaacatggtgaaaccctgcctctactaaaagtacaaaaattagctgggcgtggtggcagctgcctgtaatcccagctactcggaggctgaggcacgagaatcacttgaacctgggaggcgaaggttgcagtgaaccaagatcatgccattgcactccagcctgggcgacagagcaaaactctttatctaaaaaaaaaaaaaaaaaaaagacgcctacagaagcaaggttcttaggtgcagtgactcatgcctgtaattccagcactttgggagtttgaggcaagaggatcacttgagctcaggaattcaaaaccagcctgggcaatatggcaagaccccatctttgcagaatattagcctagcttggtagcacgagtatgtggtcctagctacttggaaggctgaggtgggaaggatcacttgagcctggtaggttgaagctgcagtgagctatattcacaccattgcactctagcttgaacaacaaagtgagatcctgtctcaaaaagaaaaaggaaaaattacagctcacggctgtaatcccagcactttgggaggccaaggcgcgcagatcacttgaggtcaggagtttgagaccagccaacatggtatcaccctgtctctactaaaaatacaaaaattagccaggtgtcgtggcgggtgcctgtaatcccagctactcgggaggctgaggcaggagaatcgcttgaacccaggaggcagagattacagtgaaccaagatgacacctctgcactccagcctgggcaacaggcttaaagactccgtcttaaaaaaaaattaagaatttgtattctcataacatattcagttttaagcttgtagcttttaaatctttgagcacgtaataaaagctgcgtaggccaagtgtggtggctcatgcttgtaatcccagcactttgggaggctgaggcaggaggatcacctgaggtcgggagttcaagagcagcttacccaatatgtagaaaccccgcctctactaaaaatacaaaattagccaggcgtggtcgcatgcctgtaatcctagctactcgggaggctgaggcaggagaatcattgaacccaggaggcggaggttgtggtgggccaatatcacaccattgcactccaacctgggcaacaagagcaagagtccatctaaaaaaagagctgtatataccactttaatctgtccttgggcttcagacttaaatattctcttaaacagcaaaaatactaactaagttaaatttaaaagcaaggagaagcatcattgtaatacgacatccatgtgtattcaaactagaattttctgatggtcttcgtaagataaaggagataattgtcatttctatgacacagcttttataatttgaataaacttagttggagattggagtatttttattatttattttcatgtgagatgggtaatgtgctgacctcataacaaagtttgagggagacacattgtatgtgagaatttgaagtgcttatgaagtacaaaagcagaggccaggtgctcacatctgtaatcccagcactttgggaggccaaggcacacagatcacttgaggtcaggagtttgagaccagcctggccaacatggcgaaaacccctctcttactaaaaatacaaaaattagctggatgtggtggtgtgggcctgtaatcccagctactcgcgaggctgaggcaggagaatcgcttgaacctggcaggcagaggttgcggtgagccaagattgcgtcactgcactccggcgtggacaagagagtgagactccgtcacaaaaaaaaaaaaaaaagaagaaaagtattggattcacatattctaaaaatgctcgtcatttgtggctaattttatcaagtctagtttaatctcatatttacagagtttagttaattctaattagctttgttggaggtcataaaccacattattaaccttgaaccgactctgtgtttacttgagttcctctgcataatagcatgtcaccaccatcataaacatgttggtattgcattatgcttctagaggagacatccaccaatatttgaaaatctggctggtccgagtgcagtggtgtttacaactaattgatcacaaccagttacagactttgtttcttctccagtcctgctgcttcacttgactagccttttaaaaaaaagaaagaaaatagagaaaatcttaacttatatttacttactgtatgttgtgattagtttaatagaagggagtttaatccttaataattaagttagtcctcaacgtttattgacttagttctgatgtagtccttgtgtactattgtataatgtagactacttggccatacttgattttgtctaaaagttaatgcataaattaatattaaatatggccaaatataaaagtttaatgagtcatttgaggtcatttagccagaaaactgcatttatgttcctggtgaatttttttcaatgtccttttccaaaagtggcagtaagcagctgtcttaaaataaggagacagtgggaatgatgttgttaaagtcttttatacaatgtattgtctgtctgttccataaaaagtaaaactactctattcgtgaccagcttgggcaacatagtgagactgtctctttaaaaaaaaaaaaaaaattaaaaattagcaggtgtggtgatgcacacctgtagtcctagcaattcgggaagctgaggtaggaagatcgcttgagccaagtgtttgaggttagaatgagctatgatcgcaccacctacactccagcctgggcaacagagcaagacccaaatggctcatggttgctttgtttgttttaccttgttgagtgccagtgtgtattttgagcaaagcagtgtaaatggccttcttgccctagagtctttcataattgagccttatttaatctaccacttttgaccatgaaatttaacaggtgacttcttctgggtatctactccaggtgaagtgatattttttttgactgagatgtctaaagctcttggattcctggtatctcaccaggacatcttagtaaaacagcaagtatcagatgaggaatcagacttgagttctagctctggtctggccactaacattgatatgatcttgggcaagttagttcctgcctgggtttcattacctttaactgaggaggttgaaatagatgatttctcatgtctcttctactcctaaattctatgattttagggagaaaatccccttcaacattcctgggatatatatctaatagtcccatatattgtgaaacttccctattgacgataaagagggctggggaaggctacaagttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccaccagctcccaaaatgccaccacctgaaaagacaaaaaaaggaaggaaagacaaggcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaactgaactgtggaaaaatgacctttccttaacttgaagctacttttaaaatttgagggtctggaccaaagaagaggatatcatgtgcgggata

SEQ ID NO: 408688 - DNA, 9028 bp, Homo sapiens
  misc_feature (4113)..(4113): n is a, c, g, or t
gctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacaggtacgcactcttctccccttttcacctttcacctttgacatctcagacatgatttgtgatcaccaccatctgacgacatgacagcctgtctggagactgagagcagctgcagttagcggtgctgggcaggcaaagcaccgcaagcacaaagtttggccagccacacattggagaaacaaaagcaatgtttaaagtgttccatgtaacggattttttcccaagatatggacaaagctggtttttactctccagagtgttgcacggagtagggcgggcttgggggttaagcgcatgcgagagctctgtgcgctttacaggacctctggaagcaactactcctgattaacctcggtgaagttaaggaaaacttcgtggctgaagatgtgaatgaagaacaagattactatcctctgccagcaggtcagatgaaaacatttctttatatatttggcttttcttgatttttttttcgttatttgaaatctttgctcttttatttttcagctcccagatcctctccctctctttagctttcactgtgtttgatatcaagaatatgaaatgtgaattccacggtccaagaggggaagagtcacctttcacaaacttcgttgttctcttctttggaagggaaattagtgttctaggcgattgagtcccttcattaatgaaacttgaaaccctgttatgcattggcaaatcacaaaaaaagagaaaagtgttttctaagtctcatctgttggagtgagagggttcagggctgtattcacagagttgctggcagtgcaaatagctttgaattatccttggttctccattctcaattgtcaaagctctttgttgcctttgtgaatagcagtccattaagaggttcgtccctgtgaaagcagactgctgtcctgggacaggaccaaatggaagtgtctttgtaggagaacgggttttaaaacatgtgttttctttcttgtaatttagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggtgagacaatttaccttgtactaattcagccaaaatgactttagaggaaaaatcttattaatttacattattaaaagattttatgtcataataatataagcttctgattgagaatagtggtgtgaactaaaacaaggaatgcatgagttattatggttggaaatcagcatactattgttatcacgtgtaaaactgtgccccaaagtgaaaagataggctaacagattttgattttaaaaaattgttttataaccattctatcatgccactgactaagctgtgggtctccaaaaataggaatgcttgtgctgaggaactagatagttgaactgtcaatatatgtggcatgctgagatttgttatacatttctatacaacacttagtctgttcatattgcaacctcatttctcacctccactaatcttacaaaaagcgtggttggtacaaatcaaaatgatatgaagaaatgccattagtacttgtttcagagaagcaaaataattgatcatgaaaaatcaccagcaatcttctggtctaaaacaattggcaataggatgtctcattccatttttaaggtactcttggaagaatttagtttagttacatacattttttaaaagataggctttcatgctcctcagttcctttagtttttaaaaagtttccaatgtgtaaagaaacttccacctgttaatcttaagaattggtagctatttgttaaactgatggcatatgaaggcaagagtctatgagtcgtttctaaagtaatagatctttgaaaattttaaaaagtgaaatttgtcaataacagagttaagagctgaattcttttgtctaaaacttatcgaaattgatgcttgtactctactggctccctgatgatagtagaaaagcactagtaatgtaccaaatgaaactggttgtgtaccagatgattttgttaacttcttaaatagcctagaaatcgtcagcaggtcacatacaactgcagtgataatttcagaacatagcaaaaggctgattttattctacttcacattttagaagtgcattttctcaagttacagggcatttcacttcccttttacatgaagagattttcttttgaatatttttcctctcttttggtagcagtgatagacatgactaataatatattggttctttttgtttgctttttagcagttaatgaactgaagaggcttgatcgtagttctggataggtggctccactcctgaccactgtcaacatcccttatatgttccaaagttgaaaattccactgttaccaattctgaatgttctgtgaacactttagatgagtattaagctgttttctccctttatgacacacatagttgatactgtctggtaaaaggaggctcttgagccattcctatttaattaaaacagaactagttgtagtgtaggaaaaagccactgataaaacaggttatattcttaagcctctctttattgagaacccctagaattgcaggataaacttgatcgaagtaaaatccaaatcttanactaagttctgtgagatttaagagcaataatcaacagttctaagcctaataaagagagctcttaatcagctcagtggtggttaaaaccagctatcttttaaagaagagaaaaaacaaaacacagcaatgccctgtctcttcagaaaattgttttaaaaagttagccaggcatagttagtggcccacgcctgtagtccgagctgtttgggaggttgaggtgggaagattggttgagcccaagattttgaggctgcagtaagccataattgtaccactgcactccagcctgagcgacagagaacaagaccctgtctcaaaaataaagtgggggaaggggtgcaaaattacactgtgagaagccaagaagtttcaaagttctatttatttttctaagtcatttttaatcattatttgttgtttcagtgtttgaatttaacattatgtttttaaagatggagtggattctaaagatgagttgggttcaagatatccaacatatcttttatattgggcttatgtcacttaggtgaagttgagctcctttttctttttaatctccatggaacaatttgtataatttcttgatttaaattgctaaactgagctcttcattcaaaatactaaacaataatttctctttggggggaaaattaaggaaggctttctatacatagaaataaagatgcctaggccgggtgcagtggctcatgcctgtaatcccaatactttggggggctgaggcgggtggatcacctgaggtcaagagttcaagaccagcctgggcaacatggtgaaaccctgcctctactaaaagtacaaaaattagctgggcgtggtggcagctgcctgtaatcccagctactcggaggctgaggcacgagaatcacttgaacctgggaggcgaaggttgcagtgaaccaagatcatgccattgcactccagcctgggcgacagagcaaaactctttatctaaaaaaaaaaaaaaaaaaaagacgcctacagaagcaaggttcttaggtgcagtgactcatgcctgtaattccagcactttgggagtttgaggcaagaggatcacttgagctcaggaattcaaaaccagcctgggcaatatggcaagaccccatctttgcagaatattagcctagcttggtagcacgagtatgtggtcctagctacttggaaggctgaggtgggaaggatcacttgagcctggtaggttgaagctgcagtgagctatattcacaccattgcactctagcttgaacaacaaagtgagatcctgtctcaaaaagaaaaaggaaaaattacagctcacggctgtaatcccagcactttgggaggccaaggcgcgcagatcacttgaggtcaggagtttgagaccagccaacatggtatcaccctgtctctactaaaaatacaaaaattagccaggtgtcgtggcgggtgcctgtaatcccagctactcgggaggctgaggcaggagaatcgcttgaacccaggaggcagagattacagtgaaccaagatgacacctctgcactccagcctgggcaacaggcttaaagactccgtcttaaaaaaaaattaagaatttgtattctcataacatattcagttttaagcttgtagcttttaaatctttgagcacgtaataaaagctgcgtaggccaagtgtggtggctcatgcttgtaatcccagcactttgggaggctgaggcaggaggatcacctgaggtcgggagttcaagagcagcttacccaatatgtagaaaccccgcctctactaaaaatacaaaattagccaggcgtggtcgcatgcctgtaatcctagctactcgggaggctgaggcaggagaatcattgaacccaggaggcggaggttgtggtgggccaatatcacaccattgcactccaacctgggcaacaagagcaagagtccatctaaaaaaagagctgtatataccactttaatctgtccttgggcttcagacttaaatattctcttaaacagcaaaaatactaactaagttaaatttaaaagcaaggagaagcatcattgtaatacgacatccatgtgtattcaaactagaattttctgatggtcttcgtaagataaaggagataattgtcatttctatgacacagcttttataatttgaataaacttagttggagattggagtatttttattatttattttcatgtgagatgggtaatgtgctgacctcataacaaagtttgagggagacacattgtatgtgagaatttgaagtgcttatgaagtacaaaagcagaggccaggtgctcacatctgtaatcccagcactttgggaggccaaggcacacagatcacttgaggtcaggagtttgagaccagcctggccaacatggcgaaaacccctctcttactaaaaatacaaaaattagctggatgtggtggtgtgggcctgtaatcccagctactcgcgaggctgaggcaggagaatcgcttgaacctggcaggcagaggttgcggtgagccaagattgcgtcactgcactccggcgtggacaagagagtgagactccgtcacaaaaaaaaaaaaaaaagaagaaaagtattggattcacatattctaaaaatgctcgtcatttgtggctaattttatcaagtctagtttaatctcatatttacagagtttagttaattctaattagctttgttggaggtcataaaccacattattaaccttgaaccgactctgtgtttacttgagttcctctgcataatagcatgtcaccaccatcataaacatgttggtattgcattatgcttctagaggagacatccaccaatatttgaaaatctggctggtccgagtgcagtggtgtttacaactaattgatcacaaccagttacagactttgtttcttctccagtcctgctgcttcacttgactagccttttaaaaaaaagaaagaaaatagagaaaatcttaacttatatttacttactgtatgttgtgattagtttaatagaagggagtttaatccttaataattaagttagtcctcaacgtttattgacttagttctgatgtagtccttgtgtactattgtataatgtagactacttggccatacttgattttgtctaaaagttaatgcataaattaatattaaatatggccaaatataaaagtttaatgagtcatttgaggtcatttagccagaaaactgcatttatgttcctggtgaatttttttcaatgtccttttccaaaagtggcagtaagcagctgtcttaaaataaggagacagtgggaatgatgttgttaaagtcttttatacaatgtattgtctgtctgttccataaaaagtaaaactactctattcgtgaccagcttgggcaacatagtgagactgtctctttaaaaaaaaaaaaaaaattaaaaattagcaggtgtggtgatgcacacctgtagtcctagcaattcgggaagctgaggtaggaagatcgcttgagccaagtgtttgaggttagaatgagctatgatcgcaccacctacactccagcctgggcaacagagcaagacccaaatggctcatggttgctttgtttgttttaccttgttgagtgccagtgtgtattttgagcaaagcagtgtaaatggccttcttgccctagagtctttcataattgagccttatttaatctaccacttttgaccatgaaatttaacaggtgacttcttctgggtatctactccaggtgaagtgatattttttttgactgagatgtctaaagctcttggattcctggtatctcaccaggacatcttagtaaaacagcaagtatcagatgaggaatcagacttgagttctagctctggtctggccactaacattgatatgatcttgggcaagttagttcctgcctgggtttcattacctttaactgaggaggttgaaatagatgatttctcatgtctcttctactcctaaattctatgattttagggagaaaatccccttcaacattcctgggatatatatctaatagtcccatatattgtgaaacttccctattgacgataaagagggctggggaaggctacaagttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccaccagctcccaaaatgccaccacctgaaaagacaaaaaaaggaaggaaagacaaggtataataaatttcccttttt

SEQ ID NO: 408689 - DNA, 8954 bp, Homo sapiens
  misc_feature (4113)..(4113): n is a, c, g, or t
  misc_feature (8898)..(8898): n is a, c, g, or t
gctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacaggtacgcactcttctccccttttcacctttcacctttgacatctcagacatgatttgtgatcaccaccatctgacgacatgacagcctgtctggagactgagagcagctgcagttagcggtgctgggcaggcaaagcaccgcaagcacaaagtttggccagccacacattggagaaacaaaagcaatgtttaaagtgttccatgtaacggattttttcccaagatatggacaaagctggtttttactctccagagtgttgcacggagtagggcgggcttgggggttaagcgcatgcgagagctctgtgcgctttacaggacctctggaagcaactactcctgattaacctcggtgaagttaaggaaaacttcgtggctgaagatgtgaatgaagaacaagattactatcctctgccagcaggtcagatgaaaacatttctttatatatttggcttttcttgatttttttttcgttatttgaaatctttgctcttttatttttcagctcccagatcctctccctctctttagctttcactgtgtttgatatcaagaatatgaaatgtgaattccacggtccaagaggggaagagtcacctttcacaaacttcgttgttctcttctttggaagggaaattagtgttctaggcgattgagtcccttcattaatgaaacttgaaaccctgttatgcattggcaaatcacaaaaaaagagaaaagtgttttctaagtctcatctgttggagtgagagggttcagggctgtattcacagagttgctggcagtgcaaatagctttgaattatccttggttctccattctcaattgtcaaagctctttgttgcctttgtgaatagcagtccattaagaggttcgtccctgtgaaagcagactgctgtcctgggacaggaccaaatggaagtgtctttgtaggagaacgggttttaaaacatgtgttttctttcttgtaatttagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggtgagacaatttaccttgtactaattcagccaaaatgactttagaggaaaaatcttattaatttacattattaaaagattttatgtcataataatataagcttctgattgagaatagtggtgtgaactaaaacaaggaatgcatgagttattatggttggaaatcagcatactattgttatcacgtgtaaaactgtgccccaaagtgaaaagataggctaacagattttgattttaaaaaattgttttataaccattctatcatgccactgactaagctgtgggtctccaaaaataggaatgcttgtgctgaggaactagatagttgaactgtcaatatatgtggcatgctgagatttgttatacatttctatacaacacttagtctgttcatattgcaacctcatttctcacctccactaatcttacaaaaagcgtggttggtacaaatcaaaatgatatgaagaaatgccattagtacttgtttcagagaagcaaaataattgatcatgaaaaatcaccagcaatcttctggtctaaaacaattggcaataggatgtctcattccatttttaaggtactcttggaagaatttagtttagttacatacattttttaaaagataggctttcatgctcctcagttcctttagtttttaaaaagtttccaatgtgtaaagaaacttccacctgttaatcttaagaattggtagctatttgttaaactgatggcatatgaaggcaagagtctatgagtcgtttctaaagtaatagatctttgaaaattttaaaaagtgaaatttgtcaataacagagttaagagctgaattcttttgtctaaaacttatcgaaattgatgcttgtactctactggctccctgatgatagtagaaaagcactagtaatgtaccaaatgaaactggttgtgtaccagatgattttgttaacttcttaaatagcctagaaatcgtcagcaggtcacatacaactgcagtgataatttcagaacatagcaaaaggctgattttattctacttcacattttagaagtgcattttctcaagttacagggcatttcacttcccttttacatgaagagattttcttttgaatatttttcctctcttttggtagcagtgatagacatgactaataatatattggttctttttgtttgctttttagcagttaatgaactgaagaggcttgatcgtagttctggataggtggctccactcctgaccactgtcaacatcccttatatgttccaaagttgaaaattccactgttaccaattctgaatgttctgtgaacactttagatgagtattaagctgttttctccctttatgacacacatagttgatactgtctggtaaaaggaggctcttgagccattcctatttaattaaaacagaactagttgtagtgtaggaaaaagccactgataaaacaggttatattcttaagcctctctttattgagaacccctagaattgcaggataaacttgatcgaagtaaaatccaaatcttanactaagttctgtgagatttaagagcaataatcaacagttctaagcctaataaagagagctcttaatcagctcagtggtggttaaaaccagctatcttttaaagaagagaaaaaacaaaacacagcaatgccctgtctcttcagaaaattgttttaaaaagttagccaggcatagttagtggcccacgcctgtagtccgagctgtttgggaggttgaggtgggaagattggttgagcccaagattttgaggctgcagtaagccataattgtaccactgcactccagcctgagcgacagagaacaagaccctgtctcaaaaataaagtgggggaaggggtgcaaaattacactgtgagaagccaagaagtttcaaagttctatttatttttctaagtcatttttaatcattatttgttgtttcagtgtttgaatttaacattatgtttttaaagatggagtggattctaaagatgagttgggttcaagatatccaacatatcttttatattgggcttatgtcacttaggtgaagttgagctcctttttctttttaatctccatggaacaatttgtataatttcttgatttaaattgctaaactgagctcttcattcaaaatactaaacaataatttctctttggggggaaaattaaggaaggctttctatacatagaaataaagatgcctaggccgggtgcagtggctcatgcctgtaatcccaatactttggggggctgaggcgggtggatcacctgaggtcaagagttcaagaccagcctgggcaacatggtgaaaccctgcctctactaaaagtacaaaaattagctgggcgtggtggcagctgcctgtaatcccagctactcggaggctgaggcacgagaatcacttgaacctgggaggcgaaggttgcagtgaaccaagatcatgccattgcactccagcctgggcgacagagcaaaactctttatctaaaaaaaaaaaaaaaaaaaagacgcctacagaagcaaggttcttaggtgcagtgactcatgcctgtaattccagcactttgggagtttgaggcaagaggatcacttgagctcaggaattcaaaaccagcctgggcaatatggcaagaccccatctttgcagaatattagcctagcttggtagcacgagtatgtggtcctagctacttggaaggctgaggtgggaaggatcacttgagcctggtaggttgaagctgcagtgagctatattcacaccattgcactctagcttgaacaacaaagtgagatcctgtctcaaaaagaaaaaggaaaaattacagctcacggctgtaatcccagcactttgggaggccaaggcgcgcagatcacttgaggtcaggagtttgagaccagccaacatggtatcaccctgtctctactaaaaatacaaaaattagccaggtgtcgtggcgggtgcctgtaatcccagctactcgggaggctgaggcaggagaatcgcttgaacccaggaggcagagattacagtgaaccaagatgacacctctgcactccagcctgggcaacaggcttaaagactccgtcttaaaaaaaaattaagaatttgtattctcataacatattcagttttaagcttgtagcttttaaatctttgagcacgtaataaaagctgcgtaggccaagtgtggtggctcatgcttgtaatcccagcactttgggaggctgaggcaggaggatcacctgaggtcgggagttcaagagcagcttacccaatatgtagaaaccccgcctctactaaaaatacaaaattagccaggcgtggtcgcatgcctgtaatcctagctactcgggaggctgaggcaggagaatcattgaacccaggaggcggaggttgtggtgggccaatatcacaccattgcactccaacctgggcaacaagagcaagagtccatctaaaaaaagagctgtatataccactttaatctgtccttgggcttcagacttaaatattctcttaaacagcaaaaatactaactaagttaaatttaaaagcaaggagaagcatcattgtaatacgacatccatgtgtattcaaactagaattttctgatggtcttcgtaagataaaggagataattgtcatttctatgacacagcttttataatttgaataaacttagttggagattggagtatttttattatttattttcatgtgagatgggtaatgtgctgacctcataacaaagtttgagggagacacattgtatgtgagaatttgaagtgcttatgaagtacaaaagcagaggccaggtgctcacatctgtaatcccagcactttgggaggccaaggcacacagatcacttgaggtcaggagtttgagaccagcctggccaacatggcgaaaacccctctcttactaaaaatacaaaaattagctggatgtggtggtgtgggcctgtaatcccagctactcgcgaggctgaggcaggagaatcgcttgaacctggcaggcagaggttgcggtgagccaagattgcgtcactgcactccggcgtggacaagagagtgagactccgtcacaaaaaaaaaaaaaaaagaagaaaagtattggattcacatattctaaaaatgctcgtcatttgtggctaattttatcaagtctagtttaatctcatatttacagagtttagttaattctaattagctttgttggaggtcataaaccacattattaaccttgaaccgactctgtgtttacttgagttcctctgcataatagcatgtcaccaccatcataaacatgttggtattgcattatgcttctagaggagacatccaccaatatttgaaaatctggctggtccgagtgcagtggtgtttacaactaattgatcacaaccagttacagactttgtttcttctccagtcctgctgcttcacttgactagccttttaaaaaaaagaaagaaaatagagaaaatcttaacttatatttacttactgtatgttgtgattagtttaatagaagggagtttaatccttaataattaagttagtcctcaacgtttattgacttagttctgatgtagtccttgtgtactattgtataatgtagactacttggccatacttgattttgtctaaaagttaatgcataaattaatattaaatatggccaaatataaaagtttaatgagtcatttgaggtcatttagccagaaaactgcatttatgttcctggtgaatttttttcaatgtccttttccaaaagtggcagtaagcagctgtcttaaaataaggagacagtgggaatgatgttgttaaagtcttttatacaatgtattgtctgtctgttccataaaaagtaaaactactctattcgtgaccagcttgggcaacatagtgagactgtctctttaaaaaaaaaaaaaaaattaaaaattagcaggtgtggtgatgcacacctgtagtcctagcaattcgggaagctgaggtaggaagatcgcttgagccaagtgtttgaggttagaatgagctatgatcgcaccacctacactccagcctgggcaacagagcaagacccaaatggctcatggttgctttgtttgttttaccttgttgagtgccagtgtgtattttgagcaaagcagtgtaaatggccttcttgccctagagtctttcataattgagccttatttaatctaccacttttgaccatgaaatttaacaggtgacttcttctgggtatctactccaggtgaagtgatattttttttgactgagatgtctaaagctcttggattcctggtatctcaccaggacatcttagtaaaacagcaagtatcagatgaggaatcagacttgagttctagctctggtctggccactaacattgatatgatcttgggcaagttagttcctgcctgggtttcattacctttaactgaggaggttgaaatagatgatttctcatgtctcttctactcctaaattctatgattttagggagaaaatccccttcaacattcctgggatatatatctaatagtcccatatattgtgaaacttccctattgacgataaagagggctggggaaggctacaagttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctgncacactcagtccccaccacactgaatctcccctcaatagcctcgtggagatcctct

SEQ ID NO: 408690 - DNA, 1145 bp, Homo sapiens
cgtggatccctcgggctgcaggacttcggcacgagaaaggaaggaatgacagcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaaatgctaattttgaagcccttcctgaggattggagagcaaggctgaagagaaggaaaatggctccaaacacatagtttttaagttttttttattgtcaaataaactataaatgttatgggggagatcttataaatttcctgggcaagagtgtatgcatacaaagttttcacttttgtgaaatgtaatttttctgtttttgcaaagggatgaggtgattggaattgctttgaccatgctgcctttattctcaaactggcaaacttagcatgttaggtgtattaacctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcaggtaaaagtcactttaaactgaggaaacggcaaattgtgttttaaagctctttgtatttctccagtttctgaccttgtaaatttgtatatatgcactaataaagctttttttataa

SEQ ID NO: 408691 - DNA, 1559 bp, Homo sapiens
gctgaagatgtgaatgaagaacaagattactatcctctgccagcagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgaggtaagtctttttttttttttttttgggcataaacagttaagtttttggaatgaaatgctgtatgtgttaacgattctgtcttgcttacattttaagcctaaatttaaatttttaacccttgaagaatatttgagccgacaatccaggaaataaaactgtgttaaccaaagcacagtaaatagacttttttctcacaatttaaaattatattatcatggtcagatgaggccatgtaatgttgaagttactttgtttaatattaaagcattataagtc

SEQ ID NO: 408692 - DNA, 262 bp, Homo sapiens
gcgggaagctgaaaggctggcccgagtcttgcaggagttcgcaatccaggcggggagttaggaagtgactcttttttaagggggagctggacagctctcgtcggccttcaccaagcgcccacttcgtgtccggcctcaggccacacaaccagaagggcccgggcctagaagcccgagggctcggggtaacgaggcgacgccgggcggcggggaggaggccggggaccgccggggttcctgcaggcctgggacggcgggcctg

SEQ ID NO: 408693 - DNA, 319 bp, Homo sapiens
cttgaacccaggaggcagaggttgcggtgagctgagattgcacgattgcactccatcctgggcaacaagagtgaaactccgtctcaaaaaaaaaaggtggtaaagctttccttaataatttgctttatttcaaaagcatgtaactttaaacttgctacttatatgttcatctttttctgaaatgtactaactcatacttcctattggtgtgaaaatgtttgatgtggcttaaactctgtgactgaataacactgttttaaatacttgtaatatcacatgagctacagagcttcagccagaaaatgttagctatttaatg

SEQ ID NO: 408694 - DNA, 447 bp, Homo sapiens
acaggttgatgggtgcagcaaaccaccatggcacttgtatacatatgtaacaaacctgcatgttctccacatgtatcccagaactgaaagtataataataaaaaaataaagatacattttcttgcctagaaccttgcttctgctaagattactttcaaaagtaagatttattccaagggtaagaataatgaactgtagtgataccagcattcccagaactatccgtggtagaagctaactggcatgtttgaagactgcaaggctctaggttgagcagataatttattgtctaaatggagctacttctaagagtgaaggagggtgttaatctcactggagcaagaagcatacataccatcctggaaaaacctggacatagttgaccatcactagacagtccctaaaattccaccttttgagattcacttcataaggggtgagaagatt

SEQ ID NO: 408695 - DNA, 405 bp, Homo sapiens
tgctacggatggtactccaagcttcaggtgtgttgagactagcaagatagtaggtaaggacagcatgggggtggggtgcagtgtgtgctggacgatgaaaagctgagaaaacaaagaggaggatcccacaggcaacagctctcagaacacctctatattcaccatatccaagaaacttgatggtatatacatctcttcagaggacaccaaaatgcaaaatcaaaatcttacttcatctggacctcacctgctggaaagctggggaaggagttccataacatgacactgaggaaaaaaaagcaagaaaaagcactctgaagcccagacttgggggaagactgcagatttctggctatcatggtagtgttcaccatcaaaaccctcagatttcagacgaaaagaaca

SEQ ID NO: 408696 - DNA, 382 bp, Homo sapiens
aggcactgctcaaagaagaaagggacaccatccctagtttcaaggcgcgacttgtcctgcccctgatggctgtggctgatccacgaggaagtaaacttggactgggaaaacacaaactggtctcggcctgcaacatacatcccattgataaatgtattgataaaccctaacatcgataagacatctgtctggacctttcaggtctgaacagacagggcagctgctgagaacctggggaaactgacaatccgattcctctctgtgtctgaaccttccctcttctcactgcaccaccagtgcaggcctctttgactcacacaagaccgtttttttagcacaaggtcacctcgaggtcaaccgtcaaccccaatgctacagaaac

SEQ ID NO: 408697 - DNA, 527 bp, Homo sapiens
ctgcagcctcaggaaggtgggctggctctccataccccacccaggtgggcctcagacacccagggaggtgctgggatggtgatgggttctcctatttacacaagaacaaaggctcctgctccacacaaagccgtggtgatgagcgtggagaaagaggctgccaggctaatttcagttccagcacaattaaaacggctctgataatgcaggagacaactgtcagcccacaaataggatgtgtcgaggtggatgctgccctgggcctgcctcggtgtctgagagcagctgcctggtccccaccgagcccctaagtcagcaccggtctcgtctgtggcccacctggggtccgtggggactctccaggtgggcgacagagcacttgggcccccagtggctgggggcatctgtgagccacagctgctctctgctgctttctccccatgcccggggctagcaaagaacccccctagcctctctggggaccctctctctgcccagtgatgccaacagctggagcaggccaaccc

SEQ ID NO: 408698 - DNA, 688 bp, Homo sapiens
tgagcaggccacaatgtccaggtcccactgacaaggcccctgttgatcaagccataaggtcgaggtacccactgaccaggcctcagctgaccaggccacaatgtccaggttcccactgatcagacccccgctgaccaggccacaatgtccaggtcccactgacaaggcccccactgaccaggccacaatgtccaggtcccactgacaaggcccctgttgaccaagccacaaggtccaggtccccactgaccagaccaggcctcggctgaccaggccacaatgtccaggttcccactgaccaggcccctcagccatggtgctcaaagtccgttcctgtggcccccactcagcccacagactctcccctccccacatctgcactcacaggccaggcccctgagggtctttttgggacagggcccctcctccaggacacagggagggacagctggccttaggctccaggcgcccagcttcacactcgccccccacaaggccctatgggctcatctcaaagggacagtaaattggcatggcaccacctggaccttttgctgagctgcagtccagggaatggagggatgtttgtcacaccaggcatcctttgtgctaggcatcccaagcccttcccgtggagtctggatctagagacacagtgcagatgcggtgaggtgaccagcccaggacc

SEQ ID NO: 408699 - DNA, 381 bp, Homo sapiens
ttcgaggtaggtattaacatctccattttacagatgaagaaagtgaggttcagagaggtgaattcaagtgcccaaggccacacagtcagcaagaggcagagttccacctggaactcagtctgtctgactcccaaggccagtgtcctcccacctaagctgcctccctccctagcattggcagagagatgggcaggtggcctggaggatgggcgctggggcaggcgcggtggttcccaggcctgtgtctctctcctgtaatcctccagagatccctgggccagcctttttctcagccagggcttagcaacttttcctagaaagggccaagcaggaaatgtcttgggctttgagggccacctctggtatctgtcgcatattctt

SEQ ID NO: 408700 - DNA, 414 bp, Homo sapiens
ctgcagtgagccgcgattgcaccgctgcactccagcctgggtgacagagtgagacctctgtttcaaaaaaaaaaaaaaaagacctgatgattcttgacgaacccccaccctctgcaacatttccaaagctgcagggtcgcctccgcccacccttacctgccgtgacccttggcctccaccacgcccacggattccactcttgccagagaagggccgcggaccccgtgtctctttcccacctgctccccccagcaccaggggacaggcccccacctgctctggcagccctggagctgcgagtgggccctccctgtactgtaggcccagcgtccatccaggccctgagggtcgccgtcgccacggcctccgcctggcatcacctgccagtgccccgcccaggggcccagtccccgt

SEQ ID NO: 408701 - DNA, 384 bp, Homo sapiens
catgttggcatgagcctgtaatcccagctactagcgaggctgaggcagaagaatctcttaaacccgggaggcggaggttgcagtgagccgagattgcgtcactgcactccagcctgggcaacagagcgagactccgtttcaaaaaaaaaaaaaaaaaaaagagcctagctgcacacaggggaccctcgggcgctcagcagtgatgcgacagttcctaagaggatgcaccaacgtatgtgggtgtatccaggcagcgaagtggttaatcccgccagaagggaagcggtggggacaggactccgacagggatcgccggacccagagcaagcctggggttgagtgggtgggtgggtgagtggaagcattccgcgttgggggcggtgt

SEQ ID NO: 408702 - DNA, 324 bp, Homo sapiens
gggaggccaaggcaggcagattgcttgagcccaggagttggagaccagcctgagcaacgtggcgaaaccctatctctacaaaaaatataaaaattggctgggcatggtggcacgcacctgtagttctagccattcgggaggctgaggtgggaggattgcttgagcttgtgtggtggaggctgcagcaagctaggattgtgccactgcactccagcctgggcgacagaacaaaaccatgcaaaaacaacaacaacaaagttattcagatgccttagcctgggaaagatcatggtgcccaccgtccagctgtaattcaagtaaaaa

SEQ ID NO: 408703 - DNA, 478 bp, Homo sapiens
tgaaactctgtctcaacaacaacaacaacaacaaaaaaaaaaaaaagaagaaaaagaaatgatggaggcaaataagtttaactcatctgaagaggaatttaggccaggcttggagataggtaggaggatatattctagtaaagtgattcttaacttttttgggtcattcttctttagaaaaaggtacttggtacatctacaatattgagtctggggccaggctctggcaccacagagcagaaagggcactttgaaggcgatatacctgagtcgattaggaaagagcctactggaaggcaggaggaagggggaggcagtcagtacttgcagagcccttctagtgcctgactctgtgatctggcaggaactgaaaaaagcacagggcctgctgcgggtctgagactggtgggcagccttagaggttccaggagtggaatcatctgtgactcagtgtgaagtcccacagggctggggcttt

SEQ ID NO: 408704 - DNA, 386 bp, Homo sapiens
gatttgaccaggtgtgtcattcacatagcaaaaagactggccctccaagcctaaccttttattatacaaatgaggcttctacctggctgtgccatgacacctgcacatgtggggacaaagaaaagggagcaggaggctgggcgcagtagctcatgcctgtaatcccagcactttggtaggccgaggtgggcggatcacctgaggtcaggagttcgagaccagcctggccaacatggcaaaatcccatctcaactaaaaatacaaaaattagccgggcgtggtggtgtgcacctacaattccagctactcaggaggctgaggcaggagaatcgcttgaacccaggaggtggaggttgcagtaagccaagattgcaccactgcattcc

SEQ ID NO: 408705 - DNA, 580 bp, Homo sapiens
ttaccctaaaatctggctcctggcactctgggtaagagagatgggagtaagaagactcatgcctcaaggtcaaagttgggtgacctagaaggacttctctttaaccctgattgcaatgaaagtagttttcatccacagagagagttctcacggtatttgttgatttttcttccattttgtcttggggcaggcactgagttgaacgcttttggactcacctcttcctgccttgtcccagcttttcctttatatgtgtttcaggcatttgaaagtttaggaccaggcacagtggctcatgcctataatcccggcactttgggaggctgaggtaagaggattgcttgagctcaggagtttgagaccagccagggcaactgacctcacctctacaaaaacagggcaagaccttgcctcaacaaaaaataaaaaaattagctgggtatggtggtgtgtgcctgtggtcccagctacttgggaggctgagatgagaggattgcttgagcccaggaggttgaagctgcagtgagctatgattgtgccactgcactccagcctgggtgacagagcaaaaaaaaagaaa

SEQ ID NO: 408706 - DNA, 388 bp, Homo sapiens
ctaatcatgtgatgattcaatgcataatggtttgtgacaaattttagcattttgctcttaccattatgtgtgattcaaaagtaagcacaaatctataataattggtatttaatgtgactaattcacttttccctagtgagtctacagattccttgagcagatctgtcttctaaaccttagttacttctcccacacaaccacctaccccattgcccattgtctgaattatcttacacaaaacaaatgctccatacatggatttgacgtcatcttgcttctgtggcctcaataagtgattgctgcttccagatgatcagtatctgaggttcccccttggtagccaatgaggaatttcataaaagcagcagcttgagaagaggacattttt

SEQ ID NO: 408707 - DNA, 362 bp, Homo sapiens
ctcaggaaaccttcagtcatggcagaaggcaaaagggtaagcaggcatgtcttcacatggtggagcaggagagagagagagtgaaggggaaggtgctacacacttttaaacaatgagatttcatgagaacatattcactatcatgacaacagcaagggggaagtccaccctatgatccagtcacctcccaccgggcccctcctccaacattgggtattacagtttgatatgagatttgggtgggaacccaaatccaaaccatatcactggcttatgtataaaagggaattttatgttttttttgtgcttttattttaaattgaatgcaactttggcattgaaaaaatttttctgaatatgga

SEQ ID NO: 408708 - DNA, 466 bp, Homo sapiens
aggaggtgaccagctgcctgcctgcaggggcttgggtggcctcccctgctgctggtccctgtgcccctcctccccgtgcttgctgtgagggtgcagctgtggcggtttcttttctgtgtctcctgcattgctgttacctccataatgtgaaatgtaaaccatgtgaatgaaaaggaagctccgtccctgtcgtcctctccaggccggtgcgggaaggcggatgtgtggctcatcccggacgctggcttctcttccctcttccatacgcgcacacccgccggggtctgctcaccttgccttctcagccttgtcagtcgggcagtgtgctaaggttaccaggaggtgttctgaagcatcttttttgagacgtgatgtcgctgtcacccaggctggagggcagtagcacagtcttggctcactgtagcctcgacctgtgctcaagagatcctcccacctcagccccctg

SEQ ID NO: 408709 - DNA, 438 bp, Homo sapiens
tctgtcgcccaggctggagggcagtggcgcgatcttggcttactgcaacctccgcctcctgggttcaagagattctcctgcctcagcctcctgcgtagctgggattataggcacccgccaccacgcccggctatttttttattttagtagagatagggtttcgtcatgttggccatggtggtcttgaactcctgacctcaggtgatccactcacctcagccttccaaagtgctgggatcacaggcgtgagccaccacgcccggcctagtcaaggcaattctgtaagggaggagcaggaggtagacacgcttgctccagttgccattcattcattcactcattttttcaggcaccggagaggtcattcagtgcatttggttttgtggccctatggcatatattgattgtctccaaatgtcatcatttcctgagcacagc

SEQ ID NO: 408710 - DNA, 400 bp, Homo sapiens
tgttatttaaaaattaaagcgtcttgcatctgctctttttcaagaatgttagtaatagccattcctctgcccttcctcaccccaacacgagcttgtattagaaacaaaataaggaccgggtacagtggctcacgcctgtaatcccaacactttgggaaaccaaggtgagcagaacatgaggtcaggagaccaagacgtggttaacacagtgaaatcccgtctctattaaaaatacaaaaaattagctgggcatggtggcgggtgcctgtaatcccagccactcgggaggctgaggcaggagaatggtgtgaacccaggaggtggaggttgcagtgagccgagatcgcgccattgcactccagcctgggcgatagagcgagactccgtctcaaaaaaaaga

SEQ ID NO: 408711 - DNA, 486 bp, Homo sapiens
caaaataaattatttgcactagaatgtgtatctcagcatttacttttaggagaacccaaactaaggctacctctgggcttcctggaaatctagagggaaactaaataacataactgttatatttagaaagtagaaaataaatcagttcttcaattgaggcaaagtatttctgcctcccctgcccttccactctccattccaaaactggacgggcccgcggtgtggctcacacctgtaatcccagcactttgggaggctgaggtgggcagatcacctgaggtcaggagtttgagaccagcctggccaacacggtgaaacctcgtctctactaaaaatacaaaaattagccaggcgtgatggcaggcgcctgtgatcccagctactcaggaggctgaggcaggagaatcgcttgaatccgggaggcggaggttgtagtgagcccagattgtgccactcaagcctggatgacaaagcgagactccatct

SEQ ID NO: 408712 - DNA, 286 bp, Homo sapiens
ataaaattcaaggcaaaaatcagtaaatgggataagaaggatattttatattgataaatagtacaccaacatgatataacatatataaaattttatgtactcaataatgtgaattaaatgtataaagcaagtatttaagaaaacttagggacaatatcacaaaactattatatattcatgatgggaaacaacaacatacttctatcagaatgtcacagatcaattatacaaaataattaaagacatagaggagtaacaaacttgatttttgtatttatgggtgtat

SEQ ID NO: 408713 - DNA, 427 bp, Homo sapiens
ggagtgtgccttgtgctgggatgggctcctgtccagggttggttgctgcattgagcactgagctgccaggataagctccagcttcctgcacctctgaactggaataagttgtccacttattccagttcagtgttgaagatggctggagcccatcccagtagctcagggcagaaggcaggaaccaaccctgggtaagatgtcatgtcattgcagagctcactcacacacatccactgatataatttgggtctgtgtctctgcccacatttcatgtcaaattataaccccagtgttgaaggttggacctggtgggaagtaattggatcatgtgggttgatttcctcttgggtgctgttctcctgatagtgagtgaggtctcatgagttctggttgtttaaaagtgtgtagcacctcccaccttgctctc

SEQ ID NO: 408714 - DNA, 403 bp, Homo sapiens
gagattgcaccactgcactccagcctggatgacaaagcaagggtccatctcaaaaaaaaagcaaagaagaaaaagtgaccaatatacaataaggtacttaacacccttgcagagtagagaaatacaaattaactataactccatcagaatggctaatattaaaaggactgaccaggccaggcctggtggctcacgcttgtaatcccagcactttgggaggccgagatgggaggatcacctgaggtcaggagttcgagacccgcctggccaacatggtgaaacctcgtctctactaaaaatacaaaaattagccagccgtggtgatgcgcacctgtaatcccagctactggggaggctgaggcatgagaattgcttgaaccaaggagatggaggttgcagtgag

SEQ ID NO: 408715 - DNA, 405 bp, Homo sapiens
cgatcttagctgcctccatgggcccttcttatgggctactgatggaatggtggggagcaaatccgcagctggcccagatccagcaccactggacccaaacctgtcacctgctgcgagtgaggaaggaggaggatctactgcctctgtttcccctggttgctcagtccacagggtacagacgcgaggtgtctgagctggaaggtgatgtccggagccccagtccaacacctcgtggacctgggtcaacctggctcagcctctacgagctgtgaggccaccgggaagtctctgaccctctctggacctggctttgtatctgaaacgaaaagcacagctctctcgcgggctggcagaggaggtgccgtcctgagctggcacctggcttccatgcattctcccgtggaa

SEQ ID NO: 408716 - DNA, 167 bp, Homo sapiens
aggtctggaggcagaaaaccacgttgtcttctctgcctaaaaagcaacaccacatcttcatagacaaggttggctatggagtagactcacagcattccatgataactagttagaatgcagcagtgttccaaatgggccaaaccttgtctagacaggagcaacaggca

SEQ ID NO: 408717 - DNA, 1720 bp, Homo sapiens
ggcaagcacacatttaaaaaaatgaaacagaaaagaatacaagatataagattgcatggcacagggtaaatgtaaagatttttcttgaatcaaccttttgttttaattattcatacatatataaagtatacataagttgcaatacaaagtgtatttttactgggggccacagtcaaaaagtttgacagccactgttttatcctcactaatgctgttttacagtcactggtgctgtgaatggatgagttaggaagctgacatggcagtccagataagacatgggtcatgaactagagcatttactacatgtggagcgaagaggaacagcctccaaaaacatggaaaaagcaaaagaactggcagaaactgtaactgactagatgttagggaaagaagaaaatgtatacaatgacttccagatttccatcctcaagtgttttatgacttgacaagcacactgtcagatacactaaatgaacagagatcctctccactttgttctactccacttcttccacacaaaccctgtttactttatgcccttttccctggtaagtggagttcagccaaaccagcgctcagaaccaccactgaggaagtgaagagatcaagctcagacaagctgctttcgttcctgtcatttcaccaacatctccatacatttttccagtttggttttcctatctacttccttcctatatgggacttaacacaagattcttaactttcatgtatgcagtttatactagaaaacacacaaagagaactacactgaagtcaacattaaggataaatgctaaatactacccaatctttccccatcttacaactacttacctacataaccctccctctaccctttactctcaaattattatattctttatccaaaaacatttagtgctttcttcaacaacccacctcgtgcttctgcttattgaaatcctttatagccctagatcacataggtcacattttacccatgaaacctttctaaattaccttttacacatgtaacactgcaggatcgttggctatctcttggtacctaccccaaagccttgaggagctgggctgggtgggcacagtggggtaacttttagattgtggacttagcctcaaggttaccagacaggagctggctgttaggcagaattgaggtgcctgaattgggcaaacctctcttcaactgttgggttttgccagggacgaaacccttgctctcctgccatgtccacgggtgtttggactgagggtgttggctattctggacgaagactcctagttatgtgccatggtttccaccctctgctccacccccagccttttctgtaccaggctgggacccccagtcctggagccccccaccttcttgtctcatggctggcactggaggctgctgttggccacctgctccatccagcgcctcccctccctccatgttccctctctgcacccttgttcacctgttgccccgcttccattctccccattcctctctgccgttgtttacctggagactcaggagagattagtgcacctgttcaagttatcacctttaagtggaaattagctttcatttagaaatgtgtggcccagggcaggggcagtggctcactcctgtcatcccagccccttgggatgccaaggtgagaggattgcttgagcccaggagtttgagaccagcctgggcaacagaccgaggccccgtctctacaaa

SEQ ID NO: 408718 - DNA, 1144 bp, Homo sapiens
aggcagcgcgcgccgcgagctgtcgcgtctggtcgtggtctggcggagctgcggttggcttgtggcgtctccgccgccgccgccctcccttcctcttccccatcttcttctctcggtcccgggagcccccgcccggagagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggttttgagggtaggcaggtctggcgtgctctccaggagaggctgtggctctggtggcactgccgagtccatgtggggtgccaccttttacacatgtaacactgcaggatcgttggctatctcttggtacctaccccaaagccttgaggagctgggctgggtgggcacagtggggtaacttttagattgtggacttagcctcaaggttaccagacaggagctggctgttaggcagaattgaggtgcctgaattgggcaaacctctcttcaactgttgggttttgccagggacgaaacccttgctctcctgccatgtccacgggtgtttggactgagggtgttggctattctggacgaagactcctagttatgtgccatggtttccaccctctgctccacccccagccttttctgtaccaggctgggacccccagtcctggagccccccaccttcttgtctcatggctggcactggaggctgctgttggccacctgctccatccagcgcctcccctccctccatgttccctctctgcacccttgttcacctgttgccccgcttccattctccccattcctctctgccgttgtttacctggagactcaggagagattagtgcacctgttcaagttatcacctttaagtggaaattagctttcatttagaaatgtgtggcccagggcaggggcagtggctcactcctgtcatcccagccccttgggatgccaaggtgagaggattgcttgagcccaggagtttgagaccagcctgggcaacagaccgaggccccgtctctacaaa

SEQ ID NO: 408719 - DNA, 384 bp, Homo sapiens
aaacctttcccagttttgagctgtttttccccctcttttggtgggaagagagctgaatgcttgagttaatcagatattgcagaaaagcaatggggctgtgtccagccggagggaggcacacagtgtgtctggggcacctcatgtgtctcaggtgcctgagttatctggggtttctggggtgtctggggttcctggcattgactggggtacctggagtgtctggggtggctggggtgcctggagtgcctggcatatctggggtgccttttgtgtctgtcgtgtctggggtgcctggggtatctggggtgccagcatctaggcagctgtgggcaggcccagagccactggagcacagaggacatttcagcccaaatgcagaggaca

SEQ ID NO: 408720 - DNA, 419 bp, Homo sapiens
tctctctgaagcagagggggctccctgaggtcagggcctgagctggcttaactcagcacgtcctgtgagcacctgtgccaggactgccagatttagtcaataaaaatacaggctgtccagggaagtttgtatttcagagaaatggtgagtcatgtttttttagtatactccatactaaagactgtaatagttcagggcgctggctgagccccctgtaaacttggcacctggatctaattctggtcctgtcccagcccactgggctcaggaacctagcaaagcacagatcccactgcccgatacccgttgtgggtcccgccaccgtcagaggtttacatgtatttggtgtttatgtgagattcagatttaacttggcaccttgaatttcacccagcagccctaacccaagcccctccttt

SEQ ID NO: 408721 - DNA, 1321 bp, Homo sapiens
ctacatcccacatgaaagattaatatcatcaagtaagaaaaatacatagtttaaactacaatgctgaaaatataaaaggaacctggtagttcaatggggatggagaaaacagagcattcctctgagagcagagatcttgtcattattgcaattaatgcccaaacaggttaaatgtggaagaaagtatggaggaaataaccccagccttcctcataccactggatttccacatcaccttttaacttatgcttgagctcccttttgagaaaaaatatttatatgcttatatatatatatatgtatatgcttgagaaagtggtttttcaagatgtatgtgtacagtacacacatggacacgcttcagtcctctgacttcccatgtgctacctcatgtgtttctcttctcatgaggatttgcaatggatagttgtacaacctggggactgtcagtgactcattggtatcagcatatgctaaagaagctcttgaatccaatcttgaaacctgatctcccttcgtcaacattccccaataccaaactggcccgtttacccatacaaatgcacagtaaagggaagaacagcggtatttttcctagccaactgactctatcatttgtttaatgtttgctggtttttttctggttttgttttgttttagagcaggggtgggagtggctgtaacttcacaatcctaatacagtaaatgttttgcatcttccatgttttatgcaaaaacagacatttaaatcaataaataattgtgccctagactgaaggttaatgtttaggagaggaaaaaaattgttggaattttttctacatttttttgtgaagaatcttttttggaaaggaaggatacatatttttgttgtgtaatattttctatttttgaatgcattttattggtacaagactgtttttttggtgaagacattatttaaaaaaaaaaaaagaaaaaaactaatcgaaaagtttgcccttaaggatatgctgcagttttgaggttaaaaaaaaattactgattcaagatgcgtgttaaaagttgggattatattgttgttttttgtaattgttacaagaagaagtttgtacccactgctgtttattttgtttcagatgagtaagtaaagggattgttcttgttttattctttttttagagaaaaaaagctatttatgaaatgtcaaaaacactggactgtgagtttaagtgtggaagcattttaccaccctgtgtcttcaaccaattatgggaaaccccttttctcttccccctaccccctgccttagccttgccaaatgagaaaaatataacagctg

SEQ ID NO: 408722 - DNA, 374 bp, Homo sapiens
aaacaaattggctatgtaacaaatttgtgtgtgagtgtgtatatatatatgtatatgcttatatatatatatatgtatatgcttgagaaagtggtttttcaagatgtatgtgtacagtacacacatggacacgcttcagtcctctgacttcccatgtgctacctcatgtgtttctcttctcatgaggatttgcaatggatagttgtacaacctggggactgtcagtgactcattggtatcagcatatgctaaagaagctcttgaatccaatcttgaaacctgatctcccttcgtcaacattccccaataccaaactggcccgtttacccatacaaatgcacagtaaagggaagaacagcggtatttttcctagc

SEQ ID NO: 408723 - DNA, 430 bp, Homo sapiens
tcgtcaacattccccaataccaaactggcccgtttacccatacaaatgcacagtaaagggaagaacagcggtatttttcctagccaactgactctatcatttgtttaatgtttgctggtttttttctggttttgttttgttttagagcaggggtgggagtggctgtaacttcacaatcctaatacagtaaatgttttgcatcttccatgttttatgcaaaaacagacatttaaatcaataaataattgtgccctagactgaaggttaatgtttaggagaggaaaaaaattgttggaattttttctacatttttttgtgaagaatcttttttggaaaggaaggatacatatttttgttgtgtaatattttctatttttgaatgcattttattggtacaagactgtttttttggtgaagacattatttaaaa

SEQ ID NO: 408724 - DNA, 2439 bp, Homo sapiens
  misc_feature (1612)..(1612): n is a, c, g, or t
agctataaaggacattcttgggacaattgacgtttagatatggattgtggggttcgatcatagtatcatatcaatgcaaattgtcctagctctgataagcatatgtgtttatgtaagagagtgtccttgtttttagggaacaaacactgaaatatacaatagtagagaggcatcatgtctccaccatactctcagatggttcaggagaaatatgcgtgtgtctccgtacatattaatatagagagaatggtacagccagtgggacaagttgtaagcaattggtgaatctaggtaaagggtatatgggaaattgcatcaaaattaaaagttatgaaaatgggggagaaaacccagttcttctataaaaacagcctccagcctctccctccagcacaacctgtccccacacgtggggcacccggcacccatgctctggctcttgtctctctgggtcttagtcccacttagcaccccacacccaaaggtcatgttttcacagatgtgtaccctcaagactaaacacacacttgaggcattcatgtgactatacatatttatggaaaaagaaaattcttgggctcacaaaactgaacgctccagggtggactgtctcaggtggccttaatcggggtgctgacaacatccagacgagcacgcaggcttctctccctgccacagcggtgccattctccaacggactctgccgccgtggctgcaagatggtggcagcagctccaacccctgcacccttttgtggccaagtccagtgggaagaatgtgaggtcttcttccagaagcttctgcagattctcattagcttcagctgggtcatgtgtctgtcatccctgacctggcctctggggtcaggaaggcaccatggtcagactggccaggcctgagccccaagccccaagtccaacctcttcacaaagcacagctggctggggcagagcggtgcccccagtggaaaatcaagatgcagtttcagaaggatggaaatggatgctgggtggcgaaacggcagaaacccaccccggcccacgcccttgcctgtccaaaatccatgcacatgcttcttcccatgctccctctgggggaggtgtgctaggcagcacagatgtatgcacagctccccacagatgccaccctcatccttggaaactgtcaatgcccatgaatttgttacctcacgtagcaaaagagactttgcagatgtaattaaggctgctcgtcagttgaccttaaaatagggagagtgtcttggatcatccacatgggctcagtgggtcacacaagcccttaaaagcagagaactttccatggctggtggcagaggtagaaaggacattggaaagagacagcatgggggaaagggagatttaaagcttgggaaggaaggatggaaagcgcgactgctgctttgaaaacaaaggaagcctcaggccacgtagcaaagaaatggagaccccaggcctgcaatcataagcgactgaattctgctcacaaccctaatgagcacctccgggaaagagcccagcctgccaacacctcgattttgccttgtaagcccctaagcagaaaatacagttgaggcactctctgcccagacttncagtgcacagaaactgtgatgctaaatggatgttgcttgaagctgctcagttggtggcactttgttacagcagcaatggaaaatgaatactggaggtaacactgtctctcccagtgacaggtccggctccaggagctggaccccagtgaccgtgttacagtctaggcttaaggcccccctcactcccaacctcacctgtgcagagagggaaggaaaagtgccatgtcaacccccagtaagggaaaggaggatgggagacccctagcctgcagcacatccaaagccctgctagaaaaatactgagaaatgttagacattgagctaccacaggacccaggattacaactcctgggtatctacccaaggcaaatgaaaacatgtgtccccagaaaaatttgcacacaatgttcatagcagcattatttataataattgagaaatgggaatagcccaaatgcccatcagctaatgaatagataaacaaaatatggcatagctatacaatggaatattatatggccctaaaaagtaatgaagaagccagacataaaaggctttgtgtgattccatttccagacagaaagcagattagtagttgctgcaggctggcgggagggaggaatggaaagtggctgctaacaggaacacggtttattctgggggcaatgaaagtgttctaaacttagatgtgatgatggatgtacaactgcgtgaatatactaaaaagcattgaatggcattgaatggttcatcttaaatgggtgaattttatagtgcgtgaattatatagataaagatgtaaaagatttgtttaacatcaataaaga

SEQ ID NO: 408725 - DNA, 677 bp, Homo sapiens
gtagagcctggctttctggtatgggtgcacaggtgggggagggagacgtaggcgtcgccactacccctgtgtggacctggttagccgcttagttcccagagttggtaacccgagaagatgagccttaagaaaaaaaaaagtatcaggttccgtttgccgccgagaggtgagtggtggtgaaaatgaatttgcccctttcccctcagaattgtttacccttttatttgcaaatgaatcgttctgctgccttcctcccgccaccaaacccacacccttgcgtagattgcactttgaggcctctttggtgatggttttagctgttagagctcttcacagccatccaggctcaaactaaacttcagatttaacgggttttctgtgttagaaatcttggaattgtaggagttggaacgctgcagccaccctcccccgatgccccaaacagtagcagttcaagggggaaaaaagaaaaaaaaaacaaaaaacaacaactttgaatcctttctgcagttaaagccttaaacatttcagaagtccacattatacatttttctgtatttgtgactgcataaagagacactgttgaggtcagtacaactttatgccaagaatctaaaaacgctgtgagtgtaaatttactgcttatgttcggaaatacaccgccaagattgtcataa

SEQ ID NO: 408726 - DNA, 2701 bp, Homo sapiens
  misc_feature (704)..(704): n is a, c, g, or t
  misc_feature (925)..(925): n is a, c, g, or t
gatgcagcagctggctgaaggctccagagggttccccgaggtgggactggcctctccccgtgtgtgtgggcaccacagtccctgggcaagcagggtgctctgggaccgcacttcatcgagctcacgagccagctaggctctgtttgtgatagaaaaatcaagaccatgttaatgatcgtaataaaagctttctactgtcgttggggtggtgggtggggctgggaagaaactggtttgagcttttagagtttgcctttgtaccttagagatgtgtctcagggccaggcatgggacctgccatcgagggttcctccccgcaccctcgattttcctgttttgcttctctctccatttctgtccaggcctccgcccaattccacagtgaggggtggttaggagctatgggccgggatggctccttgggaagggaagtcgggatcccaggctaggaggaagctggcagccccgtccccactgggcccacagtgtgagtcgtgccttagagactccgggttgtcctgttctttctgggcttgctcatctccccccaaccctgtcccaccccacccctcccatacctccactgctgaagttcctccagcccctctgtctgccttgtgaaggtggcaggggccaggtctgcctgacataggaccacatcctgtccctccctcacctggagcagcacagcagagttcaggcanggcacagccaggccctggtcagcgctgaatggcagaggaaagatcttaggaaaggagaggaatcgccaccccctcctgccaactgggatgactggggagggccacgctcattcaaagctgaatcagaaaccagccgtggaacagaattcctgccgagtcttccagggccgctcctccaccaccctcccccaggttgaggcactatggcaccctcatcaggnagaggtttggggtccccttgttgtcactgctggctctgccaccccatcttgttcatggcagctggttgggtcaggtccatggtagagccaggcccttcccagggctgcggagaaaacctgctctcttctagtcgggcttctccagaagccagtaatcagaaaggatgtgtctcctgctccaactctgcccccgagacagctcagagccagaaggcaccccgagacagctcagagccagaaggcaccccgagacagctcagagccagaaggcaccgaggactctggcccaagtggggaagctgaggcagagagcagagggggtcatgcagtgagtgggtggggtgcaggagacagagaggggctgggggcgtggggtgggggtgtctgcctcttccctccacctcctcccctccttagcagctgaagactcagccctgaggtctggggcaatggaagtcaagacacccgacccctacatcctggggtaggcccgactcagcatcctgtcccagcttcagccccacactcatttctggcatagaagattccgccgaggcagctctttcctctcggggtctgccaggggtgcctcagctggttcctgctcccaggcctagccccgaagccttaggggccttctcagccttagccctgggtactggggtgaagttggcaggggagagcttgacacttcgcctccctgatggccatgctgagggacagtggtgaccctggtcacttggtgctggtgtaggggcctgtgcccttccagggccagtgagacagccttctactcccccgacccagagctgagtccgaggaccccaggcccacctcctggccctcttggaggtctgtgctcttacctcccagcccccaccctgcgggagagcagccccagcgcctcatctccccaaaggcggcagatgcttgattctcctgccctctttcttccttccctcgtatttatttatttatttattgcttgtgctaaagaccaaaatagtctccctctttagtgcacttgaagcgggagggcggatgggatgagccaggagcgaggaagacttggcccctggggagtgtgtgtgtggaggcgtgtgcctgtgtgagcctgcatgcatacatgtgtggtgcacacatgcacactcggctcttcatgtgtatgactgggttagtaatacagatacgtgatctatacgtgtgtgtgtgtgtgtgtgtgtgtgtgtgtgtgtatgcaggcggttatgtgtctgtctacccccaggtgtttccgtgtacaagtttcctgtgagggagggcacccacccatcaggttgggcactggcacaggtgaaccccacagtccccgaccctctgccctgattatgcacgtctgctcctgagtggagcttgtgttccaggatgagacatctggaggtgagcgtgtgcgtccggctcgtgtgtaggaggctgtgtgtgtgcccatgtgaaaccgtgtacttgagtgtgtgtctgtgtgcagcctatgcctgctgctcagagcacggtggccaccccctgagcctctgctggtgctgtgctgcgtggtccccacccagagggtcctggggggcggggaggagccaccgttgggaggcccctgtacggggtgtctgccctgcgtgagggcatagaatgtcaaattattttaaatggtgaaactggagagttttcatgttattttcaatacatagcagtatctaaagacgtaggcgatgagactagaccacattaaatgcattttgatctctttga

SEQ ID NO: 408727 - DNA, 2664 bp, Homo sapiens
  misc_feature (704)..(704): n is a, c, g, or t
  misc_feature (925)..(925): n is a, c, g, or t
gatgcagcagctggctgaaggctccagagggttccccgaggtgggactggcctctccccgtgtgtgtgggcaccacagtccctgggcaagcagggtgctctgggaccgcacttcatcgagctcacgagccagctaggctctgtttgtgatagaaaaatcaagaccatgttaatgatcgtaataaaagctttctactgtcgttggggtggtgggtggggctgggaagaaactggtttgagcttttagagtttgcctttgtaccttagagatgtgtctcagggccaggcatgggacctgccatcgagggttcctccccgcaccctcgattttcctgttttgcttctctctccatttctgtccaggcctccgcccaattccacagtgaggggtggttaggagctatgggccgggatggctccttgggaagggaagtcgggatcccaggctaggaggaagctggcagccccgtccccactgggcccacagtgtgagtcgtgccttagagactccgggttgtcctgttctttctgggcttgctcatctccccccaaccctgtcccaccccacccctcccatacctccactgctgaagttcctccagcccctctgtctgccttgtgaaggtggcaggggccaggtctgcctgacataggaccacatcctgtccctccctcacctggagcagcacagcagagttcaggcanggcacagccaggccctggtcagcgctgaatggcagaggaaagatcttaggaaaggagaggaatcgccaccccctcctgccaactgggatgactggggagggccacgctcattcaaagctgaatcagaaaccagccgtggaacagaattcctgccgagtcttccagggccgctcctccaccaccctcccccaggttgaggcactatggcaccctcatcaggnagaggtttggggtccccttgttgtcactgctggctctgccaccccatcttgttcatggcagctggttgggtcaggtccatggtagagccaggcccttcccagggctgcggagaaaacctgctctcttctagtcgggcttctccagaagccagtaatcagaaaggatgtgtctcctgctccaactctgcccccgagacagctcagagccagaaggcaccccgagacagctcagagccagaaggcaccccgagacagctcagagccagaaggcaccgaggactctggcccaagtggggaagctgaggcagagagcagagggggtcatgcagtgagtgggtggggtgcaggagacagagaggggctgggggcgtggggtgggggtgtctgcctcttccctccacctcctcccctccttagcagctgaagactcagccctgaggtctggggcaatggaagtcaagacacccgacccctacatcctggggtaggcccgactcagcatcctgtcccagcttcagccccacactcatttctggcatagaagattccgccgaggcagctctttcctctcggggtctgccaggggtgcctcagctggttcctgctcccaggcctagccccgaagccttaggggccttctcagccttagccctgggtactggggtgaagttggcaggggagagcttgacacttcgcctccctgatggccatgctgagggacagtggtgaccctggtcacttggtgctggtgtaggggcctgtgcccttccagggccagtgagacagccttctactcccccgacccagagctgagtccgaggaccccaggcccacctcctggccctcttggaggtctgtgctcttacctcccagcccccaccctgcgggagagcagccccagcgcctcatctccccaaaggcggcagatgcttgattctcctgccctctttcttccttccctcgtatttatttatttatttattgcttgtgctaaagaccaaaatagtctccctctttagtgcacttgaagcgggagggcggatgggatgagccaggagcgaggaagacttggcccctggggagtgtgtgtgtggaggcgtgtgcctgtgtgagcctgcatgcatacatgtgtggtgcacacatgcacactcggctcttcatgtgtatgactgggttagtaatacagatacgtgatctatacgtgtgtgtgtgtgtgtgtgtgtgtgtgtgtgtgtatgcaggcgaagtttcctgtgagggagggcacccacccatcaggttgggcactggcacaggtgaaccccacagtccccgaccctctgccctgattatgcacgtctgctcctgagtggagcttgtgttccaggatgagacatctggaggtgagcgtgtgcgtccggctcgtgtgtaggaggctgtgtgtgtgcccatgtgaaaccgtgtacttgagtgtgtgtctgtgtgcagcctatgcctgctgctcagagcacggtggccaccccctgagcctctgctggtgctgtgctgcgtggtccccacccagagggtcctggggggcggggaggagccaccgttgggaggcccctgtacggggtgtctgccctgcgtgagggcatagaatgtcaaattattttaaatggtgaaactggagagttttcatgttattttcaatacatagcagtatctaaagacgtaggcgatgagactagaccacattaaatgcattttgatctctttga

SEQ ID NO: 408728 - DNA, 905 bp, Homo sapiens
ctcagaacttatgacactgctgtgtttaaaagtttctcaactccaaaatattaagtcacctctattaagtgctccaagatttcaaagtgtatctacttttgacagttacccactttccttttcttatagttaagaggaaaagtctagttatttgaaaagccattggattttggtctgctttcataaagactttatccatccctatctatgagaaattaaactattgaccatagaatatttgtaaatacttcataaattccccattttgtcttacactttgcaacttcaacattcatattgatgactcaactgatactggactcaatggtagaaaacaagtttaactggggaatggaaagtaacccagctctccaccaacaaagccacagcctggaactgtgcttcaagatcttaacccggacattctccctttccagtatggcttcccccttccaaaacccatgaaccttccaaattaactggaactgatcattgctgcagttctctaattcatcattttcaaagtgtaatttgcagaaactagtccgtaagatggcccatgaaaataaggatcctgtgtttgtatatgatcttaaaatattcaatccccctcttggagattcatgagcatatgaaagactctgtaaaggtctgcagtacaggaacttaactagctgagcacacccccaaaatactactattactatttgtgttgataccacttcaaaaaactttccacttagtcctttagcttcccttccagccatccttttctattcctgcccagagtccagaacagttttcttaatggggaatgggggtggaacaaagaactgaagaacatcacccagaatgttctaaaaacatacataaacatctctcccatttcttgttgtcctactcct

SEQ ID NO: 408729 - DNA, 890 bp, Homo sapiens
tgaatcatttaaaattggaagatatgttaaatatccagcccagtcccctcaatttataaatgagggaactgaggccctctccaacacacagttcctgattgtctgctttgagccaaagccaaatccagtgaacaagctgcttaactttaaatagctattaaatagagcataaaagggtaaaaatcatcttaggtccatttctagctatctaggcattatccttcaatctagcagtccaccttttaggagttcaccctgagcatacacctccaacaatacgaaagtacagatgcacaggttattcattacatcagtatttgtaactttgcaatattggaaactatctagatgtccaagcatagagagtgattgaatggcctatggtacatatatacactggattactatgcagctggaaaaaaatggtatgagaatgatcaccaggaacggatacagagtgattttcaggataaagtgttaaagaaaaacagtgacatccaaaagaacataggctatattttatataagaaataagggaaattattaaaatatatgtacctttgcttattttacaaaaaaaaaaaatcaagaaaaataatccagaacgcaatgaagttggttatcctcaaggagtgggagagaataggttggaaaatatacagtaaagagaaatttttttctaagtataccttcttgtacagttttcacattaggaagcatcactctctatcctttcaatcctgaggttaactaaggaagtacatattggaaaaatataattaaatctttagagaggaaaaggattttagaaacctgaaaatgaaagcaaattgaaacaagtcaacctgattgtattttaaatgaatatcccaaccacaatcagtgcaaaa

SEQ ID NO: 408730 - DNA, 380 bp, Homo sapiens
tcacctcagatcaatagtttgagaacagcctggccaatatagtgaagccccatctctactaaaaatacaaaaaattagccaggcgtggtggcaggcactgtaatcccagctacttgggaggctgaggcaggagaatagtttcaacccaagaggcgaaggttgcagtgagccgaggtcgtgccattgcactcaagcccaggcaacaagagcgaaactgtcaatttaaaaaaaaagaattgagccagaataaaatgtatttaagggttattaaggggaatgtttctagcacataagtgtttgttccacgtcttattatattaggcaatatcctttcatgtaatatcagcttctccaagatagggatgtcaaagagaaactaa

SEQ ID NO: 408731 - DNA, 1054 bp, Homo sapiens
aatttattttgagacagagtcttgctctgtgggccaggctggaatgcagtggcctgatcttggctcactgcaacctctgcctcccgggtttaagcgattctcctgtctcagcctcccgagtagctgggattacatgcatgagctactgtgcccagccttggtttttcttttgagacagggttttgctctgtcacccaggctggagtgcagtggtgtagtcatagctcactgcagcctcaaagtcctgagttcaagcaatcctcttgcctcagcctcccaacgtgctgggatctcaggcgggagccactgcgcctggcccgaaaccaagctttcttatcccaagcgctgacctttatcaagttgacctaatcctttatcatctcctaagtgtccctcatgagtgatcacttcacattcctcccacatggagagctcacccactggggcctatttttcccattggaaaagtgtggttattggaagtttcctgtttttggaaagaacaggattggaggtgctctctggggtgtcctcctaccaagcagcctgttgaaggcctcgtggtgctcagggagcacgagcgacactcgccgtcgcttcagcttcatcttgaggccacacagcatctccgccacccagatctcctcaggctcaggggcgagcaccttccgtggctcctcctccaacgactcctcagattcgtcccaccactccatcttccttttccagcaaaaggacctatgcggggggctgggatctaccccaggggctgagtaaagaaaccaggccacggtgtaatgcttctgcagttgatcacactagagcccgacccaaaaccccaaaccactctccatcctccccagcctcgcagactgctggcttctccaagccatctttccttctgtctgtctcctctgctgagctccatgtgccgctccttctcctccccattctcccgtttttctgtcctcagaacacttcctcatatccttcctggtccctggctctctgagtccctttttttttttttttttcgttgttgttgtcgttgttg

SEQ ID NO: 408732 - DNA, 170 bp, Homo sapiens
gtaaaaggctaaggtgggaggattgggaggatcacttgaccctgggaggtggaggctgcagttagctattaactgcactctggctgcttgatagagtgagactgtgtctcaaaaaccaaccaaacaaacaacagaagatgcaagaactcagaactttggcacaatttcaa

SEQ ID NO: 408733 - DNA, 351 bp, Homo sapiens
aacaattgggcagggaccagaggctcacacctttaattccagcactttgaaatgtcgaggcaggtggattccttgagctcaggagttcaagaccaggctgggcaacttggagataccccatctctgcaaaacatgaaaattagccagatatggtgaggctcgcttgtagtcgcagctaatcaggaggctgaagctggaggatagcttggacccaggaggtcgaggctgctataagccatgattgtgccactgcactccagcctggaaataagagcaagaccctatctcaaacaaaccctatctcaaacaaacaaataaaaacagccatattttattttaaaatatgtatca

SEQ ID NO: 408734 - DNA, 602 bp, Homo sapiens
gcttgaacccgggaagcagaggttgcagtgagccgagatcgcaccactgcactccaacctgggtgacagagcaagactccatctcaaaaacaaagaaacactgaacagttatcctatctgatctttttatatgcaggatagtgattaaatcactctacaaccactttcctctaatttctcctcataagcctaatcaaatgtatttgccttacttcctaccattctgttgaagattctccgaaaattggagaaagcactaaatatggtaggaagattctcttgaagttcctgtgatcttttgaaactgcattcctgagttctatccttacttccttaaagcagcatgcacttttggtttgttgttaatcaggggtctcctgtgcttggtgtgtggggtaggaaggcaggtgatcacctgcaacaattcttcacagattggaagttaaacatgaaaagcccccggagaccccacgaactagatgccagaaagttctgcagtcattgactgttaactgcaattccaactatacggtcagccctccatatccatgggttccatatccgtggattcaaccaacatggattgaaatattccaaaaaaa

SEQ ID NO: 408735 - DNA, 1165 bp, Homo sapiens
atatttaaattgagcaccttttcttggtttattggctactcagacagcctcttttatgaagacatccaaatatattctacgtttgagtcttttgtccatttttctgttgggctgtcttttttttgtttaataggaattctttatgtaatctgtcaggtagtattttatctccccagattatatttttagtttttaaatgatgtcttctgatatacagaagttcatgatgttataattgaatatgtaacttttttctctttctgtatcctgttcaagaaatagttgtctactccaaggtcatgcagatgtttttttctaaatgctttattgtcttgtcttttattttttatatctatggtctatttggtatggcttcgtgtgtgtggtgtgaggtagggattgagattcttttttttccattgggatatctgattgacccagcatcattttctaaaagatgcctttcctcattgcactgcggcgcctcctgtgtgcttttgacagggatgacagggatgaggatgataaagaataggcatagcgtgtctttctcttgtgagacacagggattccaactcctattctcaatcttaaaaagaagttatttttcctcctccaagtgggaattttactagtgcttctgcttccgataccaagggttcgagttttggaggatgaagaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggagactggcaagcgtgtgggcaaggtactgcatgcctccttgcagagtgttctgcacaaggaagaaagcctggggcccaagagacagaaagttggattcctgggatgatttgcacatcaactgctcaactgtggattgttttttacttttccttttaaaccggttcgtatatatttttcttcgctgttacgaatttacagcagcatttgtacatgtaaaattaaaggctattttctggtc

SEQ ID NO: 408736 - DNA, 477 bp, Homo sapiens
tcccctgggagtcttttgagtccagcccgtcatttcttcccttgtactttgcctcccaaatactcctctacccaggttttggcactcgacagtaacttcttctgtctcaaaaaaaaaaaagcagtgtcctttaactggggtaatacctaaagtaataagtgatgcttggttttttttcctttttcaattcctgtctcccttagcttctggaatgtggtggaaatttgtttgatgccatttccattgctgtaaaggctgctctcttcaatacaaggtaagtcttcctagaaacagctctgcgaacctgtggagaaccagagcagacacttgtaatggaacactgaggaaatttctattgtagctcatatgtgaagataacagggggttttaacattgaaaatggtgacatctaacgttaaactccagaaaagatagatttcgtgaattaaaactacatatatacgtatattctgtatt

SEQ ID NO: 408737 - DNA, 278 bp, Homo sapiens
tacaggatctgtatgcgcgacgcttccatcaagccggggtttccagttcccgctaggaagcgttggggacgtccgggcactgcgcacctcgccagtgccggttaccaagcgcctcctcccccgtctgtgggacaacgctctggaagacctccgtgtggatggccgtggctgtgaggactaccgatgtgtcgaagtggaaactgatgtggtgtccaacactagtgggtccgccagggtcaagctggtcacacagacatcttgatggaagcgtcgcgcat

SEQ ID NO: 408738 - DNA, 1769 bp, Homo sapiens
gaggggacgcgcgcagatgacgtgcggctcgtggggcagctcggcagcatggcgtccgtgacgctgagcgaggcggagaaggtgtacatcgtgcatggcgtccaggaagacctccgtgtggatggccgtggctgtgaggactaccgatgtgtcgaagtggaaactgatgtggtgtccaacactagtgggtccgccagggtcaagctgggtcacacagacatcttggtgggagtgaaagcagaaatggggacgccgaagctggagaaaccaaatgaaggctacttggagttctttgttgactgttcagccagtgctacccctgaatttgaaggtagaggaggtgatgaccttggcaccgagatcgctaacaccctctatcggatatttaacaataaaagcagtgtcgacttaaagaccctctgcattagtcctcgggagcactgctgggttctctatgtggatgtgctgcttctggaatgtggtggaaatttgtttgatgccatttccattgctgtaaaggctgctctcttcaatacaaggataccaagggttcgagttttggaggatgaagaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggagactggcaagcgtgtgggcaaggtactgcatgcctccttgcagagtgttctgcacaaggaagaaagcctggggcccaagagacagaaagttggattcctgggatgatttgcacatcaactgctcaactgtggattgttttttacttttccttttaaaccggttcgtatatatttttcttcgctgttacgaatttacagcagcatttgtacatgtaaaattaaaggctattttctggtcaaaaaaaaaaaaaaaaaaattggggggattaatgcgcgggggcgggaaacaagagggcacacgaatgggcccatgggccatagctggtaccatggacccatttcccgggcacaacgggcgaatccggccggtcaccctataggggagccggataaattccgaataaggcccgaggttaaacccgggattaagaaagagaggtgggagaaaagaaggcgagagcagagggaccgcgggggaacgcgagagaaacacgagacggaagacggggacgacgaccacagagagcagcacagaaaaagagcgggagaaagaagagacgacacagacgacagacacagacaacaaagcaccgagaaagaaggcgaacgccagcagccggaggaaggagcggcgacaagcgcaaccgggcgagggaaaccagaggcgaatcacgcaagagaggagaaagaagaagggcgaaacggtgaagagggggggggagcgagagaggaaaagagagccagaaagacggcggagcggacagccaggaggaagagagaacagacagaggaagaaggaagaggagagcagaggctggcggaggaagagaaggacggagagcgaagcggggcgaagggaaagagagaagagcgagggaaggggggggagagaacgaaagctctacgtaaggaagaggaagagtaaggcgccgggcaggaaggtgtagtggt

SEQ ID NO: 408739 - DNA, 1413 bp, Homo sapiens
gaggggacgcgcgcagatgacgtgcggctcgtggggcagctcggcagcatggcgtccgtgacgctgagcgaggcggagaaggtgtacatcgtgcatggcgtccaggaagacctccgtgtggatggccgtggctgtgaggactaccgatgtgtcgaagtggaaactgatgtggtgtccaacactagtgggtccgccagggtcaagctgggtcacacagacatcttggtgggagtgaaagcagaaatggggacgccgaagctggagaaaccaaatgaaggctacttggagttctttgttgactgttcagccagtgctacccctgaatttgaaggtagaggaggtgatgaccttggcaccgagatcgctaacaccctctatcggatatttaacaataaaagcagtgtcgacttaaagaccctctgcattagtcctcgggagcactgctgggttctctatgtggatgtgctgcttctggaatgtggtggaaatttgtttgatgccatttccattgctgtaaaggctgctctcttcaatacaaggataccaagggttcgagttttggaggatgaagaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggagactggcaagcgtgtgggcaaggtactgcatgcctccttgcagagtgttctgcacaaggaagaaagcctggggcccaagagacagaaagttggattcctgggatgatttgcacatcaactgctcaactgtggattgttttttacttttccttttaaaccgagcgtttcaaccgtggcatttgctctctgcattccagttagcaaatggggtaaggcgttaggaatttatcaccaaatggaaagaacataatgtgagctgaagcccttgggactgcttccagaggtcctggtgtgggcgttcctcccagcaaggccaggtccatccctgtggagagaagcagctgcctagacttgggcttaatgggggagcttctgccctgttgagagcatagcctgggttttcatcttttatgtttcttcagtgactatctacaggcaccatgacagtgttcccaacaaggcagaaatcagcctggtctctccttccctgctcctggttgactgcccgtgacatgacaaaacattggcagtggtggcgcagagatgcaactcgagtgtgaataaagtttagaagcgtttgcttttgatggttaat

SEQ ID NO: 408740 - DNA, 1476 bp, Homo sapiens
  misc_feature (1464)..(1464): n is a, c, g, or t
  misc_feature (1467)..(1468): n is a, c, g, or t
gaggggacgcgcgcagatgacgtgcggctcgtggggcagctcggcagcatggcgtccgtgacgctgagcgaggcggagaaggtgtacatcgtgcatggcgtccaggaagacctccgtgtggatggccgtggctgtgaggactaccgatgtgtcgaagtggaaactgatgtggtgtccaacactagtgggtccgccagggtcaagctgggtcacacagacatcttggtgggagtgaaagcagaaatggggacgccgaagctggagaaaccaaatgaaggctacttggagttctttgttgactgttcagccagtgctacccctgaatttgaaggtagaggaggtgatgaccttggcaccgagatcgctaacaccctctatcggatatttaacaataaaagcagtgtcgacttaaagaccctctgcattagtcctcgggagcactgctgggttctctatgtggatgtgctgcttctggaatgtggtggaaatttgtttgatgccatttccattgctgtaaaggctgctctcttcaatacaaggataccaagggttcgagttttggaggatgaagaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggagactggcaagcgtgtgggcaaggtactgcatgcctccttgcagagtgttctgcacaaggaagaaagcctggggcccaagagacagaaagttggattcctgggatgatttgcacatcaactgctcaactgtggattgttttttacttttccttttaaaccggggaactgaaactcctaaatcttaaaacaccctggggaaggagctgattcacgaaggagagcgtttcaaccgtggcatttgctctctgcattccagttagcaaatggggtaaggcgttaggaatttatcaccaaatggaaagaacataatgtgagctgaagcccttgggactgcttccagaggtcctggtgtgggcgttcctcccagcaaggccaggtccatccctgtggagagaagcagctgcctagacttgggcttaatgggggagcttctgccctgttgagagcatagcctgggttttcatcttttatgtttcttcagtgactatctacaggcaccatgacagtgttcccaacaaggcagaaatcagcctggtctctccttccctgctcctggttgactgcccgtgacatgacaaaacattggcagtggtggcgcagagatgcaacttctaattttaaaataccaatttgtaaataaaccaanttnncaaaaatg

SEQ ID NO: 408741 - DNA, 1198 bp, Homo sapiens
gaggggacgcgcgcagatgacgtgcggctcgtggggcagctcggcagcatggcgtccgtgacgctgagcgaggcggagaaggtgtacatcgtgcatggcgtccaggaagacctccgtgtggatggccgtggctgtgaggactaccgatgtgtcgaagtggaaactgatgtggtgtccaacactagtgggtccgccagggtcaagctgggtcacacagacatcttggtgggagtgaaagcagaaatggggacgccgaagctggagaaaccaaatgaaggctacttggagttctttgttgactgttcagccagtgctacccctgaatttgaaggtagaggaggtgatgaccttggcaccgagatcgctaacaccctctatcggatatttaacaataaaagcagtgtcgacttaaagaccctctgcattagtcctcgggagcactgctgggttctctatgtggatgtgctgcttctggaatgtggtggaaatttgtttgatgccatttccattgctgtaaaggctgctctcttcaatacaaggataccaagggttcgagttttggaggatgaagaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggagactggcaagcgtgtgggcaaggtactgcatgcctccttgcagagtgttctgcacaaggaagaaagcctggggcccaagagacagaaagttggattcctgggatgatttgcacatcaactgctcaactgtggattgttttttacttttccttttaaaccggttcgtatatatttttcttcgctgttacgaatttacagcagcatttgtacatgtaaaattaaaggctattttctggtcaaaaaaaaaaatacaaagaaacaaaaaaagaaagaaaaaagagaacagacaaaaagaaaaaaaacaaaagaagacacccacacaacgggcaagaagaagaaagacgaaaaaaacagagggaaacaaccaaaggacgcaagga

SEQ ID NO: 408742 - DNA, 1715 bp, Homo sapiens
gaggggacgcgcgcagatgacgtgcggctcgtggggcagctcggcagcatggcgtccgtgacgctgagcgaggcggagaaggtgtacatcgtgcatggcgtccaggaagacctccgtgtggatggccgtggctgtgaggactaccgatgtgtcgaagtggaaactgatgtggtgtccaacactagtgggtccgccagggtcaagctgggtcacacagacatcttggtgggagtgaaagcagaaatggggacgccgaagctggagaaaccaaatgaaggctacttggagttctttgttgactgttcagccagtgctacccctgaatttgaaggtagaggaggtgatgaccttggcaccgagatcgctaacaccctctatcggatatttaacaataaaagcagtgtcgacttaaagaccctctgcattagtcctcgggagcactgctgggttctctatgtggatgtgctgcttctggaatgtggtggaaatttgtttgatgccatttccattgctgtaaaggctgctctcttcaatacaaggataccaagggttcgagttttggaggatgaagaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggagactggcaagcgtgtgggcaaggtactgcatgcctccttgcagagtgttctgcacaaggatcaactgctcaactgtggattgttttttacttttccttttaaaccggttcgtatatatttttcttcgctgttacgaatttacagcagcatttgtacatgtaaaattaaaggctattttctggtcaaaaaaaaaaaaaaaaaaattggggggattaatgcgcgggggcgggaaacaagagggcacacgaatgggcccatgggccatagctggtaccatggacccatttcccgggcacaacgggcgaatccggccggtcaccctataggggagccggataaattccgaataaggcccgaggttaaacccgggattaagaaagagaggtgggagaaaagaaggcgagagcagagggaccgcgggggaacgcgagagaaacacgagacggaagacggggacgacgaccacagagagcagcacagaaaaagagcgggagaaagaagagacgacacagacgacagacacagacaacaaagcaccgagaaagaaggcgaacgccagcagccggaggaaggagcggcgacaagcgcaaccgggcgagggaaaccagaggcgaatcacgcaagagaggagaaagaagaagggcgaaacggtgaagagggggggggagcgagagaggaaaagagagccagaaagacggcggagcggacagccaggaggaagagagaacagacagaggaagaaggaagaggagagcagaggctggcggaggaagagaaggacggagagcgaagcggggcgaagggaaagagagaagagcgagggaaggggggggagagaacgaaagctctacgtaaggaagaggaagagtaaggcgccgggcaggaaggtgtagtggt

SEQ ID NO: 408743 - DNA, 1271 bp, Homo sapiens
taagatccctaggcagctataacctaatgtcctctgtgttctatattaaatccctggttatgaccactccagaacgagggttgaaaaatgttggacctggtaacgagctaccctgtatcctcctccggctgtgtctccacttgttaacctacggtgtggtcctcctatcagagttcttcatcccatccttggcagagttctggcgacagtcctacctcttttcctcatgcctttcctctgtcagtaccaactgcaaagtcagtggtcccgtgatgtagccatcggattgaagcggccagctatcattgaagtcccacaacgaagacctccgtgtggatggccgtggctgtgaggactaccgatgtgtcgaagtggaaactgatgtggtgtccaacactagtgggtccgccagggtcaagctgggtcacacagacatcttggtgggagtgaaagcagaaatggggacgccgaagctggagaaaccaaatgaaggctacttggagttctttgttgactgttcagccagtgctacccctgaatttgaaggtagaggaggtgatgaccttggcaccgagatcgctaacaccctctatcggatatttaacaataaaagcagtgtcgacttaaagaccctctgcattagtcctcgggagcactgctgggttctctatgtggatgtgctgcttctggaatgtggtggaaatttgtttgatgccatttccattgctgtaaaggctgctctcttcaatacaaggataccaagggttcgagttttggaggatgaagaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggagactggcaagcgtgtgggcaaggtactgcatgcctccttgcagagtgttctgcacaaggaagaaagcctggggcccaagagacagaaagttggattcctgggatgatttgcacatcaactgctcaactgtggattgttttttacttttccttttaaaccggttcgtatatatttttcttcgctgttacgaatttacagcagcatttgtacatgtaaaattaaaggctattttctggtc

SEQ ID NO: 408744 - DNA, 775 bp, Homo sapiens
tctagaggacccagatgacacttcagccagtgctacccctgaatttgaaggtagaggaggtgatgaccttggcaccgagatcgctaacaccctctatcggatatttaacaataaaagcagtgtcgacttaaagaccctctgcattagtcctcgggagcactgctgggttctctatgtggatgtgctgcttctggaatgtggtggaaatttgtttgatgccatttccattgctgtaaaggctgctctcttcaatacaaggataccaagggttcgagttttggaggatgaagaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggagactggcaagcgtgtgggcaaggtactgcatgcctccttgcagagtgttctgcacaaggaagaaagcctggggcccaagagacagaaagttggattcctgggatgatttgcacatcaactgctcaactgtggattgttttttacttttccttttaaaccggttcgtatatatttttcttcgctgttacgaatttacagcagcatttgtacatgtaaaattaaaggctattttctggtc

SEQ ID NO: 408745 - DNA, 1065 bp, Homo sapiens
gaggggacgcgcgcagatgacgtgcggctcgtggggcagctcggcagcatggcgtccgtgacgctgagcgaggcggagaaggtgtacatcgtgcatggcgtccagaacgagggttgaaaaatgttggacctggataccaagggttcgagttttggaggatgaagaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggagactggcaagcgtgtgggcaaggtactgcatgcctccttgcagagtgttctgcacaaggaagaaagcctggggcccaagagacagaaagttggattcctgggatgatttgcacatcaactgctcaactgtggattgttttttacttttccttttaaaccggggaactgaaactcctaaatcttaaaacaccctggggaaggagctgattcacgaaggagagcgtttcaaccgtggcatttgctctctgcattccagttagcaaatggggtaaggcgttaggaatttatcaccaaatggaaagaacataatgtgagctgaagcccttgggactgcttccagaggtcctggtgtgggcgttcctcccagcaaggccaggtccatccctgtggagagaagcagctgcctagacttgggcttaatgggggagcttctgccctgttgagagcatagcctgggttttcatcttttatgtttcttcagtgactatctacaggcaccatgacagtgttcccaacaaggcagaaatcagcctggtctctccttccctgctcctggttgactgcccgtgacatgacaaaacattggcagtggtggcgcagagatgcaactcgagtgtgaataaagtttagaagcgtttgcttttgatggttaat

SEQ ID NO: 408746 - DNA, 1056 bp, Homo sapiens
gaggggacgcgcgcagatgacgtgcggctcgtggggcagctcggcagcatggcgtccgtgacgctgagcgaggcggagaaggtgtacatcgtgcatggcgtccaggaagacctccgtgtggatggccgtggctgtgaggactaccgatgtgtcgaagtggaaactgatgtggtgtccaacactagtgggtccgccagggtcaagctgggtcacacagacatcttggtgggagtgaaagcagaaatggggacgccgaagctggagaaaccaaatgaaggctacttggagttctttgttgactgttcagccagtgctacccctgaatttgaaggtagaggaggtgatgaccttggcaccgagatcgctaacaccctctatcggatatttaacaataaaagcagtgtcgacttaaagaccctctgcattagtcctcgggagcactgctgggttctctatgtggatgtgctgcttctggaatgtggtggaaatttgtttgatgccatttccattgctgtaaaggctgctctcttcaatacaaggataccaagggttcgagttttggaggatgaagaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggagactggcaagcgtgtgggcaaggtactgcatgcctccttgcagagtgttctgcacaaggaagaaagcctggggcccaagagacagaaagttggattcctgggatgatttgcacatcaactgctcaactgtggattgttttttacttttccttttaaaccggttcgtatatatttttcttcgctgttacgaatttacagcagcatttgtacatgtaaaattaaaggctattttctggtc

SEQ ID NO: 408747 - DNA, 1472 bp, Homo sapiens
gaggggacgcgcgcagatgacgtgcggctcgtggggcagctcggcagcatggcgtccgtgacgctgagcgaggcggagaaggtgtacatcgtgcatggcgtccaggaagacctccgtgtggatggccgtggctgtgaggactaccgatgtgtcgaagtggaaactgatgtggtgtccaacactagtgggtccgccagggtcaagctgggtcacacagacatcttggtgggagtgaaagcagaaatggggacgccgaagctggagaaaccaaatgaaggctacttggagttctttgttgactgttcagccagtgctacccctgaatttgaaggtagaggaggtgatgaccttggcaccgagatcgctaacaccctctatcggatatttaacaataaaagcagtgtcgacttaaagaccctctgcattagtcctcgggagcactgctgggttctctatgtggatgtgctgcttctggaatgtggtggaaatttgtttgatgccatttccattgctgtaaaggctgctctcttcaatacaaggataccaagggttcgagttttggaggatgaagaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggagactggcaagcgtgtgggcaaggtactgcatgcctccttgcagagtgttctgcacaaggaagaaagcctggggcccaagagacagaaagttggattcctgggatgatttgcacatcaactgctcaactgtggattgttttttacttttccttttaaaccggggaactgaaactcctaaatcttaaaacaccctggggaaggagctgattcacgaaggagagcgtttcaaccgtggcatttgctctctgcattccagttagcaaatggggtaaggcgttaggaatttatcaccaaatggaaagaacataatgtgagctgaagcccttgggactgcttccagaggtcctggtgtgggcgttcctcccagcaaggccaggtccatccctgtggagagaagcagctgcctagacttgggcttaatgggggagcttctgccctgttgagagcatagcctgggttttcatcttttatgtttcttcagtgactatctacaggcaccatgacagtgttcccaacaaggcagaaatcagcctggtctctccttccctgctcctggttgactgcccgtgacatgacaaaacattggcagtggtggcgcagagatgcaactcgagtgtgaataaagtttagaagcgtttgcttttgatggttaat

SEQ ID NO: 408748 - DNA, 1487 bp, Homo sapiens
gaggggacgcgcgcagatgacgtgcggctcgtggggcagctcggcagcatggcgtccgtgacgctgagcgaggcggagaaggtgtacatcgtgcatggcgtccaggaagacctccgtgtggatggccgtggctgtgaggactaccgatgtgtcgaagtggaaactgatgtggtgtccaacactagtgggtccgccagggtcaagctgggtcacacagacatcttggtgggagtgaaagcagaaatggggacgccgaagctggagaaaccaaatgaaggctacttggagttctttgttgactgttcagccagtgctacccctgaatttgaaggtagaggaggtgatgaccttggcaccgagatcgctaacaccctctatcggatatttaacaataaaagcagtgtcgacttaaagaccctctgcattagtcctcgggagcactgctgggttctctatgtggatgtgctgcttctggaatgtggtggaaatttgtttgatgccatttccattgctgtaaaggctgctctcttcaatacaaggataccaagggttcgagttttggaggatgaagaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggagactggcaagcgtgtgggcaaggtactgcatgcctccttgcagagtgttctgcacaaggaagaaagcctggggcccaagagacagaaagttggattcctgggatgatttgcacatcaactgctcaactgtggattgttttttacttttccttttaaaccggggaactgaaactcctaaatcttaaaacaccctggggaaggagctgattcacgaaggagagcgtttcaaccgtggcatttgctctctgcattccagttagcaaatggggtaaggcgttaggaatttatcaccaaatggaaagaacataatgtgagctgaagcccttgggactgcttccagaggtcctggtgtgggcgttcctcccagcaaggccaggtccatccctgtggagagaagcagctgcctagacttgggcttaatgggggagcttctgccctgttgagagcatagcctgggttttcatcttttatgtttcttcagtgactatctacaggcaccatgacagtgttcccaacaaggcagaaatcagcctggtctctccttccctgctcctggttgactgcccgtgacatgacaaaacattggcagtggtggcgcagagatgcaactgggggggccccgtttccccaatttcgacccctttagatgaagtctcgttttacaatttt

SEQ ID NO: 408749 - DNA, 1259 bp, Homo sapiens
gaggggacgcgcgcagatgacgtgcggctcgtggggcagctcggcagcatggcgtccgtgacgctgagcgaggcggagaaggtgtacatcgtgcatggcgtccaggaagacctccgtgtggatggccgtggctgtgaggactaccgatgtgtcgaagtggaaactgatgtggtgtccaacactagtgggtccgccagggtcaagctgggtcacacagacatcttggtgggagtgaaagcagaaatggggacgccgaagctggagaaaccaaatgaaggctacttggagttctttgttgactgttcagccagtgctacccctgaatttgaaggtagaggaggtgatgaccttggcaccgagatcgctaacaccctctatcggatatttaacaataaaagcagtgtcgacttaaagaccctctgcattagtcctcgggagcactgctgggttctctatgtggatgtgctgcttctggaatgtggtggaaatttgtttgatgccatttccattgctgtaaaggctgctctcttcaatacaaggataccaagggttcgagttttggaggatgaagaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggagactggcaagcgtgtgggcaaggtactgcatgcctccttgcagagtgttctgcacaaggaagaaagcctggggcccaagagacagaaagttggattcctgggatgatttgcacatcaactgctcaactgtggattgttttttacttttccttttaaaccggggaactgaaactcctaaatcttaaaacaccctggggaaggagctgattcacgaaggagagcgtttcaaccgtggcatttgctctctgcattccagttagcaaatgggtgactatctacaggcaccatgacagtgttcccaacaaggcagaaatcagcctggtctctccttccctgctcctggttgactgcccgtgacatgacaaaacattggcagtggtggcgcagagatgcaactcgagtgtgaataaagtttagaagcgtttgcttttgatggttaat

SEQ ID NO: 408750 - DNA, 1042 bp, Homo sapiens
  misc_feature (4)..(4): n is a, c, g, or t
tttntacaaaaagcaagctgtaccggtccggtattcccggatcgtgacgctgagcgaggcggagaaggtgtacatcgtgcatggcgtccaggaagacctccgtgtggatggccgtggctgtgaggactaccgatgtgtcgaagtggaaactgatgtggtgtccaacactagtgggtccgccagggtcaagctgggtcacacagacatcttggtgggagtgaaagcagaaatggggacgccgaagctggagaaaccaaatgaaggctacttggagttctttgttgactgttcagccagtgctacccctgaatttgaaggtagaggaggtgatgaccttggcaccgagatcgctaacaccctctatcggatatttaacaataaaagcagtgtcgacttaaagaccctctgcattagtcctcgggagcactgctgggttctctatgtggatgtgctgcttctggaatgtggtggaaatttgtttgatgccatttccattgctgtaaaggctgctctcttcaatacaaggataccaagggttcgagttttggaggatgaagaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggagactggcaagcgtgtgggcaaggtactgcatgcctccttgcagagtgttctgcacaaggaagaaagcctggggcccaagagacagaaagttggattcctgggatgatttgcacatcaactgctcaactgtggattgttttttacttttccttttaaaccggttcgtatatatttttcttcgctgttacgaatttacagcagcatttgtacatgtaaaattaaaggctattttctggtc

SEQ ID NO: 408751 - DNA, 1097 bp, Homo sapiens
  misc_feature (150)..(150): n is a, c, g, or t
gaggggacgcgcgcagatgacgtgcggctcgtggggcagctcggcagcatggcgtccgtgacgctgagcgaggcggagaaggtgtacatcgtgcatggcgtccaggaagacctccgtgtggatggccgtggctgtgaggactaccgatgnttgttcgacaaggttggggggcaaaaaaaaacccctgggaactgctgggttgattcccaaaacccacctaagtgggtccgcccagggttcaaagcctgggtcacacagacatcttggtgggagtgaaagcagaaatggggacgccgaagctggagaaaccaaatgaaggctacttggagttctttgttgactgttcagccagtgctacccctgaatttgaaggtagaggaggtgatgaccttggcaccgagatcgctaacaccctctatcggatatttaacaataaaagcagtgtcgacttaaagaccctctgcattagtcctcgggagcactgctgggttctctatgtggatgtgctgcttctggaatgtggtggaaatttgtttgatgccatttccattgctgtaaaggctgctctcttcaatacaaggataccaagggttcgagttttggaggatgaagaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggagactggcaagcgtgtgggcaaggtactgcatgcctccttgcagagtgttctgcacaaggaagaaagcctggggcccaagagacagaaagttggattcctgggatgatttgcacatcaactgctcaactgtggattgttttttacttttccttttaaaccggttcgtatatatttttcttcgctgttacgaatttacagcagcatttgtacatgtaaaattaaaggctattttctggtc

SEQ ID NO: 408752 - DNA, 929 bp, Homo sapiens
gaggggacgcgcgcagatgacgtgcggctcgtggggcagctcggcagcatggcgtccgtgacgctgagcgaggcggagaaggtgtacatcgtgcatggcgtccaggaagacctccgtgtggatggccgtggctgtgaggactaccgatgtgtcgaagtggaaactgatgtggtgtccaacactagtgggtccgccagggtcaagctgggtcacacagacatcttggtgggagtgaaagcagaaatggggacgccgaagctggagaaaccaaatgaaggctacttggagttctttgttgactgttcagccagtgctacccctgaatttgaaggtagaggaggtgatgaccttggcaccgagatcgctaacaccctctatcggatatttaacaataaaagcagtgtcgacttaaagaccctctgcattagtcctcgggagcactgctgggttctctatgtggatgtgctgcttctggaatgtggtggaaatttgtttgatgccatttccattgctgtaaaggctgctctcttcaatacaaggataccaagggttcgagttttggaggatgaagaggggtcgaaggacattgaattgtcagatgacccttatgactgcatacgactaagtgtggagaatgtcccctgcattgtcactctgtgcaagattggctatcggcatcttcgagatgatggactggcaagcgtgtgggcaaggtactgcatgcctccttgcagagtgttctgcacaaggaagaaagcctggggcccaagagacagaaagttggattcctgggatgatttgcacatcaactgctcaactgtggattgttttttacttttccttttaaaccggttcgtatatatttttcttcgctgttacgaatttacagcagcatttgtacatgtaaaattaaaggctattttctggtc

SEQ ID NO: 408753 - DNA, 1442 bp, Homo sapiens
aatgcccatactcccactcggccatcgcaaggggttggggttggctttttttcgggcaactgctcacagctcccagtaatcacttccatcaagccggggtttccagttcccgctaggaagcgttggggacgtccgggcactgcgcacctcgccagtgccggttaccaagcgcctcctcccccgtctgtgggacaacgctctggaagacctccgtgtggatggccgtggctgtgaggactaccgatgtgtcgaagtggaaactgatgtggtgtccaacactagtgggtccgccagggtcaagctgggtcacacagacatcttggtgggagtgaaagcagaaatggggacgccgaagctggagaaaccaaatgaaggctacttggagttctttgttgactgttcagccagtgctacccctgaatttgaaggtagaggaggtgatgaccttggcaccgagatcgctaacaccctctatcggatatttaacaataaaagcagtgtcgacttaaagaccctctgcattagtcctcgggagcactgctgggttctctatgtggatgtgctgcttctggaatgtggtggaaatttgtttgatgccatttccattgctgtaaaggctgctctcttcaatacaaggataccaagggttcgagttttggaggatgaagaggggtcgaaggacattgaattgtcagatgacccttatgactgcatacgactaagtgtggagaatgtcccctgcattgtcactctgtgcaagattggctatcggcatcttcgagatgatggactggcaagcgtgtgggcaaggtactgcatgcctccttgcagagtgttctgcacaaggaagaaagcctggggcccaagagacagaaagttggattcctgggatgatttgcacatcaactgctcaactgtggattgttttttacttttccttttaaaccggggaactgaaactcctaaatcttaaaacaccctggggaaggagctgattcacgaaggagagcgtttcaaccgtggcatttgctctctgcattccagttagcaaatggggtaaggcgttaggaatttatcaccaaatggaaagaacataatgtgagctgaagcccttgggactgcttccagaggtcctggtgtgggcgttcctcccagcaaggccaggtccatccctgtggagagaagcagctgcctagacttgggcttaatgggggagcttctgccctgttgagagcatagcctgggttttcatcttttatgtttcttcagtgactatctacaggcaccatgacagtgttcccaacaaggcagaaatcagcctggtctctccttccctgctcctggttgactgcccgtgacatgacaaaacattggcagtggtggcgcagagatgcaactcgagtgtgaataaagtttagaagcgtttgcttttgatggttaat

SEQ ID NO: 408754 - DNA, 149 bp, Homo sapiens
cagcctcccaaaatgctgggattacaggcatgagccactgcacctggcttcaaagttctttcagttatactggcaacaaagcagcttttggggctttgaaattcctctattttatttaacacttctgaaatcacagtgaccaggaagga

SEQ ID NO: 408755 - DNA, 418 bp, Homo sapiens
gcaaagacgaagaccaccaagaaatgccctcagtgcacaatatccaatgtgtttgccatgtttgaccagtcacagattcaggagttcaaagaggccttcaacatgattgattagaacagagatggtttcatcaacaaggaagatttgcatgatatgcttgcttctctagggaagaatcccactgatgcataccttgatgccacgatgaatgaggcaccagggcccattaatttcactatgtttggtgagaagttaaatggcacagatcctgaagatgtcatcagaaatgcttctgcttgctttgatgaagaagcaacaggcaccattcaggaagattacctgagagagctgatgacaaccatgggggatcagtttacagatgaggaagtggatgagctgcacagagaagcacctattg

SEQ ID NO: 408756 - DNA, 271 bp, Homo sapiens
tctgtgacaaacccacatagaatccaaggaatgtaggtgatctgacaaaagccctcacgtttaaaatttgccctaagtttccacaaatccaccaaaaatttccccgcatgggccacgttttcagatacagtttagctatccgttcttgtgacactagttgcatttgaagagttcttgggagcggcgtgcggtgtctcacgtccataatcccagcagtttgggaggccacgcaggtggatcacttgaggtcaggagtccgagaccagcctgg

SEQ ID NO: 408757 - DNA, 715 bp, Homo sapiens
gtcctggtttgggtcatgtgactgtccctgactcaatgactgtggccaggtataggaggtggtgctttccctggccagacttgcatcatgagtccgctcccagaactggaaggtaggtttagctctgctttatccactcggactaggatcagggaaggctgattctccacaggaatatgagatgctgttactgaaaagcagaggaagctacatgatctttaccactgggttactcaatagtagatgagggcaagcatctctctataaaagtattctgattattaaattaaaaaggaatggtggaatttgaataccaccattttgtaaccctcaataatgatgcattatgtattggtgactgctgacaccatagaaggaggcaagcattatgtgccccctgtagtcttgtcaaagggatcaaacctgagtccagtccagtttctggtactagccaccaatgtgcaggtgatacacaggacacagcacttgttgaactgcaccatgagtatacagtcagcaaaatccagactgtgggaatcttggcaagtcagatggcctggattctttcccagaacaatggaaaggaaaagaaaaaaatggcataaaatgtgcagattaaaagaaaattaaataacatattaaagttttttttaaggccaggcacagtgactcacacctgtaatcttagcactttgggaggccaaggcaggaggat

SEQ ID NO: 408758 - DNA, 211 bp, Homo sapiens
gtggaatcaagcaatatgtagcccttttggtctggcttctttcacttagtaaaacgcagtcaagattctcccatgttttgtggataattatttcattcctttttatcactgagtagtacttcattgtgtggatgtaccacagttttattatccattcactaactgatgaacttgtaagatgtttctagttttggtgaatatgaacaaattt

SEQ ID NO: 408759 - DNA, 1125 bp, Homo sapiens
ttaatatttgcattatactttccagttgagcatcccaaattcgaaaatcagaaatttataccaggcatggtgatgcacacctatagttcctgctactcaggaggctgaagcaagaggtttgcttgagccctaggagttcagggctgttgtgcactatgattaggcctatgaatagtcaccacactgtagcctggacaacacagtaagaccttgtctctaatacacacacacacaaacacacacatctgtatgtgtatgtaaaatccaaaatcctccaatgagcattttctttgagcatcatgttggcattcaaaaagtttcagattttggagcattttggattttggactttcagatttgggttctcagcctgtatagtgtttgtcaatggtgaacgtttgtcatttagagtaggacagttctgttgatgtacagaacaatcctgtgtattgctgtcccctgcccaacagatacctgtatgggccttctagtcactgtgatatcaaaacctcccatacatactcaaaatctccccttggagagaagagtgcacaataccacccctattgagaaccattggtttaatggggagtgcaagttaaaggttcaccctgattctactgtttaatacagctattatttttagtcattccctcccaggctttttacacatatatgctttctgttttgatagtgtacataaagtggcaagtattactgggaccatactggtctctagcttcccagtcaatctggggagagcctcagcccacaaggcagggtacctgagcaatgctcacatatgcagatgattttaggacagaaaagtatctttttcatattgagatcctgagaccattttgaaacgggctgtaaaatatagggagaaacttatttgtgaatttcagaggttgatactaggagtataccaggaagagtttggttttcctgtccccaaagttgtattatccctgtgctagtcagatgtatttgaatcttccatatcccactatctctttaaagtgtgcttcaaatggaaaatccagataaacctattagatttgagcacttagctgcttgtatcaggaatgcttgctaaattgtcctttagcctgatttgtaaaa

SEQ ID NO: 408760 - DNA, 240 bp, Homo sapiens
aagaaatgccttgctcgcagttctggaggctggaagtctgagatgaggctgccagcatggtcaggttctggtgacggccaggcagcagaccgtcagcttcttcccacatcctcatatggcagagagagggccagagcactgactagactcccttgtgtaaaggcactgatcccattcatgacccagtcatttcctcacccagtcacttcccaagggctctacctcttaaggtcatcacct

SEQ ID NO: 408761 - DNA, 609 bp, Homo sapiens
aaatagtcgctggttggaatgtaaaatggtacgactaccttaggagaccgttttttaaaagttaaacatacacttatcatataatccagccattctacaccttggtatctacccaacagaaaagaaagcatatagctatacaaagacttgtacaactcaaaacaacctagatatctattagcaagtgaataagtaatcaaattataccatttccatacacagcaatactactcagcaataaaaaggaatgaactatttatatatcacacaacatggatgactcttaaaataattaggctgagtgaaagcctgactctcctccttcccctccccaaagtacataatggattattctatttgtgtaaaattattggagattcatactaatccacagtgacaataaaattattgattacttggagagggaatagctagagaagagaactttggggggtaatggatacgtttattaccttgattatggcaaaggtacatatatatatgtgtgtgtgtatatacgtagtaaatgcagcatatgtatacatatattatatacacacatatacatatatgtgtatgtattacaaaaaccaatagaattatcgcaag

SEQ ID NO: 408762 - DNA, 294 bp, Homo sapiens
aactcctgacctcagatgatctgcctgcctcggtctcccaaagtgctgggattatgggcatgagccgctgtgcccggccatgtcttttgcatattgtattatctacaaaggacatgagttactttttaaataagtgatcttgttaatcaagtgatcttcctgccttggcttcccaaagtgcttggattataggcgtgagccaccacgcccagccaaagaaaagtttttaataagtagatttgattttgcagttacaaagtgaggcagaaaattcagcacatctatgtttaatag

SEQ ID NO: 408763 - DNA, 316 bp, Homo sapiens
gactttgcaaatctctgtaggccagagaacacctgcagggctggctggaggtcccagttgggaggttctttccagtgaggaggggcaatattggggacttacttaaagaagcagtgtggccacactttcctagagcagctgtgttgtgctgggttaccactttcgtcccagttggctttggctctctgtgggccagagaataccagcagggatggttggaggtcccagttgtgaggtcctgctctgtgatgaggaatggattgggaacctgcttaaccagcagtctgaccacattttggtaaagaagtcatgctat

SEQ ID NO: 408764 - DNA, 299 bp, Homo sapiens
gctggagtgcattggctactcacaggcatgatcatggtgtattatagcctcaaactcctggcctccagcgatcttcctgtctcagctcccaagtagctcccaagtgtgcaactgagactacaggtgcaaaacacagtgccctggcttctctgtaaattttagaatcagtttgtagacagtgtctgggaggaaaaactttttatctaccctcaggtttagtctttggggacctgtgaattaaacagacgaaagatatattaacaagagaaggccaagcgtggtggcttacacccataatc

SEQ ID NO: 408765 - DNA, 707 bp, Homo sapiens
gttgtttgttttttgttttttgttttgttttgttttgttttgagacagagtctctctctgtcacccaggctggagtgcagtagtgtgaacttagctcactgcaacctctgcctcacaggttcaagcaattctcctgcctcaacctcccgagtagctgggattacaggcatgtgccaccacgcccggctaattttttgtatttttagtagagtcggggtttcaccatgttggtcaggctggtcttgagctcctgacctcaagtgatctacccgccttggcctcacaaagtgctgggattacaggcgtgagccaccacgcctggactgttttttaaatttctcattgagttaaattcagaatcctcaaaatgacattcaaggccttgcacaatgtggccccaacctaattttctaatttaattttaatttaattttattttattttattttgagatggagtctcactctgtcacccaggctggagtaaagtggtgcgatctctgctcactgcaacctccacctcctgggttcaagctattctcctacctcagcctcccaagtagctgggattgcaggcatgtgccaccacgcccggctaatttttgtatttttagtagtgacggggtttcaccatgttggtcaggctggtcttgaactcctgacctcatgatctgctctccttggcctcccaaagtgctgggattgccg

SEQ ID NO: 408766 - DNA, 319 bp, Homo sapiens
ctcagtttcctgcaacagcacaactctcaaattttggaaatgataggttaccagtactcttcttttcctgttccacattgatttttaaaaaactatagctagtaataattatagtacataatagttattttgcactgtattaaaaaactagcacattatcagttctcaagtatttgaagtatgttttataagaatccttttcggccgggcgtggtggctcacgcttgtaatcccagcactttgggaggtcgaggcaggcagatcacctgaggtcaggggtttgtgaccagcctggccaacatggtgaaactccgtctct

SEQ ID NO: 408767 - DNA, 209 bp, Homo sapiens
gcagcctgatttctcccaaagtgctgagattacaggcataagccatcacaccccaccttaaatctttaatttttatgagtgctcaatctttacttcttagagtacttaatccttatttacatatattaaatttgtctattgagagagatttttgatcttagtaatggactgaccaatatcagatgcttaacttaattgattactataga

SEQ ID NO: 408768 - DNA, 172 bp, Homo sapiens
gggagagccttcattgagtcttcagtcctttctacatacaggagaaatcacataggagagaaattgtatgaatgtaaggagcatgaaaaagcctgtgaatgttcactatattttaatattcacatgcaagttgtctggtcgtagaccatgtgaaaatagaggagaaaaaagg

SEQ ID NO: 408769 - DNA, 958 bp, Homo sapiens
acagctttaacttagtctccttaaaaatcactcaggttgtaaccaaaggctgctctatggctgagtagaattgttaattattaataactgttaatcaactacatagtcaacctcagacaagagggcaagagataattccttagacacacacacaaaaagagcaaaatgttaaggttagaaaacagtaaaaacgatgaagatatttaattctttttgcatactttgtaattatttgtttaaatatctatttccctagcctctgtgccagtttttctcgttgttttttatttttatttttttaagagagggtcttgtgttgttgcccaggctggagtccagtggtgcaaccatgactcactgcatcctcacactactgggctttgatcctcccatgtcagggtcccagctactcgggaggctgaggcaggagaatggcatgaacctgggaggcggagcttgcagtgagctgaaactgtgccattgcactccagcctgggcgacagagcaagactctgactcaaaaaaaaaaaaaaaagaaaaaaaagaaaaagaagagttattatcaataagaaggaatgtctgggtttcgataaggggttgtgcagaccaaagttttctcatgcagctgaagcctccaggtggcaggcttcagagagactagattgtaaatatttattatcagatgtaaggtctgtgttgatgttaataccggaggttatattgaggcatgttcaaccctacttcccgtcatagcctgagccagtctttctggttaaattttagagttctctggcctggcaggaagtccatttacatggttgaggaacttagaattttgtttttggtttacaaagagaaagcagagaagggtgaacccaggaggcggagcttgcagtgagccgagatcacaccactgcactccatccagcctgggtgacagggtgagactctgtctcaa

SEQ ID NO: 408770 - DNA, 227 bp, Homo sapiens
acgaaagaagagttaaatgccctcaagtcgacaggggatgggaccctaggaaagccagtgaggtggaggtgaagaatgaaatcgtggcgaatgtggggaaaagagaaatcttgcacaatactgagaaagaacaacacacagaggacacagtgaaggattgtgtgttttctgtggctgtctgaagtgaattgttcctcttctccatcatcaggacgctaagagggcca

SEQ ID NO: 408771 - DNA, 287 bp, Homo sapiens
acgaaagaagagttaaatgccctcaagtcgacaggggatgggaccctaggaaagccagtgaggtggaggtgaagaatgaaatcgtggcgaatgtggggaaaagagaaatcttgcacaatactgagaaagaacaacacacagaggacacagtgaaggattgtgtggacatagaggtattcactgctggtgagaataccgaggaccagaaatcctctgaagacactgccccattcctaggaaccttagcaggtgctacctatgaggaacaggttcaaagccaaattctt

SEQ ID NO: 408772 - DNA, 248 bp, Homo sapiens
aggcgtgagccgccgcgcctggcctgccaaatgtagttctatgtcttggatctgtattgtttcatttaatcctcacaacaatcaggaggtaggtagtattattttctcctttttaagattgattaaaaactgggacaaggtgggcactgtggctcatgcctgtaatgccaatactctgggaggccgaggcaggtggatcacttaaggtcaggagatcaagaccatcctggctaacatggtgaaacccc

SEQ ID NO: 408773 - DNA, 279 bp, Homo sapiens
gacctgtatcttgtgctgacctcctatctcatcccgtgacttagaatgccttcactgtctgggaatttagcccagtagttctcagcattgttttacccagcccctattcaagatggagttgctctggctcacatgcctctgacagaatggctgacatgatgtcaaatagaatcacgtgttttttaaatatacatgccttaaaaaaagccaaaaaaatgaagtcattaaaacttttggtgttcagcagtcatcagaaaggcatgatgcatgcacacatac

SEQ ID NO: 408774 - DNA, 780 bp, Homo sapiens
ggtgtttatctttgggtttaatccatcacaacttctctgctaaatttaaaggtatctttgaaacattgaattgtcaattccatttgctttgtaaggaatcaaaatttagctctaagaataatcaggaacgtttgtcaacaagatattttgatacttcaccttaaaatatttaaaataggctgggctcgatgggtcatgcctgtaatcccatccctttgggaggccgaggtgggcagatgacttgagctcaggagttccatgctagcctggccagcatggcgaaacccccatctctacaaaacaacaacaacaacacaaattagctggtcacggtggcatgtgcctgtagtcccaacatgggtgaagggggtgtaaaggagggggcaggtgctgaggtgggaggatctcatgacccaggaaggtggaggctgcagtgagctgcaccactacactctggcccgggcaacagtgcgaccctgaatcagaaaaattgagacaggtactcgctgttgacaggtcaccacgccgggctaattgtttttgttttgtagagatggggttttgccatgttgccctggctggtcatgaactcctgagctccggtgatctgcccacctcccctcccaaagtgctgggattacaggcctaagccgtggtgcctgccccaaattaaatgtttaaaatacaaaatacttaaccttttatggcttgctaaggctcaggtttttccagactgaattttgtcacccccatcttttaattttgtggagatcattggtt

SEQ ID NO: 408775 - DNA, 429 bp, Homo sapiens
gatccccaacgctgctcacagagatggtgtttctgcatgttggtcaggctggtctcgaactcctgacctcgtgatctgcccgcctcggcctcccaaagtgctgggattacaggcatgagccaccgagcccagcctcccgttttctttgtaattgttaggggctattttttttattgtggtaaaatatatataacataaaatgtaccatttaaaccattttttagtgtacccttcggtgacaggtaagggctttctgaaacgcattgtctttttattatagccattctagtagtaaggtgtgaagtggtatctcatagtggtttgggttgtatttccctgatattgggatgttggaaagttgatgagcatcttttcctgtgcttattaaccatccgtttatcttctttggtgaaatgtctagtcaaaaat

SEQ ID NO: 408776 - DNA, 359 bp, Homo sapiens
tgcatgtataaataaataaagaaggcacacacacttagggaagtcccgctgtaaagtagattcccaggagtagaattgctgggtcaaaggatgagcacatttaaagctttgatcaatattgccgaattgccctctcaaaaggttatcccagtctgtgctgctgtaggtggcgtatgtgcagcgtcgcctccccacagcctcaccacgggctgacctttcatttagaaggattaatctactcatgaggtgccttgacttgtgtgacactgaaaattgcatctatttttagttgaaggaaagaaaccctcatgggtcaggatgttgagtagtgcacagctgattcatttggtttttggaac

SEQ ID NO: 408777 - DNA, 276 bp, Homo sapiens
gaatgaaattctcagattccctcaggcatcctttctccttagggattatgcaccactgcagaaaatagctgtggtaaataaaagtagaaaaatgaactatgtgagtttaatggtacactgaaaacaaagtacagatatccctcggtatccatagggaattggtcccaggaccccctgtggctaccaaaatgcacagatgctctagtctcatatataaaatggcatagtatttgcatataacctatgtacattctcccatatactttatttatgaat

SEQ ID NO: 408778 - DNA, 330 bp, Homo sapiens
tgaacatgattctaacaacagttggccacatttatttagccaaaacttggtgattgacacaagaggaggctaccgtctgtttacaattccatttaggttttagttcacggtgtactgagaaacctttagcctgaacttgatttaacagtgttgaggggagattgtatggaactgtgaaataaaagcaatgtaggatgtttgaaataaaagagagtacataaatgttaaacaatgatttgtttaaacttttgcagtaggtgcaatagctttctttggttaaaaatagatggcaaggccaggtgtggtggctcgcaccataatcccagcact

SEQ ID NO: 408779 - DNA, 169 bp, Homo sapiens
tagtaatatttctacttattgtagaatttttttctttttttccttcgtttttccaacagtgggcttaagatattgaataaaccacgctataaacgtgctgtaatttagtccttgttattccacttatagagcacaggcaaagtagatttagcataaggttaagaaccct

SEQ ID NO: 408780 - DNA, 277 bp, Homo sapiens
atatgacaagaactggaatttccacattgatggggatgcttctcttcaaatcaactagaaattttgccatactgctctctgaaatgaatgcagaaattagcattcctttcagcaatgtacaagacttccttttgctccatattctcaccaacacttgctatagacctgatgagaagattgctcatcagcattctgacttagaggtcaaatgcacagcggcagatttttgttaaggatatcaagcagcatatggaaggagctgaaagatgacttgagg

SEQ ID NO: 408781 - DNA, 1178 bp, Homo sapiens
tcctttttttagagtatctcgttcttttctcacggatgcaatattttctcttatttctttgaggatgttagtaatgttttgttgttgtttctgttgaagtgtttctcaccatgcctaatctcttctttgtccaagttaatttttttttctgattgttgaaaagacaagccacatactgggagaatatattacagcacaaataacgcacaaagcattactatccggaatacataagtaattcttacaaattggtaagaagacaactcaattaaaaaagagcaaaagatatgaatgagcatttcacagcagaaaaatatgaatgaaaaataaaccacaagaaaagattctcagccttatagaaatcaggaaaatgtaaattaagaccacaggaagattttccatggaaaagaagtcccatagtggcaagtattggagaggcaggaatcaacagggatccttatatgctcctaatgcagtgtaaattgctgcaaccactttagaatattgcgatttcattactaagtgtaaaccctggagatacacttgcatgcaagcacccagagacaggtgcaaggatattcatagcagtgctgtttattatggtaaaaacatggaaaccaccctaatgtccttaacagtaaaattaattaattgtggcatcaccatataatgaaatcctatacagcagtggcaatgagtctaacatagctgtggctggatacagaaggaatcatagaattataatgcggagtgagaaaagcctgttgcagaagactacatacaacaggatttgacacttgtaaggctccaaaacaaagaaaattaaatgatattgtttaggttttcatacataggtgataaaagtgtgtttctttgtttttaatgagaaaattagtcacagaatttaagatcttagttacttctatagggaaggcaggggaatgggacaaggaggaagcccacagcattggtcatgctctcatgttgaagttgggttcaaaggtgttcattattaaaatgcttcataatgatgaccatacatttggtatttctaggacaatcttggtttacatctattgtctcaacataattattcagtgcaagcctttcctttctcagaaaggtcctaatgtagataataaattattttggccaacttatttcttataaaatgcaaa

SEQ ID NO: 408782 - DNA, 698 bp, Homo sapiens
gggtgcatagtgctcattagcaccttgcctggtacctaagtgggttttttttattttggaagggtgaaattgttctctgaagcttgatggtcaaggtccagatgtccattccggggtgggagtgagggtaccagtttacagtggcacagtctaaagagatgacctccagagatggatgagggaagtgtgaccatttaaagtgcacctgcagtgtactggtcactttgtgagccattctatctcatcctcccccaaaccccttcctcccttttcggaaaggtttagtaacttaccacagccacacagctagtaagtgctggcagaattggctcctaggtctagctgaccttgagacctatgtagtttctattttaccacactgccagaaataaaaagtattactattattggtttgattggggatggggggatctgattgctgtcttggcaagaaagaattttatgagcagcactttgcttctgaggtggttccctgacttggggtgagacccaggccttctaatgaggcccttgaaaatacctcttgcttaggactggaagccctatcaaaatccttggattcccacagttctctgctgctgtttaaggttaaccttggaagctttaacagaatgataacgataaagctaattgtaactccttaatctttattaaaagtctcacaaatcattcattaa

SEQ ID NO: 408783 - DNA, 406 bp, Homo sapiens
ccccttccatgggaagataaatattcaatttacataagatgacatttatgtgacaattaagaagattccccgatggaatgttgtgaacacatttgcttataggagaaataaatctaataataaacaaactcataataacagcacaaatcctccgacagggcggattgtctacccaacaaagagggagatgatgaatgctgaaataagcagtttttgcaacaagaaagaaatatgagcccttgaaaatacctcttgcttaggactggaagccctatcaaaatccttggattcccacagttctctgctgctgtttaaggttaaccttggaagctttaacagaatgataacgataaagctaattgtaactccttaatctttattaaaagtctcacaaatcattcattaa

SEQ ID NO: 408784 - DNA, 579 bp, Homo sapiens
ggtggggcggccaggattggcaaaactgtcctgggattctgaagctctttcccctaggatcccttttagaattgaagacgccagttgatatcgtggctgtgtgttagcccaaatgcttatgtccctgcgtgttttctcctgcctttccacaccttccttcccttcgtgaaagtaataaggagtcagaactacaacaaagtaaaattggggtgttcagcttagggatgtaatcaacagtctcactccctttagaaatgagcctcgtttccatagtgaagttgggccgagtgggatcctccattgtcatagagttctttgtgtacaggtttgggttgaaggacaacaaaataaacagaaccagacccaccacccagcatttggacgccacgccggggctggacaaagtggacttgctgtccgtgtacctgagtgtcagggtggttttgccctgtgccctgccaaatcagagtgaatgaacattcctgtctctgtttagcagacttggccctttggaaactcaagaaatgcatcctgaaaaagctggcactgtgctttcctcttaggaccacaataggcaaa

SEQ ID NO: 408785 - DNA, 567 bp, Homo sapiens
gtttttggaggggatttacacctacccaggtagaatcaggcatggcattctgtgaggctttatttacctggcttgtcctagatggggccaaaaggcttgacagcatttgtcatctggactgcattccatttagatattcattttgatgtggtaggtcttatagttctttaattttcatcagaaatatatgtacagttttaaaattaaattatcacaaaagcatctcctccctgttgctaaatttggttccccagatgcaaattttttttttaccattttgtccattacttctgtcaattaaatccctatgtctagactgaccttttcacaagatgctcaaatactccagtcatttctttgttctatttgttgtatgtttttaatggcaacatctcttttggaattcctatacatcctttgcctctgttttgaatcccaattcctgcatcacaagacttcttccttgtttactccattactttgtagcactaaagaaataaatcttgaggaaaagttataaaaggcaatatttttgagtcctcacatgttttaaaagttgttttactt

SEQ ID NO: 408786 - DNA, 508 bp, Homo sapiens
acacgcctcccccacctcccaacagtgggaccctcactccctcacctgcctgtgctcactgggcccagtgctgagcaaacaaagatgagttttcagtcccggggccacagtgcctctggcccaggtgaggcccctcctatacagcctcactacctcaggccctgagagccaggccatcccagatgaccagggtcccacaggcaccaccgcccactgggccgggacccgtcgttcccccatgtgcaaacaccaagtcacctcggcccctcccagccccacctgtggactcagcctcctggcggctctccaaccctctgcccgtccccattctgtgctggccccaaccagccccctccagccctgtgctccccatcaatagcagagtgggccctgatctggttcccctgcccagcccttccacagttcccaactggcccgaaactggccacaggaaacccatgaatgcccctcctcagtggccgaccgaggggtctctgtgcctatccga

SEQ ID NO: 408787 - DNA, 541 bp, Homo sapiens
caaacctcaccccactaaaaaaaaaaaaaaataataataataataataatagtagctaaagcaagagaggtaggtggtcaagagctggtgtcatacactgtagggtcctgggcttattcttgcttgttgctccatcatcctcagcatgtggctccatcatcctcagcatgtggcatcccctttattgaggtccagccagcatgtctatgttccagctaaagagaaaatggcaaagtcaaagaagggcacacctcctccactgaaggactctaaatgcttccggtcacagatagtaatttgctatcattaataatttgctattgggaggccgaggtgggtggatcacttcaggttggaagttcaagaccagtctggccaacatggtgaaaccccatctctgctaaaaatacaaaaaaaattagctgagcctggtggtgtgcacctgtaatcccagctactcaggaggctgagacaggagaattgcttgaacccaggaggcagaggttgcagtgagccaagatcatgccactgcactccagcc

SEQ ID NO: 408788 - DNA, 197 bp, Homo sapiens
cccttctgccatcagtcctagattaggccctgttcagccatgcaggggtgttggtttatgcgtgctgcagcagtgggcataatgaatataatttacccagtggacaaaggtgtgtaccaagtgaatttaaataattggtgtggattggccagtagctaagaagtgggcttttaaagagtattgaagattgaaaggtg

SEQ ID NO: 408789 - DNA, 673 bp, Homo sapiens
ccctctcagaaccttactagaccatgcgattggcgcgcgggccctgctacggtagacgtgaccatggatcctaagctgttctcctacggacatcctggctcatgattagtggttgaacttctctaccaattaccatagaacatccggcggatgagcactgcatgctgttctgaacaaatccagataggcagttatcgtgccgtcgatgttactgagaatctatcagatcagcgagttcctaagctgagctccgcattatctaaagttacgccccactcttcagatcctcctaagtgctcttccccaggtcttatctctttctgtcccccattcctttgatctcttggctattgaggcctttttctgggtgatcttcactctagttctctgttctatgaaagtttccacatctggctgggcatgatggctcacgcctgtaattccagcatgggaggctgaggtgggcggatcacttgaggtcaggagtttgagatcagcatggccaacatggtgaaaccctatctctactgaaaaagcaaaaattagctgggcatggtagtgcaggcctgtaatcccagctactcgggaggctgaggcaggagaatcgcttgatcacttgaacccaggaggcggaggttgcagtgagctgagatcacgccattgcactccagcc

SEQ ID NO: 408790 - DNA, 946 bp, Homo sapiens
cttcccaagcagctgggattaattaaaggtgtgtgccaccacagccgactaattttgtatttttagtagagacagggtttcaccatgtaggccaggctggtctcgaactcttgacctcaggtgatccgcccacctcagcctcccaaaagtgctaggatttcaggtgtgagtcatcatgcccagagtgagttccttcctttctttacatacatctctttagagaacttgttccatttttattgtctgccttatcattcaactgtttgctctgtgaagaatggagccctattatctttgaattctcatacctattacagtgtctggcatttaggctttcaataaatgcttgttaaaaaatgagtggcaaaaaatatatatacattttcctttaaattcttatgtcttatattttaaagaaagtttaactgtaaattttatataattacctttattttggaaacttaggtagaatgccttaaactttacaaagtcaaaagataagtttagctattaatagtataagactgttgaacacaaagaaacaataaaatggtggttaccagaggctggagggtaggggagtagggagatactggtcaaatgacacaaaatttcagttaggaggtgtaaattcaagagatctatcgtacatcatggtaactacagttaataacaatacattgcatatttgaaaactgctaagaaagtagatattgtgttctcaccacgaaaaaaagtatgtgttaatgcacatgttttaagtagcttgatgtagccattccagattatatacatctatcaaaagatcctattatataccataaacatatgatttttacttgttgattaaaaaataaattaaaaatagtgtgactttaatgctgctgacactgaaaaaatactctttccttcagcagttaaagatagcagtcaagtcttcactctt

SEQ ID NO: 408791 - DNA, 464 bp, Homo sapiens
attgagtattcctgggcaagaccaaatcctggctaccagcaagtatacagataatgtataacttgaaatactaagctgctaaagtattaaaaataaatgtttataaaacatggtattttacattgaaatggaataaaaatactttgacataaatcataatgctgctcctctgtcgacagtaaggaagaattgaaacacgagagaacagttgtaaaagtagatcaactttggactgaaagttgttaaaaagaataaagatattaatcagccatctaacagcatttttgttaaagcatccttagaatgggtagacttgtttggaagttataaattctggtatgtttgctaacaatgggtcctacttcttacagggacacctcagtggtagacctcagtttgggcagtgctgggtaactagtctgttggtattctgtctttttaaataaaaggttttctaataaaaa

SEQ ID NO: 408792 - DNA, 399 bp, Homo sapiens
tccctagaaattttctcaactttgtgagtttcatccaggtactttgccgttcttgaacatattttcatgtggttttataatatttattcaacattattttccattagttctctaattttaattgttggtaagcatttcgatgtgtagctattacatggtgcagaactgatttatccacgttaatgtctgaggagaccatgacccattttatctgctgcgtggtcagccctggtattcatggcaggttgtctgaatatttctgatgaagtctttaagtacatgtaattctgaaaacacattcccattcagtaagacttatacaggatggtaagcctaacatggcaaaaggtttctaaaaaattccataaacattaagcatatttatgtcatagcattaag

SEQ ID NO: 408793 - DNA, 794 bp, Homo sapiens
tgctaaaggagtttgcaggaagcagacacctccttttgggatggccagaaataatgactgaaatttgactttgcatagtctgatagacaagagcatttccgatgaatataatgatagcttgttgaaatgaatttctcctatgatccattttgacctttcttatttccttgttgttaatagcatttactttgtttctcgaagctgaaaaccttaagggccttcgactcctccctttcctttgtccatcatgtctaattgatggactcagagctgcatgctttcacaaacattctctcacctgatcttcacgtgaaccctgcaagattggtatttaatgttctcacttaaacggatagaaaaactgaggctaagaacagttaagtcacttcttcagtgtccctagctactggttgttggaactggtatctaaaagagagacagagatctttctgatggactctaaatttcatgctgaaatggagaagagctgaagagcacagaggagagagaatagagaataaagagggccaggcgcggtggctcatgcctgtaatcccagcgctttgggaggctgaggcgagcggatcgtttgagtgcaggagttcaagagcagccttggcaacatggcgaaaccctgtctctacaaaagttttaaaaaattagctgggcgtagtggcactggggaggctgaggtgggaggatcgcctgaacccgggaagcagaggttgcaatgagccgagagcacactactgcactccagcctgggtgacagagtgagactccatctcaaaaaa

SEQ ID NO: 408794 - DNA, 546 bp, Homo sapiens
tggcacacagtaggtgtacttttcccctttcagacaaagtgtaagcattgccatccttattttctctaggaagtgcaaagcctattttatgccctggtaggtgagtcagtggaggagaagaaggtggtagaaaaatagctggaggtaaagtagtgaagacagcagaggagattgggaggagaggcaatactgtagtaagcacctgctatacacagggagctagatgcagccattgtggggttttgttttgttttgttttttagtaatggtaggttttcctggttctaggagtaattcatgcatgctgtagaggctttggaagattacctttgtatagatcattttagtgtttcagataggaaacactgtggcacttgctgtgaaaaggatcctggtggtcatcccatgaacattgattgagtcccagatgtgtgctccggggagtgctgaacaatggaataaagaagcacatctcaggaggtgctgggaagaaacttgggatttcatctggggaacagagttgctgccagtgcttcagttagcatt

SEQ ID NO: 408795 - DNA, 450 bp, Homo sapiens
gtagatgcagagggcagtaagatataactcaactttgaaaatgtcagccgttatagttgaagaaatctgacccaagagacttcgctccgctgcaagatggaaggaagcttaagtaagacataaatttgtaatgaacttgctcacaacatccgccgccactgtgacttgcagtcatcatccattaccacaaaattaggtgagcctgtgcttgaatctcgtttcttttttttcagcagctcagagatggagtttaaatcattgatatactttatctgaaaatatgtaataatatgagaacaggaagatttaaaggggttattaagataataagatagaaaaatcatcagaagaaatttctacactttattgtattttaagtgggacccttttttcctatcccaaggaatcttagatcaagttcagtaggtggagctcttaactcttacttaa

SEQ ID NO: 408796 - DNA, 352 bp, Homo sapiens
actatgtgttagaagttgtctaaaatacccacctagccccccccccccccgccaccccggcttcttgcttaacaagtaacctcaaggaccaagaaagaggttaaagtttcaagttcaacagatggggattgcgtgtgctaataatcctctaatgaatagaatctgctcacttcaatgaaaaataagaaaaaagaaatatttgttcctttataatgtactcatttgctcatagttaatgaatatcacataagattaaaagtcgcttaaggttttcttgctatgtcctttaactggtttattttttaattttttaaattttaaatagagatggggtttcgcaatgttgcccagg

SEQ ID NO: 408797 - DNA, 424 bp, Homo sapiens
agaaagaaaatatatagtaattaaaagaaggtgagctactttcatagattcagcattcttaaggatcttcagacactattcagaagatagcaatggtggaaaaatgatttttttgttgttgtttaaagagaactagcacattggctgggtgcagtgcttcacgcctgtaatccagcactttgggagaccgaggtgggcagatcacctgaggtcaggagtttgagaccagcctgaccaatatggtgaaaccccatctctactaaaaatacaaaattaaccacgcatggtggtgcatgccttcaatcctagctacttgggaggctgaggcaggagaattgcttgaacctgggaggaggaggttgcagagagctgagatcatgccattgcactccagcctgggcaataagagtgaaagtcagcctca

SEQ ID NO: 408798 - DNA, 425 bp, Homo sapiens
gaaatatgctttgattccaattgcctagcaggagccagtagcattgcaggcatttccctagctccagttccttaatggtgccatgcactttaggaacccagaggtaatcagagaaagttgcttccaggggcaccagggcagagaacaggacaagaccctcaaaagaaagagggaagtgtgcaggagactgggctgctcaagatgacctcacctcagtaatgctgcccacagtcctacagtgggtggaacagctgactcctacctgtagcagcatggaagaactcagggcagagaaggggaggccctgatgtgtgtcaggtgccctgtgaggtcagaaacatatttgcccaagttcagctggaagaagtggggacaggaaatatgagcatgaacttagtccatgcaaccattgcctcgaacagacc

SEQ ID NO: 408799 - DNA, 416 bp, Homo sapiens
agttctttctttacccagcctttctccttcatgtgaaaatgttcattcttctctcctccttgaagctctattctttgtcatatgtaactctttatgctctggttcttctctatttctgtttcttttttgttttctctatgggctctttttttattcattacctaaatgtaggtattcccatggtttcatccttgaccttactctacaaacacgatttctatttccctgatttcatttctcatctgtatgcttatgacctttctgtcaagtattagattcacatatccaaatggcagctactgcttcacctggatgcctcatagccatttcaaatccacctagtcattcaaagtagaaacccacaggtaactatgaacccccaaacaccaccttcttaacttcatatatttaatgaa

SEQ ID NO: 408800 - DNA, 412 bp, Homo sapiens
gaacatgagttctaatcccagctctgctacaaattcacggtgtgaccctgggcaacaacttgcccctttctgagcctcagttcactcatcagcagaacagtggcaatcactctcccctcactgaggagatgcaaagtccaacaagatagcacatctaaaactgctttagaaagtcctgacatgaggcaagcatggagggggaggaaggacgggatctgagtggtcagatggcagccccactcctccacacaaatacccaactgggtcaccccgactggccatttggatccaaaggaccccaagggcatgcacccgatttgcatcagtgctctgaggtccagggtgaaaggaaagaatccccagcagcccgggccccagggcaagtggaggtggggaccgggaggaatgtgcc

SEQ ID NO: 408801 - DNA, 386 bp, Homo sapiens
agaactgtaagacagtgtgtcagaatggattcagttgcagagcaggaagcctggatcccagcgccggacggaaatgagaggtcgatggtgcaggctggtgtgggggttcctccaccgtcagggcccaggctccttctcaggtctcagtctcactcttcttagcacgaggtcaggtctcattccttggctgcgggagctccagccagcacacgttttaggaagaaggaggaaggaagaaggtaaagggtggatggcagctgcctcctcctctcttggaagctcacagagcgctgggtcacaattccctgggtagaactggatcacacaggcacccctgtcagcaaaagaggctggaaaaagtatttctgaagctgaatcaaattaag

SEQ ID NO: 408802 - DNA, 385 bp, Homo sapiens
ttaaccttgcttgaatttcatcagatttaacagtgagactcagcggctagtgtccagtatctcctctagagtgcttcttatgaatagaagtaacagtggcagaaacacgtaaagatcccccctgctgtgttttccatttcttatatttgctcttttggagaaatgttagtctgctttcaagaaaaaaggacagagtagataatctttttgctggttcgagatctagaattacgacaagcttgctgacagtgggaaggataagagaagagaggttgctgtttttcttttgttcagccttctcttctctgttccataagtgctctgatacaaagattttctagagctaaaaaatgtttcagtcttttttaaaaaccttatgtggctc

SEQ ID NO: 408803 - DNA, 1152 bp, Homo sapiens
ccctcctaagagttcctctgctgtacgactgcactcccgcaccctcccctaaatcccccctcttcggcctgtttaccttttaacttggcttcgttgcacgtttgtgtgtgtgtgtttgctcttcgcagcctcttgagcgtcttttgtacttaattcttacactgtggacgctctctcgcgcccgccatcccccgacccctctgatctccgatccttgacgatgtctagcctgcattgattggcccttttccctgggtatggcagatctattgcttgatgatcctctccccccaagaattctaacacaggagctgtcctgaggctctggatgactttattcttcaaatggctttaccctcccagtagctccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggcccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccagcactcactctgctccttccctgttgccaatgtctcgctgactaagggtggacgtgatcgggtgctgatgtatggacagccgtatcgtgttaccttagagcttgagctgccagagtccctgtgaatcaagattgggcatgtgcttggtcaccatttcctggtacaccagaggtggccgaatcatctccatatcttcgcgtacggtgatgctgtattaccggtcaga

SEQ ID NO: 408804 - DNA, 1035 bp, Homo sapiens
ccctcctaagagttcctctgctgtacgactgcactcccgcaccctcccctaaatcccccctcttcggcctgtttaccttttaacttggcttcgttgcacgtttgtgtgtgtgtgtttgctcttcgcagcctcttgagcgtcttttgtacttaattcttacactgtggacgctctctcgcgcccgccatcccccgacccctctgatctccgatccttgacgatgtctagcctgcattgattggcccttttccctggggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggcccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccagcactcactctgctccttccctgttgccaatgtctcgctgactaagggtggacgtgatcgggtgctgatgtatggacagccgtatcgtgttaccttagagcttgagctgccagagtccctgtgaatcaagattgggcatgtgcttggtcaccatttcctggtacaccagaggtggccgaatcatctccatatcttcgcgtacggtgatgctgtattaccggtcaga

SEQ ID NO: 408805 - DNA, 809 bp, Homo sapiens
tagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggcccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccagcactcactctgctccttccctgttgccaatgtctcgctgactaagggtggacgtgatcgggtgctgatgtatggacagccgtatcgtgttaccttagagcttgagctgccagagtccctgtgaatcaagattgggcatgtgcttggtcaccatttcctggtacaccagaggtggccgaatcatctccatatcttcgcgtacggtgatgctgtattaccggtcaga

SEQ ID NO: 408806 - DNA, 534 bp, Homo sapiens
ggcacacaagccatgccccctcttttctctttgggataccaccagtgccgctggaactatgaagatgagcaggatgtaaaagcagtggatgcagggtttgatgagcatgacattccttatgatgccatgtggctggacatagagcacactgagggcaagaggtacttcacctgggacaaaaacagattcccaaaccccaagaggatgcaagagctgctcaggagcaaaaagcgtaagcttgtggtcatcagtgatccccacatcaagattgatcctgactactcagtatatgtgaaggccaaagatcagggcttctttgtgaagaatcaggaaggggaagactttgaaggggtgtgttggccaggtctctcctcttacctggatttcaccaatcccaaggtcagagagtggtattcaagtctttttgctttccctgtttatcaggttggtttttattcctttgttcttttctagttacctgaaagagtgaaagaagtggaaaaagtgattgaataaaactattctttttcattg

SEQ ID NO: 408807 - DNA, 646 bp, Homo sapiens
ggcacacaagccatgccccctcttttctctttgggataccaccagtgccgctggaactatgaagatgagcaggatgtaaaagcagtggatgcagggtttgatgagcatgacattccttatgatgccatgtggctggacatagagcacactgagggcaagaggtacttcacctgggacaaaaacagattcccaaaccccaagaggatgcaagagctgctcaggagcaaaaagcgtaagcttgtggtcatcagtgatccccacatcaagattgatcctgactactcagtatatgtgaaggccaaagatcagggcttctttgtgaagaatcaggaaggggaagactttgaaggggtgtgttggccaggtctctcctcttacctggatttcaccaatcccaaggtcagagagtggtattcaagtctttttgctttccctgtttatcagggatctacggacatcctcttcctttggaatgacatgaatgagccttctgtctttagagggccagagcaaaccatgcagaagaatgccattcatcatggcaattgggagcacagagagctccacaacatctacggtttttatcatgtaagacatccaaaaagaattaaactgggcttgtgtgacccaccttttggctgaaggt

SEQ ID NO: 408808 - DNA, 786 bp, Homo sapiens
ggcacacaagccatgccccctcttttctctttgggataccaccagtgccgctggaactatgaagatgagcaggatgtaaaagcagtggatgcagggtttgatgagcatgacattccttatgatgccatgtggctggacatagagcacactgagggcaagaggtacttcacctgggacaaaaacagattcccaaaccccaagaggatgcaagagctgctcaggagcaaaaagcgtaagcttgtggtcatcagtgatccccacatcaagattgatcctgactactcagtatatgtgaaggccaaagatcagggcttctttgtgaagaatcaggaaggggaagactttgaaggggtgtgttggccaggtctctcctcttacctggatttcaccaatcccaaggtcagagagtggtattcaagtctttttgctttccctgtttatcagggatctacggacatcctcttcctttggaatgacatgaatgagccttctgtctttagagggccagagcaaaccatgcagaagaatgccattcatcatggcaattgggagcacagagagctccacaacatctacggtttttatcatcaaatggctactgcagaaggactgataaaacgatctaaagggaaggagagaccctttgttcttacacgttctttctttgctggatcacaaaagtatggtgccgtgtggacaggcgacaacacagcagaatggagcaacttgaaaatttctatcccaatgttactcactctcagcattactgggatctctttttgcgga

SEQ ID NO: 408809 - DNA, 382 bp, Homo sapiens
tgggaggcagagcttgcagtgagccgagatcacaccactgcactccagcctgggcgaccgagcaagaatccgtctcaaaaaaaaaaaaaagactatggatctcataggctttcactgtttgacgaaaagtagatgttatgataggacttagaaaaaaatgcactgtcctcttgcaaatataaagtttgtggggaaagtacctcttcctgattcttctcttcataggcaagcagattttctatagtttagctagtttctcgtgcttaatatataaacaatgcaaactggaaaacacataagtttctcagaaagatgtctttatttactatgttgttttgaacagctccatctactactgagggtgctcaccagctacaggggg

SEQ ID NO: 408810 - DNA, 553 bp, Homo sapiens
ggaggcagaggttgcagtgagccgagatcaaaccactgcactccagcctgggcagcaaagcaagactctgtctcaaaaaaaataaataaataaaagaaattatgttcacttccaataggacaattttgtattttctcagaaatattaaaaggagccaggcatggtggcttgaacctgtagtcccagctactttaggggttgagacaggaggatcacttgagtctaggagtccaaagaccagcctgggcaacatagtgagactctgtctctataaaacattaaaaaattagccagatgcttgccaggcgtgatggctcacacctgtaatcgcagcactttgggaggccaaggcaggtcgatcacaaggtcaggagttcaagaccagcctggccaagagggtgaaaccccgtctctactaaaaatacaaaaaattagccgggcatggtggcagacacctgtaatcccagctactcgggaggctgaggcagagaattgcttgaactcaggaggcagaggctgcagtgagctgagatcatgccactgcactccagcc

SEQ ID NO: 408811 - DNA, 764 bp, Homo sapiens
gaattacaagtagtctgagcaggaagaacctctctccagctgaaaagactctcaggaagtagtattggtttggggtttgagtaatgcactgaatttgcaaaggcaaagagtgacacaagaaggatgaggctctatagattaagaaatcagtatgagcaagaaatgataaatgctgggcattattatgaaccaacaaatacaccaaataggctagagtgtagggcttataaacaggagacaactaaaagaatgtgattctaatagaaaacagtaattccccaaacttgctaatcatctaaggaatttcttgaatatgtatttatagatgccacccctagagacagctggcttgggaagcctgagatgggatcatagaatttgatcagttctatattatgtgctttttttgttttatttctctaaagaattcatcttgtcttcctgttttctttattcttactaatatgcaaatgatttttacagctcatgcagtcctgtaatcatgattattgctatgctactttgcaaaaaataaaaacaaaaaattcataccaaaacaaatacagactagatttggggtggggaggggaaataagtgagtcttaaaagtagttttgttacttgcaacaaactgtatatatagaaactttgtacaacccagggtgactatttccaaagactgttacctatttgttgaacaacagtgggaaaactacttagcctaaatgaggaggaggaatattgtatgcttccatcgtaaccgt

SEQ ID NO: 408812 - DNA, 242 bp, Homo sapiens
gaaaaacaaaaaaaggagatgggggtgggagattgacatcttgtggatcacagataatagcatcaatccaaaagaggcagaagtttgctaattatttgctgaatttagagaagtgtccctctcacccatttgcatccttatagacttttctgaaaaagtgacagcaccccagaggtgtcccataaccattagcccgtcttacacactctaatcccatagcgtaagtctgggtgggctaaccc

SEQ ID NO: 408813 - DNA, 426 bp, Homo sapiens
gcaacgagagcgaaactctatctgaagaaataatagaagagaagagaagaataaaataaaaagtaaaataaaatagttctgatggtacatgataccatactaaacctagctttaaacaaataagatgaccaggcacattggttgacacctgtaatctcagcactttgggtggccaaggcaggcgggtcacttgagcccagcagttcgagaccagcctgggcactctagggagaccctgtctctaaaaacaaaacaaaaaaccaaaaatttgccaggtgtggtggcatgggcctgtagtcgcagctactcaggctgaggcaggaggatcactggaacttggaaggttgaggcggcagtgagctgtgatcatgtcatccacactccagcctggatggcagagtaagaccccatctcaaaaaaacaaaa

SEQ ID NO: 408814 - DNA, 353 bp, Homo sapiens
gtgcagtggcgtgatctcggctcactgcaacctcggcctcctgggtttaagcgattctccttcctcagcctccagagtagctgggactacaggcacgtgccaccatgcccggccaatttttatatttttagtagagacggggtttcaccatgttggccaagatgttctcaatctcctgaccttgtgatccgcctgcctcccaagtgctgggattataggcgtgagccaccgcgcccggccttgcgtagccatttttatggtgaaagagaacaacagctcaaccacagatttatattcaagtctgttcattagcatgtgtgcttggaaaaagtgacttttattccatatttaat

SEQ ID NO: 408815 - DNA, 395 bp, Homo sapiens
aaatgctgtaactaggaatgggtcagtgaagttcaaacgacttttccttgagggagtattttaatcggacaagggaactctttttcttttgggcattggccaacaggactgagaagccagagagcttgcacctgagccatctcagccgtgagagtaacagtcctaggaaaatagatgggggctgggggtaaggaaatgtgctgaagacagagctattctggatggattttggtttgcaaaaattctactttaaaacaattttgcctgtagcaagtacatttttttgcaattggagtgtaaacattctgtgtggcaacagttaaaagctgttataacaatttgcttgggtgtgtgtgcatgtgtgtgtgtgtgtgtgtgtgtgtatacattgttgc

SEQ ID NO: 408816 - DNA, 401 bp, Homo sapiens
ttcctcctcgtgcccgccggagagaatagtttcgctgaaaatttctctttgtcaatgggatcagtattaaatcagcaatatacaagcggggctagcaaaggtggtggagaagagcccgggaagctgccggagccggcagaggaggaatcccaggttttgcgcggaactggccactgtaagtggttcaatgtgcgcatgggatttggattcatctccatgataaaccgagagggaagccccttggatattccagtcgatgtatttgtacaccaaagcaaactattcatggaaggatttagaagcctaaaagaaggagaaccagtggaattcacatttaaaaaatcttccaaaggccttgagtcaatacgggtaacaggacctggtgggagcccctgtttagg

SEQ ID NO: 408817 - DNA, 905 bp, Homo sapiens
tatctgttagatctagtgatgtctgaaggaacccaaaggtcaagtaatccaactccctcatagtgtacaaagaaatcttgcatatcttccacaggtttattgacttttatccaacacttttcatgttttaatttcagcctttgtgaaagttgatattaaaaatacagaggtgagaacttgttagaataaccaaatgaatccacataatgttagatcaaaatacaaatgacaaagataaaatgctatgtagtgcctaccctctttacattttgtctattttatttaagtttttctgtattgtagttaacatcaaacattgtccagtcttgtaggtgaggaaaccaggacgaaatatattttgtatttcaacattgacataaatctgaaattgttggttctactaatagtactctgcactgaaggcactggcaaaataatggttaaaattgagcacaggtgttccaagttgtgtgtgtgtgtttattactgaacattgggagccgtgatagggaagtaatttgtgagttcatgatttcttaaggttctagtgtgacatttatacactgataaaactcaggcaagcaaaatgtaattaaatgttccccctgccccccccccttttaatatatatatacggagcttcactcttgtcacccatgctggagtgcaatgacatgatctcaggtcactgcaacctctgcctcccgggttcaagcgattctgcctcagcctgacttcccttctgtttctttattttcgcactgtgtagaccagctgactgccttaatatgtattgaatcaattcaagatttatgttcatagagtgctgtgtttatacagtggtgtcatgtgatttcttaatagcctatagatccaataaatacagaggaatattagttacaact

SEQ ID NO: 408818 - DNA, 331 bp, Homo sapiens
aaactattggacaaggcagaatgaatatagcctcccatggcactgcactgtagaccaccttacatattggtattgactgttgttaagcagcacacattgaatgcagaagttcaatcatttatgaatctacccaggtgaactattacctattttgtctgtaagaattcttagctgggcatggtggcttacacctgtaatcccagcactttgagaggccgaggcaggcagatcacgaggtcaggaaaatgagaccatcctgcctaacatggtgaaaccccgtctctacaaaaaatacagaaaattagccaggcgtggtggtgggcgcctgtag

SEQ ID NO: 408819 - DNA, 2738 bp, Homo sapiens
gggtgggtggagctgtgggattaggaaaactggaatgaagactcattcttttgaaactcagcctcagataaataacaaactaggaaatggaaatctgtttcaagaattgcagtaacatctactctaaggaattagtaatttcactttttattatttgtaccaaatgtatgtgtgtgttgtgtatgttggtgtaaatgtggagaggtggtagcaatacatactgatgctgcttgtaatttgttgcagggaattactgcacaatctcagaaaatagaaagcttccccagtgctttctgtcatcagagttgggatgattgtgaggttttgaatgatagtattggacctaagaaataggattagcatcatgatcagaactgttgagaatccttgtacaattatgtacattattgcatgtagagtaaacctgagagcttagagatgtatacgtttccactgctggaaaatcattataagttagggcaacattttctataggtggcagcagtaggagctcatcacattgaacattttcagattttaaaatgaaaattttcatccgtaggaatggcccaatgtatagttattagctactgagcttagaactcttgacccatgagattttttttttaaatttttatttttatagaggcaaggtcttgctatgttgtcaggctggtctcaagctcctggcctcatcagttctcctgccttccaagtagccggaactacaggtgtgcaccattgcacctggcctcatgagtattttagttagataagatttgtttggttcagtgggtcttagttttttaagacctgttaatttgtaattagacatcttgggccttaaactgtatttttgttttagtggtgaggttgggttttactttgtgtattccagcgttctcaactttgtcagatattgctagggaccagtgagatagataatccaaaaataataatttgactttggttgagtatgtcattaccacagtgttagttgaattgcactttaggttagaaaagttaattttcacatctgtgctgcgggttaggtgatattgtcctcagcacaatagatgaggaagaaactgaatcagaacagttaaatgacaggcttccaagtcatccatgtagcaaggagcacatttgcctcccaaactgatgctttttctctagaaccataatgcccccctaattacatttcagtagcatagaccgcaatgaacttcctactgtagggagacttgagtctggaatacattcagaacaaggttaacattacagttcttaatttcctttagggcaaacaagataattaaacttgggttttgtgagtctttttttgatttgcagattatatatggtaacacaataatggtggtttgtttttaagttttttctcatcaggtttgataatttaatgcaaacttcaaatctggatgtgaataataatatttttattatagtataatccaggtgagtttatagaatttgtgttttgtgcttataaactgtcaccttctgatacttttcttcatccctctatttgaaaaacccttgtagaatttaacgatttaatggaaaatgttgcactttatagaaggccattttagaacttacaggtaacctttttgaagagcttagatttgtagaccactgtttatgctgagtgacatttcttttaaatggttgcatttgtcaaatctataaagatgttttttatattgcagttttctttttgtgctacttaaaggaatctttgcaatgctgcatatagataattgttgacctttttagttcagcagtttttaaacttgaagtaacatcagcatttatttgaatatcaggttttagctaactgcctaatgtaccaaaaaaaaattagcaatgtcttatgtgggatgaggggttaagttaaagttgctgatcaagtaatggccgtgtggcacaagatgataactaagaatttctggttctaaggtagtaatgccttttgggatttatatttgtttaatgttgagattctggggaccataggtgggcctgtcaactcttaacagactatagtaaaggagagatggtggcacatgtgagataaaacttgtttatatttacattcttattagtggatagatatcacctcagtacaacactgaaattaaactgccttgttcatgctttcatgtctcaaatcaaggcctaaatgagtaaaaagatgattacagattacctaaaacccttaaccagttttggtttttgattatgcatatgtgttggcttgcaattaggtttttagtttctgtttatgtgacttgtttgaaaacattggattcgtcttctctccacagtttctacttgaacctagtagcttattttaattccctgtaagaggaaaataatatagggaatctgttcaactattcctttaataaatcatgtgacttggccaattacagaaattcctaagtgtagtattttgaaatgtggccagtgtcccagatttgtaaggtacagtgtgcatacagtgtgtcttaggatttttttaagtaaattaaggatgtttaccagaaattattgatttactgaaccaagtatttattttcagaagcccacttttggggaaggttgcctatatttttgatagtaattagatggaagattaaatcctgtttaacctggatagaaacagttttaactattgctgaagttaaaatcactttggggtggggtggggtggc

SEQ ID NO: 408820 - DNA, 481 bp, Homo sapiens
tccctgcacaagctctcttctcttgtctgctgccatgtgagatgtgcctttcaccttctgccatgattgtgaggcctcccccgccacatggaacttttaaacctgtttcttttgtaaattgcccagtctcaggtatgtctttatcagcagtgtgaaaatggactaatacagcacaatagatgacagcagacctcaaattgatgtaaacctcatggtttaggaatagttaacttgatcttgtacaagtagtgtttgaatagtgaaactgagcattaagtccatagcttatataaccaaaaacttgcaaagatacacacagagggtgattgcatttactggtgcaactgaccacttgcctgtgctgttattcatgttaattattgtcaaaaaagtatctcgggttttaaaagaagataatcatactatctgcaaataatgttatctcctttttactaataaaaggtttgtcatatagtggaga

SEQ ID NO: 408821 - DNA, 352 bp, Homo sapiens
taataatgaataaaaatgatctcagttaatttgtggctagaaagtaaatctcttgagaaacttaggtgtcacaagggtttttgcaaatttgcatgtggagaatccactgtaccagacagagcggctctttgtataaaggcctacattggtcttccctattggtcctcacacttctcatttcaatcaacctttctttactgtgttggcaacaagtctttccttagacaatttcatatttctcacatttaaatgaagtaatgtttagtgcaaagtggcttcctttaaaatattagttatctgttagactaactactgaagttattcatgtatttattcaagtgatatttctgag

SEQ ID NO: 408822 - DNA, 687 bp, Homo sapiens
ttttttgagacggagtctcgctctgtcacccaggctggagtgcagtggcgtagtctcggctcactgcaagctccgcctcccgggttcacgccgttctcctgcctcagcctctctgagaagctgggactacaggcgcccgccaccacgcccggctaatttttttgtatttttagtagagacggggtttcactgtggtctcgatctcctgacctcgtgatccgcccgccttggcctcccaaagtgctgggattacaagcgtgagccaccgcaccccgcctgaaaatattttctaaaaagataaaaaatatacataacgatgaaaaataatacaaatttaaaaaccaatacagtataacaactatttacatagtgcttacattgtattaggtgttataagcaatctagagatgatttagcaagtatacaggaggatgtgcctaggttatatgcaaatactgtgccattttatatcaggaacttgagcatctgcagatattggtatcggagggcggtcctggaaccaagcatccacggatactgaggggtgacatttcatgaagtgtagatcattgtattcagagattgtaaatgaaaaaaatatagaaactatttagttttggtagattttttttctgactatgtgaccagattgaatttcctcataaagaaaaaatggcgtgccttgtg

SEQ ID NO: 408823 - DNA, 295 bp, Homo sapiens
caagctatggaagaagtaggggatgggacccaccttcaggagctgctgttcatcgtagagggaagccctccattgcttggagaaagacagggaagaccatcccacgtcaccttgcatggtgagaatgttgagagctttcagaatttgagaacaaaggaaattcccagaacgctagtcttaggcaaggctttctagaaggggcaggacttgaactggctttgaagatcagtcagccataaggtagacccaaggtgtcaaggaagacatcactgtggagagggaacagcaaaggccc

SEQ ID NO: 408824 - DNA, 605 bp, Homo sapiens
accaccacacctggataatttttgtatttttagtagacacaaagtttcaccatgttggtcagactggtcttgaactcctgacctcgtgatctgcccgcctcagcctcccaaagtgctgggattacaggcgtgagccaccacacctggcctttctgcaacatttttttaaaaaaatctaataaatcttagatttttaaaaaagaattaaaatgtgggagttctcagaaagaaataaacacatgagaataagattattacacattttggaaggacttttgaggaatgatgtgatgtgtagagaatagaaagatttagatatatgcctgtgacaggaatagattctgggttcaggggtccccatctgtcaaatgagaagattggattatctaatcttttagatccttaacaactctgatattctgagattctctcatttgtagaatgcccgctgatgcattgtttattttttttgctcataatataaatatcagattatgtttaggagtggattaggtaattagtgtcactacatgtatcattaaaggtcctaaaaggaattgttaggcggcaggctttgtgttacgtgttacatggagtgagggtag

SEQ ID NO: 408825 - DNA, 489 bp, Homo sapiens
cgagactcggtacccgtctcaatgttctacacctttctgcaacatttttttaaaaaaatctaataaatcttagatttttaaaaaagaattaaaatgtgggagttctcagaaagaaataaacacatgagaataagattattacacattttggaaggacttttgaggaatgatgtgatgtgtagagaatagaaagatttagatatatgcctgtgacaggaatagattctgggttcaggggtccccatctgtcaaatgagaagattggattatctaatcttttagatccttaacaactctgatattctgagattctctcatttgtagaatgcccgctgatgcattgtttattttttttgctcataatataaatatcagattatgtttaggagtggattaggtaattagtgtcactacatgtatcattaaaggtcctaaaaggaattgttaggcggcaggctttgtgttacgtgttacatggagtgagggtag

SEQ ID NO: 408826 - DNA, 489 bp, Homo sapiens
aggaagtggtacataaatatgtctgttattatgcaatcgtaggtcatgataatttattcagttatagaaaacatgccacagaagcctatgtaacaagtggtgcttctttagaaagttgtcattagaatgttctgaggaagttaagcagctgcttcatcaatcccatgacacatgccttgttagcatgcccatcaaataatcagatcaaacacctgctccttattgccatacccacgaactgttaaatataaaaaaattcaaagtatttgacatcttaagcaaatatccagaatatttttaagtaaaaaaccatcttaagtattcaaaatttccttggttttttaaaggtgataattttgctttgtgttacttttttgctcttgaatgtatcgttatgatggtctcttataatcatggtatctttcacagaataaaaattaaaaataatgccagggtgcaagtgaccaaggccttatcttgaaagttaaa

SEQ ID NO: 408827 - DNA, 846 bp, Homo sapiens
tgtcgaggttcaaccatcattaactcatggtcaatcatctgtcatgcccatcttgtttgatgcgtgtctgcttccaaacctgtctgcctttccaatcccagcaatgccagggcatttcacttttcaatttattatttacatatatatcctaagtggatacattcatctactgtactctacacactgggttccacaaaagcaagcagacatgtgtggtgctgtacaactacttttatagaacttgccaccatacatttataaattataaccatataatgtaccaacaatgctttgaggtagaatactaccactttacagatgaaggaactgaaacacagaggttaggcaacttgcccaccatcacacagtgagttaagcagcagaactgagatttgaaccccaaacagtctggttccagaggctatgcctttagccatgacaccacagccttcacacaggaatttacatgcactactgaacgctcaactgcttagccaaagcttctgcattggaatggttcctgccttgttaccccagatcaatgaatagagactttccttaaaacactattcggatggctctcctcatccccaaacaataccacaagttactccagggcatattctgtttataattttgaaatgtcaggtttcatttcattcatggcatcaaaactttgaaatttgctgagatgaaacttacggcacagtatatgatcagtttttataaatattcaatgtgtgcttgaaaagaatatatattctgcaattgttgggttctatacacatccactagattgttagtcatgtgttcagctttatatgcatataaaatgttaaaatttca

SEQ ID NO: 408828 - DNA, 472 bp, Homo sapiens
cacttttaaaaggtgagttttacggtatatgaataccattcacataccatatttaaactcaatttaaaaatcatatagaattgaagacaccaccctgaacaacacagtgagaccccatttcttcaaaaaactttttttaaaaattagcagagtcagggcaaaggagaggagctgagatgagagggttccttgagcctaggaggttgaactatgattgtgctactgcgttccaatctgggtaactgagtggaaaccctgtctttaaaaaataaataaaggaaaacagtggtgtacttctaataaactgctatcaaacctggatacttttgacagtgaggggtcttacttaatagttacacctgtctcaggtaaaccagaatgtatgttctccctactttggtgtgttgaaactatttttccttcagaaatgtgaagaatataaaattcttctcatattcttctttagcaagtg

SEQ ID NO: 408829 - DNA, 384 bp, Homo sapiens
gtcaccacatagatctttttataaggagcaatatttttaattgtgatcttataaaaaatataaaaattctgtttttgttatggtagcatcctatagaatttgagcccaaagtgcaaatttaggtgcagttgttgcaagcatttcttcggtaggtgggcagaactgtgagatctgtggaaattgtagtgatggtgctgattcctagtgaggcagcttttattaatgtctattatcaattgccatgggcttataatgactgaaaggagaatttcattcatagtatttactatttgctacataatcttaaattgccaaaaatttccttggacactcaagttatgtttgggttaattcaaatatttaatgctagtggctcaatctgaa

SEQ ID NO: 408830 - DNA, 1264 bp, Homo sapiens
ctcccaagtagctgggactacaggcatcgaatctttttgcctaatttttcgtttggttgactgttttcttaatgaattttgagggttctgttcattttctggatacaagtcctttgtcagatatgtgatttacaaatatgttctgtttgtaagtttttattcttttaacaatttcacagaggtttttattttaatgaagtctaatttatccatttttaaattttatgaatggtgactttgatgttgtctctaagaactctgcctaactctaaagtcacaaagatttctcttctgtcttcttctaagagttttataattttacatttaggtctctgattttgagttaaattttgtataagatgtgaggtactgtaaataggtcaaggctcattttaaaaaatatgttgaggtcgggtgtggtggctcatgcctgtaatcccaacactttgggaggctgaggtgggtgggtcacctgaggtcaggagttccagaggagcctggctaacatggcaacagaatgagactgtctcaaaaaacaaaaaaatcagtgttcatgtgaaaacctgtgcgtcaatgcttatatcaactttatttgtaaaaaataaaaataaaaaactggaaacaactcaaatgtctcttatctgggggatgtataaacaaactgtgatgcacccttacaacggaatacaactctgcagtaaggaacgagccaccgatgcacacagcaatctgcgtgcattttgaagccgcactgattgaaatgcactgcgccatatgcagccagacccaaaaggccacgtactgtattactgcacttatgtacgttctggaaaaggcaaaatgatagggaaggtgttgccaggacttaggattggggactgttttgatgatactgggatagcacaggggaatcctgggggaagggtgactgttccatcttccttgtggtggtggttacaggactgcgtttgtcaaaactcatggaattacacaccagaaagagcagatttcactgtgtgtaaattttcacctaagttataatagcaactcatcctttcctaatgacattttaccacaatcggtccaattgtctgggtgatagaaggatgcatcacggcgcgctcctgggcttctctaaccaactccacgttttcgcactgccagcccgtggctcgaaatctgatgtggtgggagcatttacccatggaaattgggaaacgctacagatcaaaggtgaatttgttatgttaataatgccaattaa

SEQ ID NO: 408831 - DNA, 773 bp, Homo sapiens
tgttgggattacaggcatgagccaccacacccgacctcaacatattttttaaaatgagccttgacctatttacagtacctcacatcttatatcaactttatttgtaaaaaataaaaataaaaaactggaaacaactcaaatgtctcttatctgggggatgtataaacaaactgtgatgcacccttacaacggaatacaactctgcagtaaggaacgagccaccgatgcacacagcaatctgcgtgcattttgaagccgcactgattgaaatgcactgcgccatatgcagccagacccaaaaggccacgtactgtattactgcacttatgtacgttctggaaaaggcaaaatgatagggaaggtgttgccaggacttaggattggggactgttttgatgatactgggatagcacaggggaatcctgggggaagggtgactgttccatcttccttgtggtggtggttacaggactgcgtttgtcaaaactcatggaattacacaccagaaagagcagatttcactgtgtgtaaattttcacctaagttataatagcaactcatcctttcctaatgacattttaccacaatcggtccaattgtctgggtgatagaaggatgcatcacggcgcgctcctgggcttctctaaccaactccacgttttcgcactgccagcccgtggctcgaaatctgatgtggtgggagcatttacccatggaaattgggaaacgctacagatcaaaggtgaatttgttatgttaataatgccaattaa

SEQ ID NO: 408832 - DNA, 908 bp, Homo sapiens
  misc_feature (754)..(754): n is a, c, g, or t
  misc_feature (802)..(802): n is a, c, g, or t
cgatgattcattcagtgaagctcactccgagttcctaaaagcagccagcaacttgagggataactaccgatttgcacatacgaatgttgagtctctggtgaacgagtatgatgataacggagatggtatcatcttatttcgtccttcacatctcactaacaagttggaggacaagactgtggcatatacagtgcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaatgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggatttctcgcgtgatgggaatgctctggagaggttcctgcaggattactttgatggcaatctgaagagatacctgaagtctgaacctatcccagagagcaatgatgggcctgtgaaggtagtggtagcagagaattttgaatgtgatatgaaatagattctgatgattatcccttgtggcactgagactgagcagttagactgcagagtacanactgattgatgcaatgtgccacagtggcttcatgaggagtctcatctntcgcaagagtatcagaatgaggctataggtttgttcacgagtcacctgtagaaacgaaaagcggtctagtgacatgaagctcatgactggtgctgatctgcgagtt

SEQ ID NO: 408833 - DNA, 1592 bp, Homo sapiens
cgatgattcattcagtgaagctcactccgagttcctaaaagcagccagcaacttgagggataactaccgatttgcacatacgaatgttgagtctctggtgaacgagtatgatgataacggagatggtatcatcttatttcgtccttcacatctcactaacaagttggaggacaagactgtggcatatacagtgcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaatgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggatttctcgcgtgatgggaatgctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcactgtaagaacctggagcccaagtataaagaacttggcgagaagctcagcaaagacctgaatatcgtcatagccaagatggatgccacagccaatgatgtgccttctccatatgaagtcagagttttcctaccatatacttctctccagccaacaagaagctaaatccaaagaaatatgaaggtggccatgaattaagtgattttattagctatctacaacgagaagctacaaacccccctgtaattcaagaagaaaaacccaagaagaagaaggcacaggaggatctctaaagcagtaggcaaacaccactttgtaaaaggactcttccaccagagatgggaaaaccactggggaggactaggacccatatgggaattattacgtctcagggccgagaggacagaatggatataatctgaatcctgttaaattttctctaagccatttcttagctgcactgttatggaaataccaggaccagtttatgtttgtggttttgggaaaaattatttgtgttgggggaaatgttgtgggagtcgggttgagttgggggtattttctaatttttttgtgcatttggaacagtgacaataaataagacccctttaaactgtaaaaaaaaaaaaaataggaatgcggtccatggtttacttaatcgtataatatcagtgttcattttcttattttgataattgtcataatgttgtgtgaaatattctctttagggagcctgggaaagaatatataagaactctactatttttgtaacttttgtggaggactgcaatcatttctaaataaatagtcttaaaaataactaaagtaataaaaataataaagtacatga

SEQ ID NO: 408834 - DNA, 1538 bp, Homo sapiens
cgatgattcattcagtgaagctcactccgagttcctaaaagcagccagcaacttgagggataactaccgatttgcacatacgaatgttgagtctctggtgaacgagtatgatgataacggagatggtatcatcttatttcgtccttcacatctcactaacaagttggaggacaagactgtggcatatacagtgcaaaaaatgaccagtggcaaaattaaaaagtttatccaggaaaacatttttggtatctgccctcacatgacagaagacaataaagatttgatacagggcaaggacttacttattgcttactatgatgtggactatgaaaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggatttctcgcgtgatgggaatgctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcactgtaagaacctggagcccaagtataaagaacttggcgagaagctcagcaaagacctgaatatcgtcatagccaagatggatgccacagccaatgatgtgccttctccatatgaagtcagagttttcctaccatatacttctctccagccaacaagaagctaaatccaaagaaatatgaaggtggccatgaattaagtgattttattagctatctacaacgagaagctacaaacccccctgtaattcaagaagaaaaacccaagaagaagaaggcacaggaggatctctaaagcagtaggcaaacaccactttgtaaaaggactcttccaccagagatgggaaaaccactggggaggactaggacccatatgggaattattacgtctcagggccgagaggacagaatggatataatctgaatcctgttaaattttctctaagccatttcttagctgcactgttatggaaataccaggaccagtttatgtttgtggttttgggaaaaattatttgtgttgggggaaatgttgtgggagtcgggttgagttgggggtattttctaatttttttgtgcatttggaacagtgacaataaataagacccctttaaactgtaaaaaaaaaaaaaataggaatgcggtccatggtttacttaatcgtataatatcagtgttcattttcttattttgataattgtcataatgttgtgtgaaatattctctttagggagcctgggaaagaatatataagaactctactatttttgtaacttttgtggaggactgcaatcatttctaaataaatagtcttaaaaataactaaagtaataaaaataataaagtacatga

SEQ ID NO: 408835 - DNA, 584 bp, Homo sapiens
ctcatgctcgtcgagttcttcgccccctggtgtggacactgcaagagacttgctcctgagtatgaagctgcagctaccagattaaaaggaatagtcccattagcaaaggctgattgcactgccaacactaacacctgtaataaatatggagtcagtggatatccaaccctgaatatgtttagagatggtgaagaagcaggtgcttatgatggacctaggactgctgatggaattgtcagccacctgaagaagcaggcaggcccagcttcagtgcctctcaggactgaggaagaatttaagaaattcattagtgataaagatgcctctatagtaggttttttcgatgattcattcagtgaagctcactccgagttcctaaaagcagccagcaacttgagggataactaccgatttgcacatacgaatgttgagtctctggtgaacgagtatgatgataacggagatggtatcatcttatttcgtccttcacatctcactaacaagttggaggacaagactgtggcatatacagtgcaaaaaatgaccagtggcaaaattaaaaagtttatccaggaaaacatttt

SEQ ID NO: 408836 - DNA, 576 bp, Homo sapiens
aaaaacattgatttttaaagtacacttatgtattcctatatgtatacttgtcactattcagcattataattattataaaaacagtaatgtttctattaagcttaagcaccaaactggcaaaaatactattaataaaaataattaatttgaggcctaatatgagccaagcactttggtaaatatttttaaataaacacctcacataagcttcacaataacccatgaaattgattcttctatggcttatctttcatagatgaggaacttgaaggttgaagaggagactcagctctttagtggtcagcacagctgattgagggaggagttctagacaggcccaaagccatttaatgggtttttaacctctatgcaaaactgttttataagctggtaatattgataatatgcagatttaattacacactgtaatgggtaaactgactgcaggagacacaggaattctccttagggaaaggacttgtttgcttgtttgtttagagaagcagagttaagctttttggctgtaaaaatttaaagagggaagaaagagactgtttgagagttgccaaatgcttt

SEQ ID NO: 408837 - DNA, 1384 bp, Homo sapiens
tggataaaagccattataactggggtgaaatgaaatctcattgtagttttgatttgcatttatctgatgattagtaatgaatggtgagcattttttcatatacctgctggcagttaaggataatgtgattcaatctaggtagattattccagctactggaaaaaaggatttgatgaggctaaagagtcaagggagatcaacttggaggttactgttatatcaaatcctggcaggagatttaaaaagtcctgaactagaatgtagttatttaagatttgagaaggcggtaaacatttaagaaatactttaagagataaagtcatcaggacttggtgcccatatcatgtaaatagggagctggaaagaaattcaaccaaagttataccatctatttaatctcaaaggttacttgtagatgttactgaggacactttaaagaatttaaagtactgcgacagtccctatattaggaaattaaagggaacaaacatacacataaaataaaccaacaatgcaaatttaagttatgccccaattaagaaattacataaagttaagaaaaatggaagaatgacaatgctatcagataaaaagacttccgagtgaaagtgggatttatattttatactatgagaaaactgatgtagctttaaatgtttactagcatttaacctatatttttaaatttaaaattccattgctattatctaaaataaaaaaacctagatttatggtctttttttgaaaatcagaaggatctaacaacactagactcacattcctacacatatcaactagacaactagacaaagtgattaccttacaataggcaaacactttctagttttctacttcccacagttttccctaacaccgtgagtgaatattagttgccatttattaccacacgtacagtgttgttttttgacagtagggacacagttccatgtaccttgatctctagcaacgagggaaaataagaaagatcaagattattgtgtctaaagaaaactgggaatatatatacttgacccgcttcacttgcttacattgtctgtctgattcttccaagcattaattagaatttgcaactcctagctgggcacagtggctcatgcctgtaattccagcactttgggaggccgaggctggtagattacttgaggtcaggagttcaagacaagcctggccaacatggcaaaaccgcatctctactaaaggtacaataaccagcctagcatggtgttgtgcgccggtggtcccagctactcaggagactaaggcagagaatcgtttgaatccaggaggcaggggttgcagtgagcagagatcgtgccattgcactccagcctgggcaacagagcaagactctgtctcaaaaaaa

SEQ ID NO: 408838 - DNA, 991 bp, Homo sapiens
gagcccaacttggtcacagtgagtgaaggaacatggctctgaatcatgcctgtctgtctccccaggtctgtgcttaaaaccacgaagttcaagatggaaactgaagggaagagtgtcaaggggatgggagagaggacttgtccatgactttggcagcataaggaaaaaatacccagggacaagtggcgactttggaaactccattcctctgcaaaatgacatcacgaggagagtggtggggcctgcggatgaaaagatctggcttctcctcccaactctgctatgaggaagcgctggatggccctgtcggccgcggtcatcgccgcctcggcccgggagctcagcattgcagccgcaccggaggcctgaaaccgtctcctccgctaccgccgccgccgccgccgccgccggaccgagggatacgacggttcccgagacagcggaacctgcggccgcagtcccagcacctcgggggaacgtagaccgcaggacagctcccagggggaccggaagtagctgcccccggagagcaatagctgacggaccacgtcctttctttcttttcccttagcaacaggccccggcgtcggttgctacgctgggctcagttgcctggggctgcttggttttcagatttgcttaggctccattcataaatacagatggcacacttctaggatggaccctgggtcatgatttgaatttttcgatgtggggaagggaggccaacagccgaaagtcgggtcaggcctctgctataattagttattattgtggccagagtggaaataggtcgcagaggaaggaactttaatgagcatgaggcccatctctgacgatatcagtagagaaatcaacgtctttaatagccaacaaacttattgtttacttgggtgccaggtatagagctaagtatgttacattcattatttacatttaatattcacaccaactctaacattacccacattttacatcccagggaacccag

SEQ ID NO: 408839 - DNA, 1050 bp, Homo sapiens
aggcactgaaaggactgagggcactgacagaattaggggccttgacaagactggagtgccccgggtgtcctgggaacaatgacaggagggggagggactgacagacctggggagtgcagacagaattggtgttgccgaaggactggagcccgtcagtcctcccacctacgggcccaggcctccaaccctaaaggacgcagaaccttccagaatgcccgcgcgggccctggagaccccaactagggcatgaaaaagccgtcacgggcccaagctggggaccctggtcccggcctcttcggcagccccgccccccaaaatctcacctgacggccgccccggtccgcaggaagcgctggatggccctgtcggccgcggtcatcgccgcctcggcccgggagctcagcattgcagccgcaccggaggcctgaaaccgtctcctccgctaccgccgccgccgccgccgccgccggaccgagggatacgacggttcccgagacagcggaacctgcggccgcagtcccagcacctcgggggaacgtagaccgcaggacagctcccagggggaccggaagtagctgcccccggagagcaatagctgacggaccacgtcctttctttcttttcccttagcaacaggccccggcgtcggttgctacgctgggctcagttgcctggggctgcttggttttcagatttgcttaggctccattcataaatacagatggcacacttctaggatggaccctgggtcatgatttgaatttttcgatgtggggaagggaggccaacagccgaaagtcgggtcaggcctctgctataattagttattattgtggccagagtggaaataggtcgcagaggaaggaactttaatgagcatgaggcccatctctgacgatatcagtagagaaatcaacgtctttaatagccaacaaacttattgtttacttgggtgccaggtatagagctaagtatgttacattcattatttacatttaatattcacaccaactctaacattacccacattttacatcccagggaacccag

SEQ ID NO: 408840 - DNA, 597 bp, Homo sapiens
catggtcgtgggctaaggggccagagtgcttttatgctcagacagccttgactacgttacaaaacactttctacagagcagatagtggccctttgcaggcttcaggaggaaattcatagccggggatggtggtgcacccctgtaattctagctacttgggaggctgaggcaggagaatcgcttgaacccaggaggtggatgttgcagtgagccaagattgtgccactgcactccagcctgggtgacagagcaagactctgtctcaaacaaacaaagaaacaaacaaacaaacaaacaaaacacaagattcagcctactagactgaaggaagtgttgttgtggaggattcagcctaagggtggacctgggcctgctgggtgaccacaggcaggtgattggacctctctgagcctcattttctgcacctctaaagtgagggtcatagcagctgtcatctcacatggccatggggacaaactggcagattacaaggtgcctgtaatcccagcacatggggatgccaagtcaggaggattgcttaaagccaggagtttgagaccagcgtgagcaacaaagtgggatcctgtctctgaaatt

SEQ ID NO: 408841 - DNA, 758 bp, Homo sapiens
gacgccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccacccatttgctcgcagtatcctagaatctttgtgctctcgctgcagttccctttgggttccatgttttccttgttccctcccatgcctagctggattgcagagttaagtttatgattatgaattaaaaactaaataacaaaaaatatatatatataagaaaa

SEQ ID NO: 408842 - DNA, 406 bp, Homo sapiens
agcagatacacaaaggagaaagagaagggaatcaaatcttagcactacagtaaaccgccaaaccttaatgataaacaataggagagaacaaaaataacaaaggatatataaaacaaccagaggcaattaaaaattgataggaataagtcctcacctaccagtaataaccttgaatgtaagcagattaaatttcaccacttaaaagacataaactggtgaaatgaaatttttaaaaaccgtgacacaattatatgctacctacaagaaactcacttcacttcttttttttcttttttcctttttttgagacggagtctcgcttgctcgcctaggctggagtgcagtggtgcaatcttggctcactgcaaccttcgcctcccgggttcaaacaactctcctgcctcag

SEQ ID NO: 408843 - DNA, 505 bp, Homo sapiens
cacaaagcaaataggaggcagaactagaatgaggacgaagcttctgagcctgagcccagcagcctttcctgtcctgccccggtggccagacatccacttgccatgggaacctgtcacctcccaggcccatctgagacctcaacagcttctgagtgtttttgctgggctgtgccctgcccatggtgctgaggacacagaggtgagccatggccatagcagctccaaggggctatgcatggggccctggccataaattctgtatacaactggaggaatggacaacgaaggaacaaatgtgcacccattccagagacaaaacgagggagcaatggattctgcttgggaaagtcaggaagacaggaagctggcactggaagatagggaggaaattccaggcagagggaatgatgtcatcaaagcacaaactaagaataagacaaaaaataagaaccagaagactctgacacacttatcaagggttcgtttccaggcagcactgcactaa

SEQ ID NO: 408844 - DNA, 1108 bp, Homo sapiens
aaattctgcaagttttcttgtaaatttggccaagtactgcagaattcctggaagactgcagaatacacatactcagaaccaagaatgaagagacgttgcgagccatccccactatgcagggcaccaacgggctgccgcagcccactcacaacctcctgaatacagaagcagttgtgtttgtgctttctaaacaaattaaagaaaaccgtgtaaaagaattctttgcaatagtctttgcagagcagaggaagtactaggtctctttccaagacttctctctcagagggaaaattgcaacccttgcctacaaccagactgacagcataatttcttaggaatcaagaatcaatacagggttatttctttagattaaaccttaaaagcccccttggaggctgaagaagcagaggatagccatgcatacacttgaacgtgaaaaatggtcctctttcattggagaggtcttcctcttcagctaaaccgacagagtggtgaaaagaagaagggaccccttgttgaccaaaataatccagacaaatcaaatcggccctttccagcaaggagtggaacagcccaagggtggctagatcacatcttctgctcacaccaccactgagcaaccctctccaggactgccacctatgcataggtcatgccctgtgcaagagcacataaagtgggagctgaagtcctgcccaggctccattcaccaagcagagcttatgttgttgtgtgtctgtgtctacccagaggatgtgggtcctttttaaaatgtgcaccaatgcatcttgtatgagctggcaccagctcggaccatcccaccctcataccctggtcctatccagggttatattccctactttagaagaattaattatttttatgaacgtatttagtttattgtaaaaaatgaaatatatgacacaaattgaaattaatttcagaggtaaaggtcagaatattaccatgtatgtgaattatgtttgtatgtatatgtatatatcaagagagttatatgaatatacatttttgtgtatcagaagtgaggacaatttaactttgttaagtgtttgaaataaaattattttgagttttggaaaaaaaaaaa

SEQ ID NO: 408845 - DNA, 1146 bp, Homo sapiens
cgcgcgagcgcgtcccccgggccccggcggcctccctgctgcggcggggaggggcggctagccgcgacggcggcggacggagggggagggccgcgagccttcggaaccagcctcgagggtgctgaaccccgcgcgcccgcctcgccgcggcccccgggtgggggcgtccacggcccgggttcccggcgggcttggggcagggacgcagtccggagattccgggactgcccggctgctgcagcccgcaggctcctctctcctccccgcttcccctccgcactgcctgggctaaaggcggccaagctgaggctccgaaagaaaagggaaaattgcaacccttgcctacaaccagactgacagcataatttcttaggaatcaagaatcaatacagggttatttctttagattaaaccttaaaagcccccttggaggctgaagaagcagaggatagccatgcatacacttgaacgtgaaaaatggtcctctttcattggagaggtcttcctcttcagctaaaccgacagagtggtgaaaagaagaagggaccccttgttgaccaaaataatccagacaaatcaaatcggccctttccagcaaggagtggaacagcccaagggtggctagatcacatcttctgctcacaccaccactgagcaaccctctccaggactgccacctatgcataggtcatgccctgtgcaagagcacataaagtgggagctgaagtcctgcccaggctccattcaccaagcagagcttatgttgttgtgtgtctgtgtctacccagaggatgtgggtcctttttaaaatgtgcaccaatgcatcttgtatgagctggcaccagctcggaccatcccaccctcataccctggtcctatccagggttatattccctactttagaagaattaattatttttatgaacgtatttagtttattgtaaaaaatgaaatatatgacacaaattgaaattaatttcagaggtaaaggtcagaatattaccatgtatgtgaattatgtttgtatgtatatgtatatatcaagagagttatatgaatatacatttttgtgtatcagaagtgaggacaatttaactttgttaagtgtttgaaataaaattattttgagttttggaaaaaaaaaaa

SEQ ID NO: 408846 - DNA, 770 bp, Homo sapiens
tgctgttctagaggatcctccaacgcgctcacagataaacgttaaagcccttgcgtgctgaagaagcagaggatagccatgcatacacttgaacgtgaaaaatggtcctctttcattggagaggtcttcctcttcagctaaaccgacagagtggtgaaaagaagaagggaccccttgttgaccaaaataatccagacaaatcaaatcggccctttccagcaaggagtggaacagcccaagggtggctagatcacatcttctgctcacaccaccactgagcaaccctctccaggactgccacctatgcataggtcatgccctgtgcaagagcacataaagtgggagctgaagtcctgcccaggctccattcaccaagcagagcttatgttgttgtgtgtctgtgtctacccagaggatgtgggtcctttttaaaatgtgcaccaatgcatcttgtatgagctggcaccagctcggaccatcccaccctcataccctggtcctatccagggttatattccctactttagaagaattaattatttttatgaacgtatttagtttattgtaaaaaatgaaatatatgacacaaattgaaattaatttcagaggtaaaggtcagaatattaccatgtatgtgaattatgtttgtatgtatatgtatatatcaagagagttatatgaatatacatttttgtgtatcagaagtgaggacaatttaactttgttaagtgtttgaaataaaattattttgagttttggaaaaaaaaaaa

SEQ ID NO: 408847 - DNA, 835 bp, Homo sapiens
catgatggaaattcgcaacgatcgcactcactcatactggcattgtagattggtatacgcatcatcaggctgacaagaggatgtctttagatcacacgatacaagcgccgcatgccagggtcaagactcaaaagatagccttgctttcactagaacgcagtatgatgcgaactcttctttatgtagaggagttactctttagctatactcaagaagtggagaaccaatgattgacccctaggtgaccaaaggattgctgaccgatccaataaagacctttacagctccgtgtggaacagcccaagggtggctagatcacatcttctgctcacaccaccactgagcaaccctctccaggactgccacctatgcataggtcatgccctgtgcaagagcacataaagtgggagctgaagtcctgcccaggctccattcaccaagcagagcttatgttgttgtgtgtctgtgtctacccagaggatgtgggtcctttttaaaatgtgcaccaatgcatcttgtatgagctggcaccagctcggaccatcccaccctcataccctggtcctatccagggttatattccctactttagaagaattaattatttttatgaacgtatttagtttattgtaaaaaatgaaatatatgacacaaattgaaattaatttcagaggtaaaggtcagaatattaccatgtatgtgaattatgtttgtatgtatatgtatatatcaagagagttatatgaatatacatttttgtgtatcagaagtgaggacaatttaactttgttaagtgtttgaaataaaattattttgagttttggaaaaaaaaaaa

SEQ ID NO: 408848 - DNA, 890 bp, Homo sapiens
gatgaatctcatcaaatttaaatcacttgcacaatttcatctcattaggtagtttgagaataaggactcggatccaatctggggtgctttccactatctaaccctttcttcccaaattccagttttatattctttttccaaaataaaagtccttctaaaatcgtatttcagtagtttgagctcctactctgataaattcctgttagtagttttgaaacaggcctttcttatggcttatactaaggccacttaaaggtaaatttattttggttttaaaatactatgcatctgttataacctacgaccctaagatatagaaagtttataaaagattactgaaataagacatgcttgttatttcttgatatatggaaattagaattgatttcatatactgtttgtcctgaaagtcaataaattgggtcacttaggagatagcttgagcttattcttagtgttactgatataatttctaaacagttactaagcagtgttatacaaatggactaacttctgatttgttttttccagagggaaaattgcaacccttgcctacaaccagactgacagcataatttcttaggaatcaagaatcaatacagggttatttctttagattaaaccttaaaagcccccttggaggctgaagaagcagaggatagccatgcatacacttgaacgtgaaaaatggtcctctttcattggagaggtcttcctcttcagctaaaccgacagagtggtgaaaagaagaagggaccccttgttgaccaaaataatccagacaaatcaaatcggccctttccagcaaggagtggaacagcccaagggtggctagatcacatcttctgctcacaccaccactgagcaaccctctccaggactgccaccta

SEQ ID NO: 408849 - DNA, 422 bp, Homo sapiens
acagacaaggtggagtgaatcaaggagcatgtggaggagaaagagggaatccctccacaacagcagaggctcatctacagtggcaaacatgaatgatgagaagacagcagctgattacaagattttaggtggttcagtccttcacctggtgttggctctgagaggaggaggtggtcttaggcagtgatggaccctccattttacctccctaccctgtcgctcgtaatgaggcatcatatatcctctcactctctgggacaccagagccactgccccctcccttggatgcccagtaatgtatgtctactggtgggagactgtgaggacaccaggattcagtattcctggcccagagggcccttgctgactattggatgttagtttggagtcctgtgtgcttctctctcttatggctgtgtccc

SEQ ID NO: 408850 - DNA, 497 bp, Homo sapiens
ctccatctttaaaacctaaacaggcattttggacaacacattattgtacaccacaaatatctaacagaccataaaatacaactgttttgtaagtattttaataactttgatactgctctgcttttcttcatttttaaaaattcacttctccatttatgtattgctatatgtgttgcatgagaattctattactttctctaagacgttttactgtttttctgactcttacttcaagggaataaaacctcctctttacccgcaagaaagttttagctgaattaattaatgtatgatggagactctttttcaagtgttaaccaatatattggtgtagaagcctccagtctcttaaatttttgtttgcccagtgcttgaacagtggtatctcgtagttgcttgaattggcatttccctgcctactgaaattatcttttaatatgtttattagtaatttgtatttcctctcctatgaatttccagtttttatcctttgccct

SEQ ID NO: 408851 - DNA, 517 bp, Homo sapiens
ttcaccgctccaacacttcaacactattttgttttatttttcttattaatataagaaggcaggaatgtcaggcctctgagcccaagccaagccatcgcatcccctgtgacttgcacatatacgcccagatggcctgaagtaactgaagaatcacaaaagaagtgaaaaggccctgccctgccttaactgatgacattccaccattgtgatttgttcctgccccaccttaactgagtgattaaccctgtgaatttccttctcctggctcagaagctgccccaccttaactgagtgattaaccctgcgaatttccttctcctggctcagaagctcccccactgagcaccttgtgacccccgcccctgcccaccagagagcaaccccctttgactgtaattttccattaccttcccaaatcctataaaacggccccacccctatctcccttggctgactctctttgcggactcagcccgcctgcacccaggtgaaataaacagccatgttgctcacacaa

SEQ ID NO: 408852 - DNA, 403 bp, Homo sapiens
gtctttgggtcctgcatgctttcctttgtgttggctggttcctctggctgagttcactgttggtctgtctgtggcaattacggagaagcatgacagtcacagcttccctgagttctactgaactcatgaactttgttcataacagactctacaagtggtacaggattcctatggccacaactcaactcaactccgtagaaatcaatgtttatggatcattggagctaaaagaaaacttgcagatcagatcatctcatccaattccctgactttacagaatgaggaaactgaggcacagtaagatttttttttttattttttgcccaggtctgaataaaattgaaggcacccttaccatagccaggattctttgtatataccactggctgaccagtggtagctg

SEQ ID NO: 408853 - DNA, 2375 bp, Homo sapiens
  misc_feature (2338)..(2338): n is a, c, g, or t
accatcctcttgaaaaacccagacacagagttggctgggagctccccagccgtccccgcccccatataagaaaagcctggctagccggtttctcagggccctgggcgcccgcccaagaccctggcggaccagtatgcttgctctcattgcggagtctggtcccctcccctccgctcctagcgcgcgggaggcgggattgtgcttgcacgacttcccccggcccgcggcctgtgagcccaggtcctggggtgaaccgagcgctcgctcgttcgtcagaccgtagcgctccagcggctgtccttactgtgtagtagccaaagctgagggtgatgactgtgaaccagaacagactgcctcgctgaaaagtcacttggaactcttctgtggcatctgaagcagatggacgaagccaagagggccgagagtatctcagcacctagaaatggacaaggctggttattagaacaaagatttcgcaggtggtgagtctcaaaggcgaagctgaatgaggcaagaatctgcatcaaagagccctggaagcaatcatggctcaactgtgatgcctttagaacatgaagtcctccaagaagatgccataggaatggcctccatcccagggcctggagagcagccagagacaagaagagtagcccaggagggcactggcagtcagtgctacactgtggcctgtcagtctcagagccaggatttaatcactggatctcccattaaccagtcataatgaagtaagaacaagaagatggggaagaggaagtgtaaaaccgtggcttaaatttaccaaggataagctgagtgtacttcagcagtcatttgcacagaatccttatcctaattttacaaccagggaaaaactggctggacagtctcttgtcctgtgtttgtaattgataactggtttcaaaataaaagccagaccaccacttagagagagacacagaatgttcactgccagggaactgcatgattcctctgccaaaggccacccatttacaagaatccaggaaaaccaggtggaatctcccaatgatgaccctgagcagaacttcttgtacccaggaagttctactgggtggagctggccactcttccgtggagacacaggggactcccaattaacatgatggctcaaataactgtagccttatggattaaaaggaaactaagctgtgatttggagtatccaggtgatacagaaaatggcccttgtcgatgtagatcagcattatttccttatccttctgcatctcctcctcagtattctgaaagggacaagcctgagatgggggaaagccagcatgcaaggccctcccctttgtgctgtgttcatggtgtgcacggagagaggcagcagcaggaggaacagaaaggttattttctttactgactctttcaaggacatcagcagaatggttgggaatgtcatcatgagcagcctcagcctcagaattaccaggagaagctggtcttccaggatcaggttctaatgtatatgagtcacaggatttagggaagcaggcactttcccttcagtcccagcagcatggttgatgttcccaagtaatggagagtccctgtgctctcagttgtggcacacacctttgcaaatagtgatcagatctccacaaacgcctcttgggtaagatatgcagcaacatagctggctgcagagcaacccagttcccaaatccagcagctcttggatgagaagtctgcaagtgtttactgctgggaccaggactgtgtttctaggaaatggtgctaggcttcagagagcatcatccacaggtcatcccacaaccatccacacagaagcctgaggaaaagggctctgcagagcttgcacataaagatgctgaactcaggaaggctctgtgagctgctggtctcttctgttagggcagcagtgtcctgagaaggtggagctagagtatggagaacaaaactaacaagcaccaaggcagcaagcaaggcaacccccaaatgacagcagttgccaaatccaaagcaatctgtgcttcagaagacagaggctctgcacagtccctgtctcagacattgtctcctccttagaagatacctaacaacagcactgtgggaggctgaggtgggtggatcaccaggtcaggagatcaagaccatccttgatctttagtagagacggtgaaacactgtctctactaaaaaatacaaaaaaaaattagctagccgtggcggcgggcacctgtagtcccaactatttgggaggctgaggcaggagaatggcctgaacccgggaggcagagcttgcagtgagctgagattgcgccactgcactccngcctgggcaacagagtgagactccatctcaaaaaaaa

SEQ ID NO: 408854 - DNA, 2138 bp, Homo sapiens
  misc_feature (2101)..(2101): n is a, c, g, or t
accatcctcttgaaaaacccagacacagagttggctgggagctccccagccgtccccgcccccatataagaaaagcctggctagccggtttctcagggccctgggcgcccgcccaagaccctggcggaccagtatgcttgctctcattgcggagtctggtcccctcccctccgctcctagcgcgcgggaggcgggattgtgcttgcacgacttcccccggcccgcggcctgtgagcccaggtcctggggtgaaccgagcgctcgctcgttcgtcagaccgtagcgctccagcggctgtccttactgtgtagtagccaaagctgagggtgatgactgtgaaccagaacagactgcctcgctgaaaagtcacttggaactcttctgtggcatctgaagcagatggacgaagccaagagggccgagagtatctcagcacctagaaatggacaaggctggttattagaacaaagatttcgcaggtggatctcccattaaccagtcataatgaagtaagaacaagaagatggggaagaggaagtgtaaaaccgtggcttaaatttaccaaggataagctgagtgtacttcagcagtcatttgcacagaatccttatcctaattttacaaccagggaaaaactggctggacagtctcttgtcctgtgtttgtaattgataactggtttcaaaataaaagccagaccaccacttagagagagacacagaatgttcactgccagggaactgcatgattcctctgccaaaggccacccatttacaagaatccaggaaaaccaggtggaatctcccaatgatgaccctgagcagaacttcttgtacccaggaagttctactgggtggagctggccactcttccgtggagacacaggggactcccaattaacatgatggctcaaataactgtagccttatggattaaaaggaaactaagctgtgatttggagtatccaggtgatacagaaaatggcccttgtcgatgtagatcagcattatttccttatccttctgcatctcctcctcagtattctgaaagggacaagcctgagatgggggaaagccagcatgcaaggccctcccctttgtgctgtgttcatggtgtgcacggagagaggcagcagcaggaggaacagaaaggttattttctttactgactctttcaaggacatcagcagaatggttgggaatgtcatcatgagcagcctcagcctcagaattaccaggagaagctggtcttccaggatcaggttctaatgtatatgagtcacaggatttagggaagcaggcactttcccttcagtcccagcagcatggttgatgttcccaagtaatggagagtccctgtgctctcagttgtggcacacacctttgcaaatagtgatcagatctccacaaacgcctcttgggtaagatatgcagcaacatagctggctgcagagcaacccagttcccaaatccagcagctcttggatgagaagtctgcaagtgtttactgctgggaccaggactgtgtttctaggaaatggtgctaggcttcagagagcatcatccacaggtcatcccacaaccatccacacagaagcctgaggaaaagggctctgcagagcttgcacataaagatgctgaactcaggaaggctctgtgagctgctggtctcttctgttagggcagcagtgtcctgagaaggtggagctagagtatggagaacaaaactaacaagcaccaaggcagcaagcaaggcaacccccaaatgacagcagttgccaaatccaaagcaatctgtgcttcagaagacagaggctctgcacagtccctgtctcagacattgtctcctccttagaagatacctaacaacagcactgtgggaggctgaggtgggtggatcaccaggtcaggagatcaagaccatccttgatctttagtagagacggtgaaacactgtctctactaaaaaatacaaaaaaaaattagctagccgtggcggcgggcacctgtagtcccaactatttgggaggctgaggcaggagaatggcctgaacccgggaggcagagcttgcagtgagctgagattgcgccactgcactccngcctgggcaacagagtgagactccatctcaaaaaaaa

SEQ ID NO: 408855 - DNA, 1956 bp, Homo sapiens
  misc_feature (1919)..(1919): n is a, c, g, or t
agatttgatatttcatgaaattcagaaataatttggagcttttcaaacctgggatatggaagaaactgacactcctgttctctgggaagaggcaagaatctgcatcaaagagccctggaagcaatcatggctcaactgtgatgcctttagaacatgaagtcctccaagaagatgccataggaatggcctccatcccagggcctggagagcagccagagacaagaagagtagcccaggagggcactggcagtcagtgctacactgtggcctgtcagtctcagagccaggatttaatcactggatctcccattaaccagtcataatgaagtaagaacaagaagatggggaagaggaagtgtaaaaccgtggcttaaatttaccaaggataagctgagtgtacttcagcagtcatttgcacagaatccttatcctaattttacaaccagggaaaaactggctggacagtctcttgtcctgtgtttgtaattgataactggtttcaaaataaaagccagaccaccacttagagagagacacagaatgttcactgccagggaactgcatgattcctctgccaaaggccacccatttacaagaatccaggaaaaccaggtggaatctcccaatgatgaccctgagcagaacttcttgtacccaggaagttctactgggtggagctggccactcttccgtggagacacaggggactcccaattaacatgatggctcaaataactgtagccttatggattaaaaggaaactaagctgtgatttggagtatccaggtgatacagaaaatggcccttgtcgatgtagatcagcattatttccttatccttctgcatctcctcctcagtattctgaaagggacaagcctgagatgggggaaagccagcatgcaaggccctcccctttgtgctgtgttcatggtgtgcacggagagaggcagcagcaggaggaacagaaaggttattttctttactgactctttcaaggacatcagcagaatggttgggaatgtcatcatgagcagcctcagcctcagaattaccaggagaagctggtcttccaggatcaggttctaatgtatatgagtcacaggatttagggaagcaggcactttcccttcagtcccagcagcatggttgatgttcccaagtaatggagagtccctgtgctctcagttgtggcacacacctttgcaaatagtgatcagatctccacaaacgcctcttgggtaagatatgcagcaacatagctggctgcagagcaacccagttcccaaatccagcagctcttggatgagaagtctgcaagtgtttactgctgggaccaggactgtgtttctaggaaatggtgctaggcttcagagagcatcatccacaggtcatcccacaaccatccacacagaagcctgaggaaaagggctctgcagagcttgcacataaagatgctgaactcaggaaggctctgtgagctgctggtctcttctgttagggcagcagtgtcctgagaaggtggagctagagtatggagaacaaaactaacaagcaccaaggcagcaagcaaggcaacccccaaatgacagcagttgccaaatccaaagcaatctgtgcttcagaagacagaggctctgcacagtccctgtctcagacattgtctcctccttagaagatacctaacaacagcactgtgggaggctgaggtgggtggatcaccaggtcaggagatcaagaccatccttgatctttagtagagacggtgaaacactgtctctactaaaaaatacaaaaaaaaattagctagccgtggcggcgggcacctgtagtcccaactatttgggaggctgaggcaggagaatggcctgaacccgggaggcagagcttgcagtgagctgagattgcgccactgcactccngcctgggcaacagagtgagactccatctcaaaaaaaa

SEQ ID NO: 408856 - DNA, 514 bp, Homo sapiens
agatttgatatttcatgaaattcagaaataatttggagcttttcaaacctgggatatggaagaaactgacactcctgttctctgggaagaggcaagaatctgcatcaaagagccctggaagcaatcatggctcaactgtgatgcctttagaacatgaagtcctccaagaagatgccataggaatggcctccatcccagggcctggagagcagccagagacaagaagagtagcccaggagggcactggcagtcagtgctacactgtggcctgtcagtctcagagccaggatttaatcactggatctcccattaaccagtcataatgaagtaagaacaagaagatggggaagaggaagtgtaaaaccgtggcttaaatttaccaaggataagctgagtgtacttcagcagtcatttgcacagaatccttatcctaattttacaaccagggaaaaactggctggacagtctcttgtcctgtgtttgtaattgatgtaagtaaaatattaaaagcttt

SEQ ID NO: 408857 - DNA, 1831 bp, Homo sapiens
  misc_feature (1049)..(1049): n is a, c, g, or t
agcgggtgagtgcgggccgcgctctcggcggcgcgcatgtgcgtgtgtgctggctgccgggctgccccgagccggcggggagccggtccgctccaggtggcgggcggctggagcgagggagcggacatggactacgactcgtaccagcactatttctacgactatgactgcggggaggatttctaccgctccacggcgcccagcgaggacatctggaagaaattcgagctggtgccatcgccccccacgtcgccgccctggggcttgggtcccggcgcaggggacccggcccccgggattggtcccccggagccgtggcccggagggtgcaccggagacgaagcggaatcccggggccactcgaaaggctggggcaggaactacgcctccatcatacgccgtgactgcatgtggagcggcttctcggcccgggaacggctggagagagctgtgagcgaccggctcgctcctggcgcgccccgggggaacccgcccaaggcgtccgccgccccggactgcactcccagcctcgaagccggcaacccggcgcccgccgccccctgtccgctgggcgaacccaagacccaggcctgctccgggtccgagagcccaagcgactcgggtaaggacctccccgagccatccaagagggggccaccccatgggtggccaaagctctgcccctgcctgaggtcaggcattggctcttctcaagctcttgggccatctccgcctctctttggctgaagctgcccgtgtagtccccaaccgtgtctgtctggcacgtgggtgtgttggtaaacagtttggaaaagtggcgtgggagccagcctccctttgatgattattggagccccaggggacaagggatttgaggtgagggttggcgcttagagaggacaatactggggttggactgtaagggattgaagggggtaccttaagagacactccaaacctgaagtttttttgctgctgcctctttccctaggaaactcacactcccctagggggagaagaagccgagagccttttgtgcaaagccaaanccttcgtccttttaaaaacctaggtctccagttggctttactttaaaatgccaataataaatgccctcttctcgtgcctccccaccaccacttaccactcgtgcatccctgagacagggagggaagaatgaacactccccattaacagatggaaaaactgaggcttagagatagacaatcactacaagtcagctccagctttctgccatctagccagcccctcttccccaatgctccatcccaaccaggcacctcttccttgatgtttggggtctttgtggtagcttatcttagaagcactacaccttgccttgctgtttgtcctgagatggaaaagtgtccttcttgctccccctcaatagatctccagcgtcagctgctccctggcattcaacaaatattcactggcccctactttgtggcaatctgtgggctacatgctggggtcaaggcagtagaactccaggccctcctctcccatccttgatgcaagtgcaacctcgctgagggcagactggggcatcctgtgccactaaactacattgttcttattctggcatcttagacctccacacccgtgagaaatcctggagagggtatttttgtagagtgtagactgtggctagtgacaaataaattaggaccaagaaagctcactgtagcttttaggaataacttttacacgaccatttgatagggaactggggaatggggtatggaagttttcctacacttgagagaaaaaataggataacaaaaattaaaagtcttttttttcctgg

SEQ ID NO: 408858 - DNA, 1651 bp, Homo sapiens
agcgggtgagtgcgggccgcgctctcggcggcgcgcatgtgcgtgtgtgctggctgccgggctgccccgagccggcggggagccggtccgctccaggtggcgggcggctggagcgagggagcggacatggactacgactcgtaccagcactatttctacgactatgactgcggggaggatttctaccgctccacggcgcccagcgaggacatctggaagaaattcgagctggtgccatcgccccccacgtcgccgccctggggcttgggtcccggcgcaggggacccggcccccgggattggtcccccggagccgtggcccggagggtgcaccggagacgaagcggaatcccggggccactcgaaaggctggggcaggaactacgcctccatcatacgccgtgactgcatgtggagcggcttctcggcccgggaacggctggagagagctgtgagcgaccggctcgctcctggcgcgccccgggggaacccgcccaaggcgtccgccgccccggactgcactcccagcctcgaagccggcaacccggcgcccgccgccccctgtccgctgggcgaacccaagacccaggcctgctccgggtccgagagcccaagcgactcggagaatgaagaaattgatgttgtgacagtagagaagaggcagtctctgggtattcggaagccggtcaccatcacggtgcgagcagaccccctggatccctgcatgaagcatttccacatctccatccatcagcaacagcacaactatgctgcccgttttcctccagaaagctgctcccaagaagaggcttcagagaggggtccccaagaagaggttctggagagagatgctgcaggggaaaaggaagatgaggaggatgaagagattgtgagtcccccacctgtagaaagtgaggctgcccagtcctgccaccccaaacctgtcagttctgatactgaggatgtgaccaagaggaagaatcacaacttcctggagcgcaagaggcggaatgacctgcgttcgcgattcttggcgctgagggaccaggtgcccaccctggccagctgctccaaggcccccaaagtagtgatcctaagcaaggccttggaatacttgcaagccctggtgggggctgagaagaggatggctacagagaaaagacagctccgatgccggcagcagcagttgcagaaaagaattgcatacctcagtggctactaactgaccaaaaagcctgacagttctgtcttacgaagacacaagtttattttttaacctccctctcccctttagtaatttgcacattttggttatggtgggacagtctggacagtagatcccagaatgcattgcagccggtgcacacacaataaaggcttgcattcttggaaaccttgaaacccagctctccctcttccctgactcatgggagtgctgtatgttctctggcgcctttggcttcccagcaggcagctgactgaggagccttggggtctgcctagctcactagctctgaagaaaaggctgacagatgctatgcaacaggtggtggatgttgtcaggggctccagcctgcatgaaatctcacactctgcatgagctttaggctaggaaaggatgctcccaactggtgtctctggggtgatgcaag

SEQ ID NO: 408859 - DNA, 1947 bp, Homo sapiens
  misc_feature (1049)..(1049): n is a, c, g, or t
agcgggtgagtgcgggccgcgctctcggcggcgcgcatgtgcgtgtgtgctggctgccgggctgccccgagccggcggggagccggtccgctccaggtggcgggcggctggagcgagggagcggacatggactacgactcgtaccagcactatttctacgactatgactgcggggaggatttctaccgctccacggcgcccagcgaggacatctggaagaaattcgagctggtgccatcgccccccacgtcgccgccctggggcttgggtcccggcgcaggggacccggcccccgggattggtcccccggagccgtggcccggagggtgcaccggagacgaagcggaatcccggggccactcgaaaggctggggcaggaactacgcctccatcatacgccgtgactgcatgtggagcggcttctcggcccgggaacggctggagagagctgtgagcgaccggctcgctcctggcgcgccccgggggaacccgcccaaggcgtccgccgccccggactgcactcccagcctcgaagccggcaacccggcgcccgccgccccctgtccgctgggcgaacccaagacccaggcctgctccgggtccgagagcccaagcgactcgggtaaggacctccccgagccatccaagagggggccaccccatgggtggccaaagctctgcccctgcctgaggtcaggcattggctcttctcaagctcttgggccatctccgcctctctttggctgaagctgcccgtgtagtccccaaccgtgtctgtctggcacgtgggtgtgttggtaaacagtttggaaaagtggcgtgggagccagcctccctttgatgattattggagccccaggggacaagggatttgaggtgagggttggcgcttagagaggacaatactggggttggactgtaagggattgaagggggtaccttaagagacactccaaacctgaagtttttttgctgctgcctctttccctaggaaactcacactcccctagggggagaagaagccgagagccttttgtgcaaagccaaanccttcgtccttttaaaaacctaggtctccagttggctttactttaaaatgccaataataaatgccctcttctcgtgcctccccaccaccacttaccactcgtgcatccctgagacagggagggaagaatgaacactccccattaacagatggaaaaactgaggcttagagatagacaatcactacaagtcagctccagctttctgccatctagccagcccctcttccccaatgctccatcccaaccaggcacctcttccttgatgtttggggtctttgtggtagcttatcttagaagcactacaccttgccttgctgtttgtcctgagatggaaaagtgtccttcttgctccccctcaatagatctccagcgtcagctgctccctggcattcaacaaatattcactggcccctactttgtggcaatctgtgggctacatgctggggtcaaggcagtagaactccaggccctcctctcccatccttgatgcaagtgcaacctcgctgagggcagactggggcatcctgtgccactaaactacattgttcttattctggcatcttagacctccacacccgtgagaaatcctggagagggtatttttgtagagtgtagactgtggctagtgacaaataaattaggaccaagaaagctcactgtagcttttaggaataacttttacacgaccatttgatagggaactggggaatggggtatggaagttttcctacacttgagagaaaaaataggataacaaaaattaaaagtcttttttttcctggtccactgtgttaaggtcatttttaaccagcttgctttctacaccaagagtttatgtttgtttaatggctggaaagagaatcttgagatcaaaaaaccaataaagatgtatctctac

SEQ ID NO: 408860 - DNA, 820 bp, Homo sapiens
tggctgccgggctgccccgagccggcggggagccggtccgctccaggtggcgggcggctggagcgaggtgaggctgcgggtggccagggcacgggcgcgggtcccgcggtgcgggctggctgcaggctgccttctgggcacggcgcgcccccgcccggccccgccgggccctgggagctgcgctccgggcggcgctggcaaagtttgctttgaactcgctgcccacagtcgggtccgcgcgctgcgattggcttcccctaccactctgacccggggcccggcttcccgggacgcgaggactgggcgcaggctgcaagctggtggggttggggaggaacgagagcccggcagccgactgtgccgagggacccggggacacctccttcgcccggccggcacccggtcagcacgtccccccttccctcccgcagggagcggacatggactacgactcgtaccagcactatttctacgactatgactgcggggaggatttctaccgctccacggcgcccagcgaggacatctggaagaaattcgagctggtgccatcgccccccacgtcgccgccctggggcttgggtcccggcgcaggggacccggcccccgggattggtcccccggagccgtggcccggagggtgcaccggagacgaagcggaatcccggggccactcgaaaggctggggcaggaactacgcctccatcatacgccgtgactgcatgtggagcggcttctcggcccgggaacggctggagagagctgtgagcgaccggctcgctcctggcgcgccccgggggaacccgcccaaggcgtccgc

SEQ ID NO: 408861 - DNA, 916 bp, Homo sapiens
tccaaaatgcataagttctcgcgagacgcagtaaggcaccggctcgaactggggcgggccactgccaggaaagcaacgcccctgaatgcttatgccggtggttggtagaggaaatggaattccccagactgtacctcttgacttgctactggtacctggaagagatgtaacacctgaccatgggacatcaagtgactgtgtgaatcaaactgcccatcatgaattgttgttatttgactcatcaaactgtacaactggatgaacacaggagcagtgcactacatatgggactggaaccatgaatgagcaggtgactcagactcctatagtacctgcctctactccttcagcacttctccctcaacccacataaactgtcatcataatgagttccctctgaccagttaatggaagagaaaaaagtatggatgttatggatatcctaacatatttctggccattggacccctagaaacctgtggcaagagtcctggaagtttttcaaggttcatcttgcaccttctagcatgcatatgtcgtaccaaagcatgtagaatgctgcctacttctgctcttcagtttcatttaatataatttcattactctgataaatcagtgtgatgttctatggaataacaaaagaccgtcaaggtcccttcataccatatagagaacaggagagttgatgtagcctgagacaagacagtaaggacttactgttatccctcctatttaaacgtagtctgtttctgattctccttagaatgggggtggggggacatttccagatcaatatcagatcagtatcgtgtcaacatgggtattaatttcttccgaagaagataccacacctagaacagcaaccataattggcatccctacctaattaaagtttgcagtccactgtcattcttca

SEQ ID NO: 408862 - DNA, 991 bp, Homo sapiens
tccaaaatgcataagttctcgcgagacgcagtaaggcaccggctcgaactggggcgggccactgccaggaaagcaacgcccctgaatgcttatgccggtggttggtagaggaaatggaattccccagactggtaagagcgcgcgcagacacagccttgtctcacgcgcccaatcaggagcgtgtggtgggaggtgccaaggattaattaccagatacctttagtctagctcgagccgggattttgaggtttccggtggagcaggtgagcagtatttactcgcctgccctcctgggctggttatggtgtgggaggaggcgcccctcgagatgggaatagtagttttaaatagacccaggttggccgctcatcagcgctcccacgtgctgaagtctagtgcacgtctgaccctaagggagcaatactgagaacagcagggagcaggctgagtcaagctcaattgagtggatggggctaggacagagagagttaggggcagggttttcactggtctccgtaatcagtcgctgccgtccgccaaggtgtagatgtgggaacaagcttaaattctcaaactttagcttctgttgctgtgtttcagttcttgagccagaaagtgttgagactaattagttaattaggtagagtttagagtcagaaaaacaatacaatacttcctgaaatatccaagttgggaggtgggatttacctcagtaggattggcctgttttagtcaagggtttaaagtatggagacggcagttatgctctctagtgtatccttcaggcaaaagaaagaccttaatttttatgaggaatttaaaagtgggtaagcactgaccagcttaaggttttttaacattccttaatgaccccagttaccgaagtggagatcttcaattacttggaaaaataaacttgttttaaaaatacacttaatttgaaaactgttgcagaaagttttacctaataaaaacttaacacgtcaacaat

SEQ ID NO: 408863 - DNA, 703 bp, Homo sapiens
attttctgcatctccaggctcctctgctcacacggagccccagtggcccccatgactccttacctgatgctgtgccagccacacaagagatgtggggacaagttctacgaccccctgcagcactgttgctatgatgatgccgtcgtgcccttggccaggacccagacgtgtggaaactgcaccttcagagtctgctttgagcagtgctgcccctggaccttcatggtgaagctgataaaccagaactgcgactcagcccggacctcggatgacaggctttgtcgcagtgtcagctaatggaacatcaggggaacgatgactcctggattctccttcctgggtgggcctggagaaagaggctggtgttacctgagatctgggatgctgagtggctgtttgggggccagagaaacacacactcaactgcccacttcattctgtgacctgtctgaggcccaccctgccgctgccctgaggaggcccacaggtccccttctagaattctggacagcatgagatgcgtgtgctgatgggggcccagggactctgaaccctcctgatgacccctatggccaacatcaacccggcaccaccccaaggctggctggggaacccttcacccttctgtgagattttccatcatctcaagttctcttctatccaggagcaaagcacaggatcataataaatttatgtactttat

SEQ ID NO: 408864 - DNA, 625 bp, Homo sapiens
ccgagctcgattcccttgtctttgttctacgaccccctgcagcactgttgctatgatgatgccgtcgtgcccttggccaggacccagacgtgtggaaactgcaccttcagagtctgctttgagcagtgctgcccctggaccttcatggtgaagctgataaaccagaactgcgactcagcccggacctcggatgacaggctttgtcgcagtgtcagctaatggaacatcaggggaacgatgactcctggattctccttcctgggtgggcctggagaaagaggctggtgttacctgagatctgggatgctgagtggctgtttgggggccagagaaacacacactcaactgcccacttcattctgtgacctgtctgaggcccaccctgccgctgccctgaggaggcccacaggtccccttctagaattctggacagcatgagatgcgtgtgctgatgggggcccagggactctgaaccctcctgatgacccctatggccaacatcaacccggcaccaccccaaggctggctggggaacccttcacccttctgtgagattttccatcatctcaagttctcttctatccaggagcaaagcacaggatcataataaatttatgtactttat

SEQ ID NO: 408865 - DNA, 289 bp, Homo sapiens
gaattccggctctctggggaattccggctctctggggaggcccaccctgccgctgccctgaggaggcccacaggtccccttctagaattctggacagcatgagatgcgtgtgctgatgggggcccagggactctgaaccctcctgatgacccctatggccaacatcaacccggcaccaccccaaggctggctggggaacccttcacccttctgtgagattttccatcatctcaagttctcttctatccaggagcaaagcacaggatcataataaatttatgtactttat

SEQ ID NO: 408866 - DNA, 115 bp, Homo sapiens
cttccaggggaccccaggctgggacccacctgccactacctcctggatctcaccagctctgtctcctccagtggcccccatgactccttacctgatgctgtgccagccacacaag

SEQ ID NO: 408867 - DNA, 157 bp, Homo sapiens
ccaccacgcctgtccaatgctcatctttttttaaaaaaatagacttttcacactgtacaagaaccaacacctttgtgatttgttttctgttcctgaagcctgcctgttccattttgtttcctgagctggcattaaacattgatgtattccttaaaat

SEQ ID NO: 408868 - DNA, 373 bp, Homo sapiens
agcatcttaaatttcattttaaagttcagctaagatgttttaaaaatcatcattctagagaaaaggcttcagtggaaaaactggtgaaatctgactcagttctgtattttatttaatggtattatatcaagattaatttcttagttgtgagaactgatctatggttgcataagatgttaaaacaagaggacactgtgtatagattcattagagtattcattatgagtaactcttctgtaagaataaaattatcttttaaaaagtcacaatggaaatattcaatctttgccctagtctatttggaccttatttccaagtactaattgccttatgtcttgcttatgaaatgaagtccccaacttgtaaaccagtt

SEQ ID NO: 408869 - DNA, 635 bp, Homo sapiens
gcggccgcggcgagcggcgctgcccgggccgggcgcgcacggcgggcgccctgtgagcggccccgatgtggcaggaggcgatgcggcgccgccgctacctgcgggaccgctccgaggaggcggcgggcggcggagacgggctgccgcggtcccgggactggctctacgagtcctactactgcatgagccagcagcacccgctcatcgtcttcctgctgctcatcgtcatgggctcctgcctcgccctgctcgccgtcttcttcgcgctcgggctggaagttgaagaccatgtggcgtttctaataacagttccaactgccctggcgattttctttgcgatatttatcctggtctgcatcgagtctgtgtttaagaagctgctgcgcctcttctcgttggtgatatggatatgccttgttgccatgggatacctgttcatgtgttttggaggcaccgtctctccctgggaccaggtatcgttcttcctcttcatcatcttcgtggtgtacaccatgctgcccttcaacatgcgagacgccatcattgccagcgtcctcacctcctcctcccacaccatcgtgcttagcgtctgcctgtctgcaacaccgggaggcaaggagcacctggtctggcag

SEQ ID NO: 408870 - DNA, 699 bp, Homo sapiens
gcggccgcggcgagcggcgctgcccgggccgggcgcgcacggcgggcgccctgtgagcggccccgatgtggcaggaggcgatgcggcgccgccgctacctgcgggaccgctccgaggaggcggcgggcggcggagacgggctgccgcggtcccgggactggctctacgagtcctactactgcatgagccagcagcacccgctcatcgtcttcctgctgctcatcgtcatgggctcctgcctcgccctgctcgccgtcttcttcgcgctcgggctggtgagtggcctccccgcgggtccagcgccgcgccttccccggccctgagaggagcccggccagccgagccgcgtcccgctccgggctgcccctcggcccgcggcagcccctcggcccgcggctccctgcttctcctgctggcccgcggcccggtggactctggcaagggctgcgggcgggagaaaagtttcctgggaaggctcttcccaaaataaagttcccgaggtgttcaccaggtggacgggcagggcgtgtgctttttgcatctttgcgcacccgctggcaaactctgcgctttccgccgggcaccgctgcccgcagcgctcgaataggtcttccccgactcagccctgggcttcctgggcgagtcgctgtctcctgcccggttccactggcatggccccacagttggcattttagttgg

SEQ ID NO: 408871 - DNA, 532 bp, Homo sapiens
tgtacagcctgcaaaaccatgagccaattaaacttctttcctttataaactacccagcctcaggtatttctctacagtaatgcaaacaatggcctaatacaccgaccttcccctgaagcaggtcataagacagacccttcttatgagagaagccttatgagcctgattactcttcatctcatttggttcttctttctcctcagcaatgatccttaactgaaaataacttcttgtgagaggttccttccccacaccaagaggaaaggaacattcctatctctgaaaacaagtcacagagaagaatctgaacaaacagtccttgctaagtttctcccagtttgttaccatttaatcatacaatttcccccatcatatttctccatgactgtttactcttcaccgaacctggcataaaaatacacaggaagctgtggcaggaggatcacttgagcccaggagttggagattgcaatgagttatgattgcaccattgcattccagccggggtgacagagcaagaccttgtctctta

SEQ ID NO: 408872 - DNA, 507 bp, Homo sapiens
atccctcataaatgttgtgcggttaatactcccactggcatgtgatcgtacccgtctccatagtaattgcatctaagaactgaggctacataggaaaaaatcttaaggtccatggttgttaggtatcagatgccctataatggatgaatatttaagtaaataatggcacattgacttgctgtctgacacaactgctgaaaatgttggtgaaaagtgagtctcgaagtggtagctcacacttgtaataccagcactttcggaggctgagacggggatcgctcgaggccaggagttcaagagcagcctgggcaacataacgagacccccatctctaccaaaaatttaaaaattagccgggcatggtggcgcaagcctgttgtcccagttactcctgagactaaggcaagaggatcccttgagtccaggagttcaaggctgcagtgagctatgattgagccactgcactccagcctgggtgacagagcaagactcttatctacctgtggg

SEQ ID NO: 408873 - DNA, 1346 bp, Homo sapiens
gagcaagtaggctctattaaggagagatatgaccacaggctcatgttgaaacatctccctccagaattcagcatctttctagaccatatctcttctttggattattttacaaaaccagactaccagcttcttacatccgtgtttgacaatagcatcaagacttttggagtaattgagagtgacccttttgactgggagaagactggaaatgatggctccctaacaaccaccactacttctaccacccctcagttgcacactcgcttgacccctgctgcaattggaattgccaatgctactcccatccctggagacttgcttcgagaaaatacagatgaggtatttccagatgaacagcttagcgatggagaaaatggcatccctgttggtgtgtcaccagataaattgcctggatctctgggacacccccgtccccaggagaaggatgtttgggaagagatggatgccaacaaaaacaagataaagcttggaatttgtaaggctgctactgaagaggagaacagccatggccaggcaaatggtcttctcaatgctccaagccttgggtcaccaattcgtgtccgctcagagattactcagccagacagagatattccactggtgcgaaagttacgttccattcacagctttgagctggaaaaacgtctgaccctggagccaaagccagacactgacaagttccttgagacctggtataaaatagtgtatttttctttttaaagcttctaaggtaccattattattgttgtcattgttgttattattattgtatatttctgttacataaagtctttcaaataagaaatccttgcatttttgtaacactgagtctattcagctccaattttcatccatgtttttaattattattatcctgattcttaattattataaattctatagcatatcctttggctttggaagctgagcagtaagagctgatgacttcctaacactaggtacaagttaaatgaacatttttacagtaactttgtttagaaagtaatctcttccacacaacagtgtagtgctggagagggcatgataaagatggcattaggcagagatgaggggaatacataaaggaggggaaaaagtaattcatacacaagggacggtgagttcaattcactttagtgaagaccctctaggagtaagatactgtgggaaaacagataccaataagtatatcatgcttgccctcgagagtttgcaatctacctagagagaaaggaaggtgaaacttgagagatctatatacataggtaaagattgtagtgcatggttttgaggcacattatccctacaacaaattttgataacag

SEQ ID NO: 408874 - DNA, 929 bp, Homo sapiens
atattattttgaaaggcttcaatgattcctctcatgtgtgttgcctagaatgtttttcatgattttattttatattttggataggctgctactgaagaggagaacagccatggccaggcaaatggtcttctcaatgctccaagccttgggtcaccaattcgtgtccgctcagagattactcagccagacagagatattccactggtgcgaaagttacgttccattcacagctttgagctggaaaaacgtctgaccctggagccaaagccagacactgacaagttccttgagacctggtataaaatagtgtatttttctttttaaagcttctaaggtaccattattattgttgtcattgttgttattattattgtatatttctgttacataaagtctttcaaataagaaatccttgcatttttgtaacactgagtctattcagctccaattttcatccatgtttttaattattattatcctgattcttaattattataaattctatagcatatcctttggctttggaagctgagcagtaagagctgatgacttcctaacactaggtacaagttaaatgaacatttttacagtaactttgtttagaaagtaatctcttccacacaacagtgtagtgctggagagggcatgataaagatggcattaggcagagatgaggggaatacataaaggaggggaaaaagtaattcatacacaagggacggtgagttcaattcactttagtgaagaccctctaggagtaagatactgtgggaaaacagataccaataagtatatcatgcttgccctcgagagtttgcaatctacctagagagaaaggaaggtgaaacttgagagatctatatacataggtaaagattgtagtgcatggttttgaggcacattatccctacaacaaattttgataacag

SEQ ID NO: 408875 - DNA, 487 bp, Homo sapiens
ggaatggtaattgaatattagcattcatttaaagtcaccaactgcattgacctctaacaagaaagccagcccaggctgggaaaagtggcttacacctgtaattccagtgctttgggaggctgaggttggaggatcacttgaggtcaagagttcaagaccagccagcacaacagagcgtgacgctgtctctacaaagtaaagagtcagcccgtcctttgaatctttgaagtcagatattagcttacctagagctgtgaaagtcctaaatggcatctcctgaagtaaggctgttttgtctctgttaaaactctagtagagctacctctgccatttatctagatattctggaaatgcttgctgcagattccacatcagcaattgctacttcactttgtacttttatgttatggaaatgacttgttaaacctcacgaactgatctttgccagcttccagcatttcttctgcagctaactcacctctcagcc

SEQ ID NO: 408876 - DNA, 325 bp, Homo sapiens
gaatgagatgatagagagtggaaaggggttcagagaaattctgattgaagtgtgaagttggggtccctctgatagtgtgatatttgacctgaaacctgaaaaacaagaagtagttataaaaaaagagcctgagggccgggcgcggtggctcacgactgtaatcccagcactttaagaggccgaggctggcggtttcaccatgttggccaggctggtctcttaactccttacctcaaatgatccacccacctcggcctcccaaagtgctgggattatagatgtgagccactgcacccagcccttcctctccctttctctttggggt

SEQ ID NO: 408877 - DNA, 1109 bp, Homo sapiens
ccacaagctggccccttggcctcctagagaccctgacatctcctccagcagcatctgtcctctctcctcagggaggcaagcatttgatgctcgaggtccctggcagttgtggtccttggcaagtgatgtgtgagtcccgtgtgtcataggaagctccccatccccatctggtgaccaaaggcctggctacaagtagtgagtccttcctcctccacccagacctcactgctcagatccccttcgccaactgggacatcttccgacatggcctggatgctgttgctcatcttgatcatggtccatccaggatcctgtgctctctgggtgtcccagccccctgagattcgtaccctggaaggatcctctgccttcctgccctgctccttcaatgccagccaagggagactggccattggctccgtcacgtggttccgagatgaggtggttccagggaaggaggtgaggaatggaaccccagagttcaggggccgcctggccccacttgcttcttcccgtttcctccatgaccaccaggctgagctgcacatccgggacgtgcgaggccatgacgccagcatctacgtgtgcagagtggaggtgctgggccttggtgtcgggacagggaatgggactcggctggtggtggagaaagaacatcctcagctaggggctggtacagtcctcctccttcgggctggattctatgctgtcagctttctctctgtggccgtgggcagcaccgtctattaccagggcaaatatgccaaatctactctctccggattcccccaactctgaactttcccttccaccaggtctgacctggaaaggtccaagaaggcagctgccggctgtggtcccagcgcccctcccaccaccatgtgggagctcagcacatctgcttcccccagtcccaggaggctgagcctgattgtcctgagaaatgggaaggatcagatatgactcctccttggcaactgccctttcctgccaggcccacacataccctcttctggctgttaggggagcttgggtccctgaacactgtcattcacccaataaattactatttgaccccagagtgggtggaagggtgagccatgtgtttt

SEQ ID NO: 408878 - DNA, 875 bp, Homo sapiens
ccacaagctggccccttggcctcctagagaccctgacatctcctccagcagcatctgtcctctctcctcagggaggcaagcatttgatgctcgaggtccctggcagttgtggtccttggcaagtgatgtgtgagtcccgtgtgtcataggaagctccccatccccatctggtgaccaaaggcctggctacaagtagtgagtccttcctcctccacccagacctcactgctcagatccccttcgccaactgggacatcttccgacatggcctggatgctgttgctcatcttgatcatggtccatccaggatcctgtgctctctgggtgtcccagccccctgagattcgtaccctggaaggatcctctgccttcctgccctgctccttcaatgccagccaagggagactggccattggctccgtcacgtggttccgagatgaggtggttccagggaaggaggtgaggaatggaaccccagagttcaggggccgcctggccccacttgcttcttcccgtttcctccatgaccaccaggctgagctgcacatccgggacgtgcgaggccatgacgccagcatctacgtgtgcagagtggaggtgctgggccttggtgtcgggacagggaatgggactcggctggtggtggagaaagaacatcctcagctaggggctggtacagtcctcctccttcgggctggattctatgctgtcagctttctctctgtggccgtgggcagcaccgtctattaccagggcaaatgccactgtcacatgggaacacactgccactcctcagatgggccccgaggagtgattccagagcccagatgtccctagtcctcttcaaaagaccccaataaatctgccccaccact

SEQ ID NO: 408879 - DNA, 1054 bp, Homo sapiens
ccacaagctggccccttggcctcctagagaccctgacatctcctccagcagcatctgtcctctctcctcagggaggcaagcatttgatgctcgaggtccctggcagttgtggtccttggcaagtgatgtgtgagtcccgtgtgtcataggaagctccccatccccatctggtgaccaaaggcctggctacaagtagtgagtccttcctcctccacccagacctcactgctcagatccccttcgccaactgggacatcttccgacatggcctggatgctgttgctcatcttgatcatggtccatccaggatcctgtgctctctgggtgtcccagccccctgagattcgtaccctggaaggatcctctgccttcctgccctgctccttcaatgccagccaagggagactggccattggctccgtcacgtggttccgagatgaggtggttccagggaaggaggtgaggaatggaaccccagagttcaggggccgcctggccccacttgcttcttcccgtttcctccatgaccaccaggctgagctgcacatccgggacgtgcgaggccatgacgccagcatctacgtgtgcagagtggaggtgctgggccttggtgtcgggacagggaatgggactcggctggtggtggagaaagaacatcctcagctaggggctggtacagtcctcctccttcgggctggattctatgctgtcagctttctctctgtggccgtgggcagcaccgtctattaccagggcaaatgtctgacctggaaaggtccaagaaggcagctgccggctgtggtcccagcgcccctcccaccaccatgtgggagctcagcacatctgcttcccccagtcccaggaggctgagcctgattgtcctgagaaatgggaaggatcagatatgactcctccttggcaactgccctttcctgccaggcccacacataccctcttctggctgttaggggagcttgggtccctgaacactgtcattcacccaataaattactatttgaccccagagtgggtggaagggtgagccatgtgtttt

SEQ ID NO: 408880 - DNA, 940 bp, Homo sapiens
ccacaagctggccccttggcctcctagagaccctgacatctcctccagcagcatctgtcctctctcctcagggaggcaagcatttgatgctcgaggtccctggcagttgtggtccttggcaagtgatgtgatcctgtgctctctgggtgtcccagccccctgagattcgtaccctggaaggatcctctgccttcctgccctgctccttcaatgccagccaagggagactggccattggctccgtcacgtggttccgagatgaggtggttccagggaaggaggtgaggaatggaaccccagagttcaggggccgcctggccccacttgcttcttcccgtttcctccatgaccaccaggctgagctgcacatccgggacgtgcgaggccatgacgccagcatctacgtgtgcagagtggaggtgctgggccttggtgtcgggacagggaatgggactcggctggtggtggagaaagaacatcctcagctaggggctggtacagtcctcctccttcgggctggattctatgctgtcagctttctctctgtggccgtgggcagcaccgtctattaccagggcaaatatgccaaatctactctctccggattcccccaactctgaactttcccttccaccaggtctgacctggaaaggtccaagaaggcagctgccggctgtggtcccagcgcccctcccaccaccatgtgggagctcagcacatctgcttcccccagtcccaggaggctgagcctgattgtcctgagaaatgggaaggatcagatatgactcctggaatgccttctgcaggccaaatacctcttctgttgtaaggagttggggctggaacatggattcaccaatattctattgaccgatgggggggggggaaacaaaacaacaaaacccggcttctggggggcaacagaaaggcggaacggtgc

SEQ ID NO: 408881 - DNA, 3034 bp, Homo sapiens
  misc_feature (570)..(571): n is a, c, g, or t
aattgagatggtttactgtaaaattaaaatgggagttagttttctagacatgtaactctctggggagtataaaactggtcacaatgggctttgcgttgaagtatctgtccctcagatctcatcagaaggagtatataatacaaaaatataaattcaacctctgtatgttttcttctatgttttatgctgggactcactggagatctttgtaagtaatcaaagctggccctttatctttgattttggcttttagggaattctagggacttcctttccccaaattaaaactcattttgaggtgtttggttttgtcttttaatttttgcaacttcaaaattgatgactcagttctagtgtactttatcctcgaacttgtttaaaataggttactttcttgaaataaataataatataatgaagagatcatgacttggatttgggtgggggaattaaataccttttcaaaattgccatcagtatcatcttggatgaagaaagttcagtggttaaaagcgtcttctgaagtgtggtcatagtcggtgaggtttatttcagtttggcttctcattnnaattttcagatgtatatcacatatatgtgaaaagtactgacaaaaataatttatgaaataaacacagtagggcatgaggttgtgttatttgtgaggcagcaatggagcatgacttgtagtcaacaaacatgggtgtcctgatcaaagctctgctgtgctattcggcaagactctatgtggatgcctcttgtagaatgtggttaataataccagccgatctcatagggcactgtgcagactcagcattatggtgcacagctccttgaactcataggagtggcacttaactggagctttgtgtcgtactcatcaaacatcttcccccagacaatgattcttctgattctgctaactctggacagagtttgcattgtcttttgagaaaaatgaatttatcacttagtcaaaaaactgtaaaaatacataggctctttccgatgcttgctttctcagagccctatgagtttgtctctctggaatggctgcaaaagtggttggatgaatcaacacctaccaaacctattgataatcacgcttgcctgtgttcccatgacaagcttcacccggataaaatatcaattatgaagaggatatctgaatatgcagctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcgatggattttgggtggggaagtcctccttgcggagttggcgccagctagctcttgaacagctggatgagcaagatggtgatgcagaacaaagcaacggaaagatgaacggtagcaccttaaataaagatgaatcaaaggaagaaagaaaagaagaggaggaattaaattttaatgaagatattctgtgtccacatggtgagttatgcatatctgaaaatgaaagaaggcttgtttctaaagaggcttggagcaaactgcagcagtactttccaaaggctcctgagtttccaagttacaaagagtgctgttcacagtgcaagattttagaaagagaaggggaagaaaatgaagccttacataagatgattgcaaacgagcaaaagacttctctcccaaatttgttccaggataaaaacagaccgtgtctcagtaactggccagaggatacggatgtcctctacatcgtgtctcagttctttgtagaagagtggcggaaatttgttagaaagcctacaagatgcagccctgtgtcatcagttgggaacagtgctcttttgtgtccccacgggggcctcatgtttacatttgcttccatgaccaaagaagattctaaacttatagctctcatatggcccagtgagtggcaaatgatacaaaagctctttgttgtggatcatgtaattaaaatcacgagaattgaagtgggagatgtaaacccttcagaaacacagtatatttctgagcccaaactctgtccagaatgcagagaaggcttattgtgtcagcagcagagggacctgcgtgaatacactcaagccaccatctatgtccataaagttgtggataataaaaaggtgatgaaggattcggctccggaactgaatgtgagtagttctgaaacagaggaggacaaggaagaagctaaaccagatggagaaaaagatccagattttaatcaaatcatgcatgcattttcagttgctccttttgaccagaatttgtcaattgatggaaagattttaagtgatgactgtgccaccctaggcacccttggcgtcattcctgaatctgtcattttattgaaggctgatgaaccaattgcagattatgctgcaatggatgatgtcatgcaagtttgtatgccagaagaagggtttaaaggtactggtcttcttggacattaatctttgaatacttgctgactgctaagaaatgaccagaggggaagaggagtttgacatgttagggcattaaagcaaaggtggatttaagaattaaaccattacatgccccttccaaaaggcagaaatccattcaaacgtgactgtcccaaatgccttatgtcaaataaagcagattgcactgatggacatcagacttgaaggaaatgtttccaattttatatttaaggggggtggtgggtgggagggggcaagtaaagacggaacaagtttagtagcagtaatagtaaatcatgtttacatatgagatttatagtcgtgggaggggaataaagttctgttatatttccttgctcgagtttcataccagatgcgttggtccataaaggattgtatcaagtagatgggacaacattctgctctgaacgaaaagtaattttagagacataacctgcttaccaatgcctgtctttgattcatattctactttcaataaagcatgaaagtgaagaac

SEQ ID NO: 408882 - DNA, 198 bp, Homo sapiens
gcggccgcctactactactatggggctgtgagaagacgacagaggggaagaggagtttgacatgttagggcattaaagcaaaggtggatttaagaattaaaccattacatgccccttccaaaaggcagaaatccattcaaacgtgactgtcccaaatgccttatgtcaaataaagcagattgcactgatggacatcag

SEQ ID NO: 408883 - DNA, 116 bp, Homo sapiens
tcaagcttctaacgatgtacggggacatgccccttccaaaaggcagaaatccattcaaacgtgactgtcccaaatgccttatgtcaaataaagcagattgcactgatggacatcag

SEQ ID NO: 408884 - DNA, 3798 bp, Homo sapiens
  misc_feature (570)..(571): n is a, c, g, or t
aattgagatggtttactgtaaaattaaaatgggagttagttttctagacatgtaactctctggggagtataaaactggtcacaatgggctttgcgttgaagtatctgtccctcagatctcatcagaaggagtatataatacaaaaatataaattcaacctctgtatgttttcttctatgttttatgctgggactcactggagatctttgtaagtaatcaaagctggccctttatctttgattttggcttttagggaattctagggacttcctttccccaaattaaaactcattttgaggtgtttggttttgtcttttaatttttgcaacttcaaaattgatgactcagttctagtgtactttatcctcgaacttgtttaaaataggttactttcttgaaataaataataatataatgaagagatcatgacttggatttgggtgggggaattaaataccttttcaaaattgccatcagtatcatcttggatgaagaaagttcagtggttaaaagcgtcttctgaagtgtggtcatagtcggtgaggtttatttcagtttggcttctcattnnaattttcagatgtatatcacatatatgtgaaaagtactgacaaaaataatttatgaaataaacacagtagggcatgaggttgtgttatttgtgaggcagcaatggagcatgacttgtagtcaacaaacatgggtgtcctgatcaaagctctgctgtgctattcggcaagactctatgtggatgcctcttgtagaatgtggttaataataccagccgatctcatagggcactgtgcagactcagcattatggtgcacagctccttgaactcataggagtggcacttaactggagctttgtgtcgtactcatcaaacatcttcccccagacaatgattcttctgattctgctaactctggacagagtttgcattgtcttttgagaaaaatgaatttatcacttagtcaaaaaactgtaaaaatacataggctctttccgatgcttgctttctcagagccctatgagtttgtctctctggaatggctgcaaaagtggttggatgaatcaacacctaccaaacctattgataatcacgcttgcctgtgttcccatgacaagcttcacccggataaaatatcaattatgaagaggatatctgaatatgcagctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcgatggattttgggtggggaagtcctccttgcggagttggcgccagctagctcttgaacagctggatgagcaagatggtgatgcagaacaaagcaacggaaagatgaacggtagcaccttaaataaagatgaatcaaaggaagaaagaaaagaagaggaggaattaaattttaatgaagatattctgtgtccacatggtgagttatgcatatctgaaaatgaaagaaggcttgtttctaaagaggcttggagcaaactgcagcagtactttccaaaggctcctgagtttccaagttacaaagagtgctgttcacagtgcaagattttagaaagagaaggggaagaaaatgaagccttacataagatgattgcaaacgagcaaaagacttctctcccaaatttgttccaggataaaaacagaccgtgtctcagtaactggccagaggatacggatgtcctctacatcgtgtctcagttctttgtagaagagtggcggaaatttgttagaaagcctacaagatgcagccctgtgtcatcagttgggaacagtgctcttttgtgtccccacgggggcctcatgtttacatttgcttccatgaccaaagaagattctaaacttatagctctcatatggcccagtgagtggcaaatgatacaaaagctctttgttgtggatcatgtaattaaaatcacgagaattgaagtgggagatgtaaacccttcagaaacacagtatatttctgagcccaaactctgtccagaatgcagagaaggcttattgtgtcagcagcagagggacctgcgtgaatacactcaagccaccatctatgtccataaagttgtggataataaaaaggtgatgaaggattcggctccggaactgaatgtgagtagttctgaaacagaggaggacaaggaagaagctaaaccagatggagaaaaagatccagattttaatcaaagcaatggtggaacaaagcggcaaaagatatcccatcaaaattatatagcctatcaaaagcaagttattcgccgaagtatgcgacatagaaaagttcgtggtgagaaagcacttctcgtttctgctaatcagacgttaaaagaattgaaaattcagatcatgcatgcattttcagttgctccttttgaccagaatttgtcaattgatggaaagattttaagtgatgactgtgccaccctaggcacccttggcgtcattcctgaatctgtcattttattgaaggctgatgaaccaattgcagattatgctgcaatggatgatgtcatgcaagtttgtatgccagaagaagggtttaaaggtactggtcttcttggacattaatctttgaatacttgctgactgctaagaaatgaccagaggggaagaggagtttgacatgttagggcattaaagcaaaggtggatttaagaattaaaccattacatgccccttccaaaaggcagaaatccattcaaacgtgactgtcccaaatgccttatgtcaaataaagcagattgcactgatggacatcagacttgaaggaaatgtttccaattttatatttaaggggggtggtgggtgggagggggcaagtaaagacggaacaagtttagtagcagtaatagtaaatcatgtttacatatgagatttatagtcgtgggaggggaataaagttctgttatatttccttgctcgagtttcataccagatgcgttggtccataaaggattgtatcaagtagatgggacaacattctgctctgaacgaaaagtaattttagagacataacctgcttaccaatgcctgtctttgattcatattctactttcaataaagcatgaaagtgaagaacttgtcctaagtgtggaaaagtgtcttcagatttagactcttctccatgtcagctgcagcgccacccgccttacacctgcccggccgtctgtctcttggtattgggtaaaggagggggcacctgcatgtctcctgcaatgagcaaggaattatgtctcatgttttgacttcagaggctttttgctttggtgcatttcagaaaggatggagaacatttattatgtgtgaaagcatcctcttccggttttgctgttattcaaaagtgggaaatgtacctggcacgtttgaaaataaaaaatctgactacctatcagaagagtaaatcagactgaagtacatttggataacacaaggtttctataaaatttgttcttcctgtcctccatgtcactgtttcttggacctcagttctctttttgaaagcattattccaaaatgccctgagagggtctcttagatcattgtttaaaaaaggaaaaaagtatatggatgtgctgtccatccaactcaggattatcattcttagcaacacgtaaccgaagcaatattcttaagaatattgaaggggtttttttaattgaacttaagactggagtttttcctttgaaa

SEQ ID NO: 408885 - DNA, 2871 bp, Homo sapiens
  misc_feature (570)..(571): n is a, c, g, or t
aattgagatggtttactgtaaaattaaaatgggagttagttttctagacatgtaactctctggggagtataaaactggtcacaatgggctttgcgttgaagtatctgtccctcagatctcatcagaaggagtatataatacaaaaatataaattcaacctctgtatgttttcttctatgttttatgctgggactcactggagatctttgtaagtaatcaaagctggccctttatctttgattttggcttttagggaattctagggacttcctttccccaaattaaaactcattttgaggtgtttggttttgtcttttaatttttgcaacttcaaaattgatgactcagttctagtgtactttatcctcgaacttgtttaaaataggttactttcttgaaataaataataatataatgaagagatcatgacttggatttgggtgggggaattaaataccttttcaaaattgccatcagtatcatcttggatgaagaaagttcagtggttaaaagcgtcttctgaagtgtggtcatagtcggtgaggtttatttcagtttggcttctcattnnaattttcagatgtatatcacatatatgtgaaaagtactgacaaaaataatttatgaaataaacacagtagggcatgaggttgtgttatttgtgaggcagcaatggagcatgacttgtagtcaacaaacatgggtgtcctgatcaaagctctgctgtgctattcggcaagactctatgtggatgcctcttgtagaatgtggttaataataccagccgatctcatagggcactgtgcagactcagcattatggtgcacagctccttgaactcataggagtggcacttaactggagctttgtgtcgtactcatcaaacatcttcccccagacaatgattcttctgattctgctaactctggacagagtttgcattgtcttttgagaaaaatgaatttatcacttagtcaaaaaactgtaaaaatacataggctctttccgatgcttgctttctcagagccctatgagtttgtctctctggaatggctgcaaaagtggttggatgaatcaacacctaccaaacctattgataatcacgcttgcctgtgttcccatgacaagcttcacccggataaaatatcaattatgaagaggatatctgaatatgcagctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcgatggattttgggtggggaagtcctccttgcggagttggcgccagctagctcttgaacagctggatgagcaagatggtgatgcagaacaaagcaacggaaagatgaacggtagcaccttaaataaagatgaatcaaaggaagaaagaaaagaagaggaggaattaaattttaatgaagatattctgtgtccacatggtgagttatgcatatctgaaaatgaaagaaggcttgtttctaaagaggcttggagcaaactgcagcagtactttccaaaggctcctgagtttccaagttacaaagagtgctgttcacagtgcaagattttagaaagagaaggggaagaaaatgaagccttacataagatgattgcaaacgagcaaaagacttctctcccaaatttgttccaggataaaaacagaccgtgtctcagtaactggccagaggatacggatgtcctctacatcgtgtctcagttctttgtagaagagtggcggaaatttgttagaaagcctacaagatgcagccctgtgtcatcagttgggaacagtgctcttttgtgtccccacgggggcctcatgtttacatttgcttccatgaccaaagaagattctaaacttatagctctcatatggcccagtgagtggcaaatgatacaaaagctctttgttgtggatcatgtaattaaaatcacgagaattgaagtgggagatgtaaacccttcagaaacacagtatatttctgagcccaaactctgtccagaatgcagagaaggcttattgtgtcagcagcagagggacctgcgtgaatacactcaagccaccatctatgtccataaagttgtggataataaaaaggtgatgaaggattcggctccggaactgaatgtgagtagttctgaaacagaggaggacaaggaagaagctaaaccagatggagaaaaagatccagattttaatcaaagcaatggtggaacaaagcggcaaaagatatcccatcaaaattatatagcctatcaaaagcaagttattcgccgaagtatgcgacatagaaaagttcgtggtgagaaagcacttctcgtttctgctaatcagacgttaaaagaattgaaaattcagatcatgcatgcattttcagttgctccttttgaccagaatttgtcaattgatggaaagattttaagtgatgactgtgccaccctaggcacccttggcgtcattcctgaatctgtcattttattgaaggctgatgaaccaattgcagattatgctgcaatggatgatgtcatgcaagtttgtatgccagaagaagggtttaaaggtactggtcttcttggacattaatctttgaatacttgctgactgctaagaaatgaccagaggggaagaggagtttgacatgttagggcattaaagcaaaggtggatttaagaattaaaccattacatgccccttccaaaaggcagaaatccattcaaacgtgactgtcccaaatgccttatgtcaaataaagcagattgcactgatggacatcag

SEQ ID NO: 408886 - DNA, 2362 bp, Homo sapiens
gtgatctagaggatcccactgtaataaagatgaatcaaaggaagaaagaaaagaagaggaggaattaaattttaatgaagatattctgtgtccacatggtgagttatgcatatctgaaaatgaaagaaggcttgtttctaaagaggcttggagcaaactgcagcagtactttccaaaggctcctgagtttccaagttacaaagagtgctgttcacagtgcaagattttagaaagagaaggggaagaaaatgaagccttacataagatgattgcaaacgagcaaaagacttctctcccaaatttgttccaggataaaaacagaccgtgtctcagtaactggccagaggatacggatgtcctctacatcgtgtctcagttctttgtagaagagtggcggaaatttgttagaaagcctacaagatgcagccctgtgtcatcagttgggaacagtgctcttttgtgtccccacgggggcctcatgtttacatttgcttccatgaccaaagaagattctaaacttatagctctcatatggcccagtgagtggcaaatgatacaaaagctctttgttgtggatcatgtaattaaaatcacgagaattgaagtgggagatgtaaacccttcagaaacacagtatatttctgagcccaaactctgtccagaatgcagagaaggcttattgtgtcagcagcagagggacctgcgtgaatacactcaagccaccatctatgtccataaagttgtggataataaaaaggtgatgaaggattcggctccggaactgaatgtgagtagttctgaaacagaggaggacaaggaagaagctaaaccagatggagaaaaagatccagattttaatcaaagcaatggtggaacaaagcggcaaaagatatcccatcaaaattatatagcctatcaaaagcaagttattcgccgaagtatgcgacatagaaaagttcgtggtgagaaagcacttctcgtttctgctaatcagacgttaaaagaattgaaaattcagatcatgcatgcattttcagttgctccttttgaccagaatttgtcaattgatggaaagattttaagtgatgactgtgccaccctaggcacccttggcgtcattcctgaatctgtcattttattgaaggctgatgaaccaattgcagattatgctgcaatggatgatgtcatgcaagtttgtatgccagaagaagggtttaaaggtactggtcttcttggacattaatctttgaatacttgctgactgctaagaaatgaccagaggggaagaggagtttgacatgttagggcattaaagcaaaggtggatttaagaattaaaccattacatgccccttccaaaaggcagaaatccattcaaacgtgactgtcccaaatgccttatgtcaaataaagcagattgcactgatggacatcagacttgaaggaaatgtttccaattttatatttaaggggggtggtgggtgggagggggcaagtaaagacggaacaagtttagtagcagtaatagtaaatcatgtttacatatgagatttatagtcgtgggaggggaataaagttctgttatatttccttgctcgagtttcataccagatgcgttggtccataaaggattgtatcaagtagatgggacaacattctgctctgaacgaaaagtaattttagagacataacctgcttaccaatgcctgtctttgattcatattctactttcaataaagcatgaaagtgaagaacttgtcctaagtgtggaaaagtgtcttcagatttagactcttctccatgtcagctgcagcgccacccgccttacacctgcccggccgtctgtctcttggtattgggtaaaggagggggcacctgcatgtctcctgcaatgagcaaggaattatgtctcatgttttgacttcagaggctttttgctttggtgcatttcagaaaggatggagaacatttattatgtgtgaaagcatcctcttccggttttgctgttattcaaaagtgggaaatgtacctggcacgtttgaaaataaaaaatctgactacctatcagaagagtaaatcagactgaagtacatttggataacacaaggtttctataaaatttgttcttcctgtcctccatgtcactgtttcttggacctcagttctctttttgaaagcattattccaaaatgccctgagagggtctcttagatcattgtttaaaaaaggaaaaaagtatatggatgtgctgtccatccaactcaggattatcattcttagcaacacgtaaccgaagcaatattcttaagaatattgaaggggtttttttaattgaacttaagactggagtttttcctttgaaa

SEQ ID NO: 408887 - DNA, 2715 bp, Homo sapiens
  misc_feature (570)..(571): n is a, c, g, or t
aattgagatggtttactgtaaaattaaaatgggagttagttttctagacatgtaactctctggggagtataaaactggtcacaatgggctttgcgttgaagtatctgtccctcagatctcatcagaaggagtatataatacaaaaatataaattcaacctctgtatgttttcttctatgttttatgctgggactcactggagatctttgtaagtaatcaaagctggccctttatctttgattttggcttttagggaattctagggacttcctttccccaaattaaaactcattttgaggtgtttggttttgtcttttaatttttgcaacttcaaaattgatgactcagttctagtgtactttatcctcgaacttgtttaaaataggttactttcttgaaataaataataatataatgaagagatcatgacttggatttgggtgggggaattaaataccttttcaaaattgccatcagtatcatcttggatgaagaaagttcagtggttaaaagcgtcttctgaagtgtggtcatagtcggtgaggtttatttcagtttggcttctcattnnaattttcagatgtatatcacatatatgtgaaaagtactgacaaaaataatttatgaaataaacacagtagggcatgaggttgtgttatttgtgaggcagcaatggagcatgacttgtagtcaacaaacatgggtgtcctgatcaaagctctgctgtgctattcggcaagactctatgtggatgcctcttgtagaatgtggttaataataccagccgatctcatagggcactgtgcagactcagcattatggtgcacagctccttgaactcataggagtggcacttaactggagctttgtgtcgtactcatcaaacatcttcccccagacaatgattcttctgattctgctaactctggacagagtttgcattgtcttttgagaaaaatgaatttatcacttagtcaaaaaactgtaaaaatacataggctctttccgatgcttgctttctcagagccctatgagtttgtctctctggaatggctgcaaaagtggttggatgaatcaacacctaccaaacctattgataatcacgcttgcctgtgttcccatgacaagcttcacccggataaaatatcaattatgaagaggatatctgaatatgcagctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcgatggattttgggtggggaagtcctccttgcggagttggcgccagctagctcttgaacagctggatgagcaagatggtgatgcagaacaaagcaacggaaagatgaacggtagcaccttaaataaagatgaatcaaaggaagaaagaaaagaagaggaggaattaaattttaatgaagatattctgtgtccacatggtgagttatgcatatctgaaaatgaaagaaggcttgtttctaaagaggcttggagcaaactgcagcagtactttccaaaggctcctgagtttccaagttacaaagagtgctgttcacagtgcaagattttagaaagagaaggggaagaaaatgaagccttacataagatgattgcaaacgagcaaaagacttctctcccaaatttgttccaggataaaaacagaccgtgtctcagtaactggccagaggatacggatgtcctctacatcgtgtctcagttctttgtagaagagtggcggaaatttgttagaaagcctacaagatgcagccctgtgtcatcagttgggaacagtgctcttttgtgtccccacgggggcctcatgtttacatttgcttccatgaccaaagaagattctaaacttatagctctcatatggcccagtgagtggcaaatgatacaaaagctctttgttgtggatcatgtaattaaaatcacgagaattgaagtgggagatgtaaacccttcagaaacacagtatatttctgagcccaaactctgtccagaatgcagagaaggcttattgtgtcagcagcagagggacctgcgtgaatacactcaagccaccatctatgtccataaagttgtggataataaaaaggtgatgaaggattcggctccggaactgaatgtgagtagttctgaaacagaggaggacaaggaagaagctaaaccagatggagaaaaagatccagattttaatcaaatcatgcatgcattttcagttgctccttttgaccagaatttgtcaattgatggaaagattttaagtgatgactgtgccaccctaggcacccttggcgtcattcctgaatctgtcattttattgaaggctgatgaaccaattgcagattatgctgcaatggatgatgtcatgcaagtttgtatgccagaagaagggtttaaaggtactggtcttcttggacattaatctttgaatacttgctgactgctaagaaatgaccagaggggaagaggagtttgacatgttagggcattaaagcaaaggtggatttaagaattaaaccattacatgccccttccaaaaggcagaaatccattcaaacgtgactgtcccaaatgccttatgtcaaataaagcagattgcactgatggacatcag

SEQ ID NO: 408888 - DNA, 4354 bp, Homo sapiens
  misc_feature (570)..(571): n is a, c, g, or t
  misc_feature (2752)..(2752): n is a, c, g, or t
  misc_feature (3721)..(3721): n is a, c, g, or t
  misc_feature (3785)..(3785): n is a, c, g, or t
aattgagatggtttactgtaaaattaaaatgggagttagttttctagacatgtaactctctggggagtataaaactggtcacaatgggctttgcgttgaagtatctgtccctcagatctcatcagaaggagtatataatacaaaaatataaattcaacctctgtatgttttcttctatgttttatgctgggactcactggagatctttgtaagtaatcaaagctggccctttatctttgattttggcttttagggaattctagggacttcctttccccaaattaaaactcattttgaggtgtttggttttgtcttttaatttttgcaacttcaaaattgatgactcagttctagtgtactttatcctcgaacttgtttaaaataggttactttcttgaaataaataataatataatgaagagatcatgacttggatttgggtgggggaattaaataccttttcaaaattgccatcagtatcatcttggatgaagaaagttcagtggttaaaagcgtcttctgaagtgtggtcatagtcggtgaggtttatttcagtttggcttctcattnnaattttcagatgtatatcacatatatgtgaaaagtactgacaaaaataatttatgaaataaacacagtagggcatgaggttgtgttatttgtgaggcagcaatggagcatgacttgtagtcaacaaacatgggtgtcctgatcaaagctctgctgtgctattcggcaagactctatgtggatgcctcttgtagaatgtggttaataataccagccgatctcatagggcactgtgcagactcagcattatggtgcacagctccttgaactcataggagtggcacttaactggagctttgtgtcgtactcatcaaacatcttcccccagacaatgattcttctgattctgctaactctggacagagtttgcattgtcttttgagaaaaatgaatttatcacttagtcaaaaaactgtaaaaatacataggctctttccgatgcttgctttctcagagccctatgagtttgtctctctggaatggctgcaaaagtggttggatgaatcaacacctaccaaacctattgataatcacgcttgcctgtgttcccatgacaagcttcacccggataaaatatcaattatgaagaggatatctgaatatgcagctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcgatggattttgggtggggaagtcctccttgcggagttggcgccagctagctcttgaacagctggatgagcaagatggtgatgcagaacaaagcaacggaaagatgaacggtagcaccttaaataaagatgaatcaaaggaagaaagaaaagaagaggaggaattaaattttaatgaagatattctgtgtccacatggtgagttatgcatatctgaaaatgaaagaaggcttgtttctaaagaggcttggagcaaactgcagcagtactttccaaaggctcctgagtttccaagttacaaagagtgctgttcacagtgcaagattttagaaagagaaggggaagaaaatgaagccttacataagatgattgcaaacgagcaaaagacttctctcccaaatttgttccaggataaaaacagaccgtgtctcagtaactggccagaggatacggatgtcctctacatcgtgtctcagttctttgtagaagagtggcggaaatttgttagaaagcctacaagatgcagccctgtgtcatcagttgggaacagtgctcttttgtgtccccacgggggcctcatgtttacatttgcttccatgaccaaagaagattctaaacttatagctctcatatggcccagtgagtggcaaatgatacaaaagctctttgttgtggatcatgtaattaaaatcacgagaattgaagtgggagatgtaaacccttcagaaacacagtatatttctgagcccaaactctgtccagaatgcagagaaggcttattgtgtcagcagcagagggacctgcgtgaatacactcaagccaccatctatgtccataaagttgtggataataaaaaggtgatgaaggattcggctccggaactgaatgtgagtagttctgaaacagaggaggacaaggaagaagctaaaccagatggagaaaaagatccagattttaatcaaagcaatggtggaacaaagcggcaaaagatatcccatcaaaattatatagcctatcaaaagcaagttattcgccgaagtatgcgacatagaaaagttcgtggtgagaaagcacttctcgtttctgctaatcagacgttaaaagaattgaaaattcagatcatgcatgcattttcagttgctccttttgaccagaatttgtcaattgatggaaagattttaagtgatgactgtgccaccctaggcacccttggcgtcattcctgaatctgtcattttattgaaggctgatgaaccaattgcagattatgctgcaatggatgatgtcatgcaaggtaaagatgaatttgttttaggaatctgctgattaggttttagacggaggtgggattttagatattgaagctttagtgtacagtgcttttactttgaaccttgaaaaaagcttccacatattnttacagtagaatacattatcttaaaagatcatagaaaggagggaaagatatctacaaaaacttggaaagctaacctgaggaaactgaaataaatgtgagctctgcctgtggaggaggtcaacaagaagcaaaactaagtcagattgcagtgccccagacaggcacacacaaattagaggcctaggtacctctgaaggtgggaatgaattgtgagcctaaaaagaagataacatgatacttgtttggaaaactgtataagaagcagttagacaactctctacctttcacatccttgtcacttccccatctccacctggacctcagatgggcacccagaattatgtgtttccacacttggaaaaattaaactagaaaggtgggaacgaagcctataccaaataggagaccatctcttagccctttgctcaaattcgggcagcccattacttaccctcccccaggtgggaagggatttctctccagggaaactagtcaagaaaataaccagtggatgtaaaaagtctggttctgtatgatcaagtgagatttctcccagggatgcaaggatgttcaacatatgcaaaccaatacatcacatcagcagaatgaaggacaaaaatcatatgatcatcttaatagacaaagaaaaagcatttgataaaattcaacatcccttcgtggtaaaaactctcaaaaaaccaagtacagaaggaacatacctcaatataataaaggccatatgtgagacccacagctgacatcatacctaatggcgaaaagcttaaagcctttcctctaagaactggaatagacaaggacggccattttcaccactcttattcaacatagtattggaagtcctagcaagagcaattaggcaagataaataagtaaaaagcatgcaaaattggaaaagaggaagtcaaatggtccctctttgcagatgacatgctttttttttagagtctntgttgcccagactggagtgcagtggcaccatctcagctcactgcagccaccactcctgggttcnagcaattcttgtgcctcagactcctgagtagctgggactacaggcatgtgccatgacacccagctaatttttgtatttttactagagatgaggatttcccatgttggccaggctggtcccgaactcctggccccctgtgatctggccacctgggcctcccaaaatgctagaattacaggcatgagccaccacacctggcctacatatatttttttttcttttttgagacagtcttgctttttgtcggaagtatgtagtcgactacatacttccgagaggatatctgaatatgcagctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcagcgatggattttgggtggggaagtcctccttgcggagttggcgccagctagctcttgaacagctggatgagcaagatggtgatgcagaacaaagcaacggaagtatgtagtc

SEQ ID NO: 408889 - DNA, 2633 bp, Homo sapiens
  misc_feature (570)..(571): n is a, c, g, or t
aattgagatggtttactgtaaaattaaaatgggagttagttttctagacatgtaactctctggggagtataaaactggtcacaatgggctttgcgttgaagtatctgtccctcagatctcatcagaaggagtatataatacaaaaatataaattcaacctctgtatgttttcttctatgttttatgctgggactcactggagatctttgtaagtaatcaaagctggccctttatctttgattttggcttttagggaattctagggacttcctttccccaaattaaaactcattttgaggtgtttggttttgtcttttaatttttgcaacttcaaaattgatgactcagttctagtgtactttatcctcgaacttgtttaaaataggttactttcttgaaataaataataatataatgaagagatcatgacttggatttgggtgggggaattaaataccttttcaaaattgccatcagtatcatcttggatgaagaaagttcagtggttaaaagcgtcttctgaagtgtggtcatagtcggtgaggtttatttcagtttggcttctcattnnaattttcagatgtatatcacatatatgtgaaaagtactgacaaaaataatttatgaaataaacacagtagggcatgaggttgtgttatttgtgaggcagcaatggagcatgacttgtagtcaacaaacatgggtgtcctgatcaaagctctgctgtgctattcggcaagactctatgtggatgcctcttgtagaatgtggttaataataccagccgatctcatagggcactgtgcagactcagcattatggtgcacagctccttgaactcataggagtggcacttaactggagctttgtgtcgtactcatcaaacatcttcccccagacaatgattcttctgattctgctaactctggacagagtttgcattgtcttttgagaaaaatgaatttatcacttagtcaaaaaactgtaaaaatacataggctctttccgatgcttgctttctcagagccctatgagtttgtctctctggaatggctgcaaaagtggttggatgaatcaacacctaccaaacctattgataatcacgcttgcctgtgttcccatgacaagcttcacccggataaaatatcaattatgaagaggatatctgaatatgcagctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcgatggattttgggtggggaagtcctccttgcggagttggcgccagctagctcttgaacagctggatgagcaagatggtgatgcagaacaaagcaacggaaagatgaacggtagcaccttaaataaagatgaatcaaaggaagaaagaaaagaagaggaggaattaaattttaatgaagatattctgtgtccacatggtgagttatgcatatctgaaaatgaaagaaggcttgtttctaaagaggcttggagcaaactgcagcagtactttccaaaggctcctgagtttccaagttacaaagagtgctgttcacagtgcaagattttagaaagagaaggggaagaaaatgaagccttacataagatgattgcaaacgagcaaaagacttctctcccaaatttgttccaggataaaaacagaccgtgtctcagtaactggccagaggatacggatgtcctctacatcgtgtctcagttctttgtagaagagtggcggaaatttgttagaaagcctacaagatgcagccctgtgtcatcagttgggaacagtgctcttttgtgtccccacgggggcctcatgtttacatttgcttccatgaccaaagaagattctaaacttatagctctcatatggcccagtgagtggcaaatgatacaaaagctctttgttgtggatcatgtaattaaaatcacgagaattgaagtgggagatgtaaacccttcagaaacacagtatatttctgagcccaaactctgtccagaatgcagagaaggcttattgtgtcagcagcagagggacctgcgtgaatacactcaagccaccatctatgtccataaagttgtggataataaaaaggtactggtccctcttgtggcaatgactagtaatgatcaagcgtgctctttggcttgatttgctgttgtatttgcactgagggtctgcctaggactgcatttttgttccttcagagctgtttggcatcagaattgaaattggacaataattgaaaatgaacagttatgtgattatatgagaatttagtttgttattaattgatgcatagatatttactgaatgtcagctgtgttccaggaatggtccaggtgctggggatacagtgataaagaaggcaggtataataccttctctcaaaattataggcacctagtgaggaagatcaggaataaagtataaattcatatgatttcacacagaaatgattgttttgaaggaactttagcagggtcaagtggaggttagtgtgagacagggagtagacaggagaggcgtcttgg

SEQ ID NO: 408890 - DNA, 2515 bp, Homo sapiens
  misc_feature (10)..(10): n is a, c, g, or t
  misc_feature (913)..(913): n is a, c, g, or t
  misc_feature (1882)..(1882): n is a, c, g, or t
  misc_feature (1946)..(1946): n is a, c, g, or t
taaccatgtngattcatgtaatttcagtccatttagtttcgctgctgtggtaacattcctttgtatgaaaaactattctttgttgatgatacgtatcttttctctctaattcctttggattaaatgttagtgttaatggttttggtttagcagactaatggattatgttaattctcttaatttccatgtgtcttaaggcatgttgtgttttttttttgcacagtatagctctcatatggcccagtgagtggcaaatgatacaaaagctctttgttgtggatcatgtaattaaaatcacgagaattgaagtgggagatgtaaacccttcagaaacacagtatatttctgagcccagtgatgaaggattcggctccggaactgaatgtgagtagttctgaaacagaggaggacaaggaagaagctaaaccagatggagaaaaagatccagattttaatcaaagcaatggtggaacaaagcggcaaaagatatcccatcaaaattatatagcctatcaaaagcaagttattcgccgaagtatgcgacatagaaaagttcgtggtgagaaagcacttctcgtttctgctaatcagacgttaaaagaattgaaaattcagatcatgcatgcattttcagttgctccttttgaccagaatttgtcaattgatggaaagattttaagtgatgactgtgccaccctaggcacccttggcgtcattcctgaatctgtcattttattgaaggctgatgaaccaattgcagattatgctgcaatggatgatgtcatgcaaggtaaagatgaatttgttttaggaatctgctgattaggttttagacggaggtgggattttagatattgaagctttagtgtacagtgcttttactttgaaccttgaaaaaagcttccacatattnttacagtagaatacattatcttaaaagatcatagaaaggagggaaagatatctacaaaaacttggaaagctaacctgaggaaactgaaataaatgtgagctctgcctgtggaggaggtcaacaagaagcaaaactaagtcagattgcagtgccccagacaggcacacacaaattagaggcctaggtacctctgaaggtgggaatgaattgtgagcctaaaaagaagataacatgatacttgtttggaaaactgtataagaagcagttagacaactctctacctttcacatccttgtcacttccccatctccacctggacctcagatgggcacccagaattatgtgtttccacacttggaaaaattaaactagaaaggtgggaacgaagcctataccaaataggagaccatctcttagccctttgctcaaattcgggcagcccattacttaccctcccccaggtgggaagggatttctctccagggaaactagtcaagaaaataaccagtggatgtaaaaagtctggttctgtatgatcaagtgagatttctcccagggatgcaaggatgttcaacatatgcaaaccaatacatcacatcagcagaatgaaggacaaaaatcatatgatcatcttaatagacaaagaaaaagcatttgataaaattcaacatcccttcgtggtaaaaactctcaaaaaaccaagtacagaaggaacatacctcaatataataaaggccatatgtgagacccacagctgacatcatacctaatggcgaaaagcttaaagcctttcctctaagaactggaatagacaaggacggccattttcaccactcttattcaacatagtattggaagtcctagcaagagcaattaggcaagataaataagtaaaaagcatgcaaaattggaaaagaggaagtcaaatggtccctctttgcagatgacatgctttttttttagagtctntgttgcccagactggagtgcagtggcaccatctcagctcactgcagccaccactcctgggttcnagcaattcttgtgcctcagactcctgagtagctgggactacaggcatgtgccatgacacccagctaatttttgtatttttactagagatgaggatttcccatgttggccaggctggtcccgaactcctggccccctgtgatctggccacctgggcctcccaaaatgctagaattacaggcatgagccaccacacctggcctacatatatttttttttcttttttgagacagtcttgctttttgtcggaagtatgtagtcgactacatacttccgagaggatatctgaatatgcagctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcagcgatggattttgggtggggaagtcctccttgcggagttggcgccagctagctcttgaacagctggatgagcaagatggtgatgcagaacaaagcaacggaagtatgtagtc

SEQ ID NO: 408891 - DNA, 602 bp, Homo sapiens
atcttttcaatttggaattcttctttttttctttttttcagtttgtatgccagaagaagggtttaaaggtactggtcttcttggacattaatctttgaatacttgctgactgctaagaaatgaccagaggggaagaggagtttgacatgttagggcattaaagcaaaggtggatttaagaattaaaccattacatgccccttccaaaaggcagaaatccattcaaacgtgactgtcccaaatgccttatgtcaaataaagcagattgcactgatggacatcagacttgaaggaaatgtttccaattttatatttaaggggggtggtgggtgggagggggcaagtaaagacggaacaagtttagtagcagtaatagtaaatcatgtttacatatgagatttatagtcgtgggaggggaataaagttctgttatatttccttgctcgagtttcataccagatgcgttggtccataaaggattgtatcaagtagatgggacaacattctgctctgaacgaaaagtaattttagagacataacctgcttaccaatgcctgtctttgattcatattctactttcaataaagcatgaaagtgaagaac

SEQ ID NO: 408892 - DNA, 576 bp, Homo sapiens
cttgaactcctgggattataggtgggagcctcctcaccaaaccttaaatgtctcttgtaacaaacatttaaactgcttacatgcacttagaggtgtgtattactcattattttcttttatcaattttatgtgagcctgctaagaaagtctcgttagtttctactcattgtttacattgaatttcaaatagttaagggaccaataaggaaacagcttttgtttacctgaaaaacttcatgagcaagggtcacattgtggttaatttcagtgctttcttcatttccaatcttcattatagagcaatggtggaacaaagcggcaaaagatatcccatcaaaattatatagcctatcaaaagcaagttattcgccgaagtatgcgacatagaaaagttcgtggtgagaaagcacttctcgtttctgctaatcagacgttaaaagaattgaaaattcaggtgagggaaacatttgttcaagtttgctctggacttaaaagggcctttatgaattcctgctttccacctgtatttacatatatgtatgtatctgtgtttttttccagaagacttaaagtttt

SEQ ID NO: 408893 - DNA, 968 bp, Homo sapiens
ggctagtcagcgggacgggcgggcgcgcgggcgctgttgggctcctctgagcggttgaggttggggctggggttgagctcgggttgggttcctcctggggcaggagggaaaggcgggagccagggcgtcagggcctgcggacgatgtgtgtgtgaaagggcgcgtcagccataagaagccatatgcgtgcgagccggtccccaccgtccccgcggcgttgtcaccatcatcatgaggccactggagcagcctcaggcgctgctgccggggggccgggcgcggggtgcgtcgggctctgcaggttggcactcacacccagcgcgcaggatggcaggaatagcacatttcaaacctacaagaaagaagtgtgcctcccccgtcattcgatgcaccctggcccctgggccatctgctgtgaatgccagaccagattcgggggccgcctgcctgtgtccagggtggaagcagcactgccttactgggtccctctgtccctgagaccccgaaagcagcacccctgctggatgcatgctgctggcacaactgctggcggatctgcggtgatgagtgcctgttgtccaagttccagcagctccaggccccctaccaggaccagctaccggctcctgcagcgcgtctgctgcccctcggcctcctgaccctcctccaggccatcccgagggtcatcatggccattcgccagtgttttggggtttgaagttggaatcttcagctactgtcaagaacagccacaaaaatgtgtcacgatcaagatctttgagagtccaccaatcaggaggcgtctgtgacagtcgctgtcttctcagaacagaatccacacccaggattcaacccaaatgatttctcatcaggtgattcttggttgtagcaaagttcatgtgaatgtgggtgagtttctgttatgaatgtggtcaataaatgttatttgtgaaactctaaactggcca

SEQ ID NO: 408894 - DNA, 849 bp, Homo sapiens
gtgattcatatgcttccatagcaggtgtctgcttctgagccaagctcccagggcagcggagcaggcaccaaccagcatcccaggggagggcacagcttgtccagctgggatgtttgggtgccctgtgagatgccccaagccaccaacccagcttatctcaggagaagcctcggcggcccgtctgccggcctggagagatgtgctacagcagccgggggtggggggagagggtgggcttagaatctcttggcagggagcccccaagagcagggtgagacctgccttcatttcacctgtccccttcacagttctgcaaagccagcattatcatcccttttcagaaggagtgggcactcaggtggaatgcctcaccccagtcctgcggctggaaagcgatatggccaggactgcaccccacccctcatccctgcaccccttccctgcctgggattcctccagccctgtgcactgtggagcgcctctgccttccgctcatggaggtttcccaagggcacgcgctgagggcagctggtctcagcctggggccgggtcctagtaactgtctctctttgctttccagccagtgttttggggtttgaagttggaatcttcagctactgtcaagaacagccacaaaaatgtgtcacgatcaagatctttgagagtccaccaatcaggaggcgtctgtgacagtcgctgtcttctcagaacagaatccacacccaggattcaacccaaatgatttctcatcaggtgattcttggttgtagcaaagttcatgtgaatgtgggtgagtttctgttatgaatgtggtcaataaatgttatttgtgaaactctaaactggcca

SEQ ID NO: 408895 - DNA, 452 bp, Homo sapiens
cgcacgctggaggacatcttccacgagcacatgcaggagctcatcctgatgaagttcatctacaccagtcagtacgacaactgcctgacctaccgccgcatctacctgccgcccagccgccccgacgacctcatcaagcctggccctcctccaggccatcccgagggtcatcatggccattcgccagtgttttggggtttgaagttggaatcttcagctactgtcaagaacagccacaaaaatgtgtcacgatcaagatctttgagagtccaccaatcaggaggcgtctgtgacagtcgctgtcttctcagaacagaatccacacccaggattcaacccaaatgatttctcatcaggtgattcttggttgtagcaaagttcatgtgaatgtgggtgagtttctgttatgaatgtggtcaataaatgttatttgtgaaactctaaactggcca

SEQ ID NO: 408896 - DNA, 1022 bp, Homo sapiens
tccccgctgggcagcagacagtggagatcgacctgaggcatcggatccagctgcccgacctcgagaaccagcgcaacttcaatgagctctcccgcatcgtcctggaggtgcgcgagagggtgcgccaggagcagcaggaaggcgggcacgaggcgggcgagggtcgtggccggcagggcccccgggagtcccagccaagccctgcccagcccagggcagaggcgcccagcaagggcccagatgggacacctggtgaggatggtggcgagcctggggatgccgtagctgcggccgagcagcctgcccagtgtgggcaggggcagccgttcgtgctgcccgtgggcgtgagctccaggaatgaggactacccccgaacctgcaggatgtggaatagcacatttcaaacctacaagaaagaagtgtgcctcccccgtcattcgatgcaccctggcccctgggccatctgctgtgaatgccagaccagattcgggggccgcctgcctgtgtccagggtggaagcagcactgccttactgggtccctctgtccctgagaccccgaaagcagcacccctgctggatgcatgctgctggcacaactgctggcggatctgcggtgatgagtgcctgttgtccaagttccagcagctccaggccccctaccaggaccagctaccggctcctgcagcgcgtctgctgcccctcggcctcctgaccctcctccaggccatcccgagggtcatcatggccattcgccagtgttttggggtttgaagttggaatcttcagctactgtcaagaacagccacaaaaatgtgtcacgatcaagatctttgagagtccaccaatcaggaggcgtctgtgacagtcgctgtcttctcagaacagaatccacacccaggattcaacccaaatgatttctcatcaggtgattcttggttgtagcaaagttcatgtgaatgtgggtgagtttctgttatgaatgtggtcaataaatgttatttgtgaaactctaaactggcca

SEQ ID NO: 408897 - DNA, 1152 bp, Homo sapiens
ggctagtcagcgggacgggcgggcgcgcgggcgctgttgggctcctctgagcggttgaggttggggctggggttgagctcgggttgggttcctcctggggcaggagggaaaggcgggagccagggcgtcagggcctgcggacgatgtgtgtgtgaaagggcgcgtcagccataagaagccatatgcgtgcgagccggtccccaccgtccccgcggcgttgtcaccatcatcatgaggccactggagcagcctcaggcgctgctgccggggggccgggcgcggggtgcgtcgggctctgcaggttggcactcacacccagcgcgcaggatggcaggaatagcacatttcaaacctacaagaaagaagtgtgcctcccccgtcattcgatgcaccctggcccctgggccatctgctgtgaatgccagaccagattcgggggccgcctgcctgtgtccagggtggaagcagcactgccttactgggtccctctgtccctgagaccccgaaagcagagtcaaaagacggttcaatttcctatcccccaaaccgccaagatgtgcccctgcctatgccaccgctttgggggccgcctcccgatgcctagggaccaggcagtgatgccctactgggtgccccaggtcctgaggtctcagcagcagatagtcaggaggcagcagagtttgaaaggcatccaagcacccctgctggatgcatgctgctggcacaactgctggcggatctgcggtgatgagtgcctgttgtccaagttccagcagctccaggccccctaccaggaccagctaccggctcctgcagcgcgtctgctgcccctcggcctcctgaccctcctccaggccatcccgagggtcatcatggccattcgccagtgttttggggtttgaagttggaatcttcagctactgtcaagaacagccacaaaaatgtgtcacgatcaagatctttgagagtccaccaatcaggaggcgtctgtgacagtcgctgtcttctcagaacagaatccacacccaggattcaacccaaatgatttctcatcaggtgattcttggttgtagcaaagttcatgtgaatgtgggtgagtttctgttatgaatgtggtcaataaatgttatttgtgaaactctaaactggcca

SEQ ID NO: 408898 - DNA, 1188 bp, Homo sapiens
ggctagtcagcgggacgggcgggcgcgcgggcgctgttgggctcctctgagcggttgaggttggggctggggttgagctcgggttgggttcctcctggggcaggagggaaaggcgggagccagggcgtcagggcctgcggacgatgtgtgtgtgaaagggcgcgtcagccataagaagccatatgcgtgcgagccggtccccaccgtccccgcggcgttgtcaccatcatcatgaggccactggagcagcctcaggcgctgctgccggggggccgggcgcggggtgcgtcgggctctgcaggttggcactcacacccagcgcgcaggatggcaggaatagcacatttcaaacctacaagaaagaagtgtgcctcccccgtcattcgatgcaccctggcccctgggccatctgctgtgaatgccagaccagattcgggggccgcctgcctgtgtccagggtggaagcagcactgccttactgggtccctctgtccctgagaccccgaaagcagcacccctgctggatgcatgctgctggcacaactgctggcggatctgcggtgatgagtgcctgttgtccaagttccagcagctccaggccccctaccaggaccagctaccggctcctgcagcgcgtctgctgcccctcggcctcctgaccctcctccaggccatcccgagggtcatcatggccattcgccagtgttttggggtttgaagttggaatcttcagctactgtcaagaacagccacaaaaatgtgtcacgatcaagatctttgagagtccaccaatcaggaggcgtctgtgacagtcgctgtcttctcagaacagaatccacacccaggattcaacccaaatgatttctcatcaggggggacttgtccccatgtccgtgtccctgggggagggcagctatttccgagtgtctcttcagggacagcagacccactggatgagggcccgaaaatggtttcagcacctgtgtcaggctctgcttttggggtgaactcaagataagacaaggtgagcagatcccatctcaccagtcagggaggaagcgccatcggagcagagacctgaagacaattccaggaaacctggcaatgaaaggtgagagagaagctgattatggccaggtctggcacagaaagcccctgtttgtgcaatcctgcattcttcctttttaa

SEQ ID NO: 408899 - DNA, 367 bp, Homo sapiens
atttctcatcaggtgattcttggttgtagcaaagttcatgtgaatgtgggtgagtttctgttatgaatgtggtcaataaatgttatttgtgaaactctaaactggccacctcttaaatgatgacctctgatttcccttcattaaggggggacttgtccccatgtccgtgtccctgggggagggcagctatttccgagtgtctcttcagggacagcagacccactggatgagggcccgaaaatggtttcagcacctgtgtcaggtgggtctccctttaagtagcataacattgtatatgtgaattgaattttaaaatctgagatctcttttatatgtcataaaattcactcttttagagtatacgatt

SEQ ID NO: 408900 - DNA, 417 bp, Homo sapiens
gattttttaaccatttcggacaattgagagtttagaatagtctagtactattttggttaaataaatatttagaacatcctagagtttattttgttttaagctgtaaaacatttttctttaaactgttttagaaagatacttccctacccaactcttaaaacaggtgttaataagcaggtgactaaatagtgaactgaggtgtgctgtaatagagcagttgttgctgaatgcacggaggtttcgtgctttcagacttcttggccttctaaaatatatatatacacacacacatatatgtatatgtatatatgtgtatatatatatatatacacacacatatatatatgttccttccactccaactttgtggcttttgcttattactaggtaagagtactaagattatttgctacatgc

SEQ ID NO: 408901 - DNA, 718 bp, Homo sapiens
gcgctctggctgggcacgaacgtagaggtcaggctagggctgacgatgctggctaagcgggggcgcacgtctgggaagtcgtcgtcgtagtcaccgatgtccgtgaccttccagaggtaatccacccgccttggcctcccaaagtgctgggattacaggtgtgagccaccatgcccagccagaaactgccacttttaaaccatcagatctcattgagaactccctcactatcacgagaaccgcatgagggaaaccacccccatgatctgatcacctcccaccaggtcctgccctcaacatgtggggattacaattcaagatgagatttgggtcaggaaacagagccaaaccatatcaagagcctctggtaaccactgttctactcaatacttctatgaggtgaacttctttggattccacatatgatcaagatcatgaggaaggaggagcaagtcttctttgtcatgctattaagaaaatacccagagtcacagcaccatgatctccttgtgaagcagaacaagtaatataaaactgatctaaagaggcctcccctctactcttatctgtctggtcgagtcatttgggtccaagtgggcaccattgtgggagggtgggaggactcatcactgggggcccaggcatcattggcatgtggcctcctgtgttagtttgttctcatgctgcaaataaagacaacttgagactggataattta

SEQ ID NO: 408902 - DNA, 632 bp, Homo sapiens
agcggcaggagctggttagccggatagaatgtaatccacccgccttggcctcccaaagtgctgggattacaggtgtgagccaccatgcccagccagaaactgccacttttaaaccatcagatctcattgagaactccctcactatcacgagaaccgcatgagggaaaccacccccatgatctgatcacctcccaccaggtcctgccctcaacatgtggggattacaattcaagatgagatttgggtcaggaaacagagccaaaccatatcaagagcctctggtaaccactgttctactcaatacttctatgaggtgaacttctttggattccacatatgatcaagatcatgaggaaggaggagcaagtcttctttgtcatgctattaagaaaatacccagagtcacagcaccatgatctccttgtgaagcagaacaagtaatataaaactgatctaaagaggcctcccctctactcttatctgtctggtcgagtcatttgggtccaagtgggcaccattgtgggagggtgggaggactcatcactgggggcccaggcatcattggcatgtggcctcctgtgttagtttgttctcatgctgcaaataaagacaacttgagactggataattta

SEQ ID NO: 408903 - DNA, 820 bp, Homo sapiens
gcgctctggctgggcacgaacgtagaggtcaggctagggctgacgatgctggctaagcgggggcgcacgtctgggaagtcgtcgtcgtagtcaccgatgtccgtgaccttccagaggtaatccacccgccttggcctcccaaagtgctgggattacaggtgtgagccaccatgcccagccagaaactgccacttttaaaccatcagatctcattgagaactccctcactatcacgagaaccgcatgagggaaaccacccccatgatctgatcacctcccaccaggtcctgccctcaacatgtggggattacaattcaagatgagatttgggtcaggaaacagagccaaaccatatcaagagcctctggtaaccactgttctactcaatacttctatgaggtgaacttctttggattccacatatgatcaagatcatgaggggtgatgaacatgatctagaattgattgtggtgttcttacacatctctgtgaacatactaaacaccactgaatggtacacttcaagtgggtgaattgtatggaaggaggagcaagtcttctttgtcatgctattaagaaaatacccagagtcacagcaccatgatctccttgtgaagcagaacaagtaatataaaactgatctaaagaggcctcccctctactcttatctgtctggtcgagtcatttgggtccaagtgggcaccattgtgggagggtgggaggactcatcactgggggcccaggcatcattggcatgtggcctcctgtgttagtttgttctcatgctgcaaataaagacaacttgagactggataattta

SEQ ID NO: 408904 - DNA, 278 bp, Homo sapiens
ggagttcaggctgggcaagatggtcaggtccatctctattaaagaaataaataaataaaaaattccacatggcccaaatttgtcacagtcaaactgagctcacttttctgtttgatcttctctcatgttcttgtctggagaggtggcctcgctgtctgtccagtgacccatagcaaagataaggcagctccctggactctccattctttctcccatcccttgcaacaggtgggttgccagatcctgtaactgacccatcagatccagcagccactgtc

SEQ ID NO: 408905 - DNA, 360 bp, Homo sapiens
aggaaaaaggggttccgatccagacccctagagaaggttcttggatctcatgcaggaagaaactcaagacatggtctcactctgtcacccaagctggagtgcagtggcgcaatgatagctcactgcaaccttgagctcctgggctcaggcaatcttcctgcctcagccttccaaagcactgggattccaggcacaaaccaccgtgcccagccagcgcttcacttctttgttgccttcaaggaaatacttcaattcaattctgtcatgtctcggacaatttaccacttaaatgtgtttaccaaaaaaggaattatacagctaaatccaagacacagagcatgtgtgaccaccaaaagcaac

SEQ ID NO: 408906 - DNA, 670 bp, Homo sapiens
aggaaaaaggggttccgatccagacccctagagaaggttcttggatctcatgcaggaagaaactcaagacatggtctcactctgtcacccaagctggagtgcagtggcgcaatgatagctcactgcaaccttgagctcctgggctcaggcaatcttcctgcctcagccttccaaagcactgggattccaggcacaaaccaccgtgcccagccagcgcttcacttctttgttgccttcaaggtaatgatataaagcaacaattcaataccaagttggtaaaataatttgtatttcaaacagaaagactgcctaaaaatattaccttttgctcctagcacccagacaaacaatgaataaagggaaataaggaaaccctggcagctgagaaggcctcctagtcaatagatccagtttctcccaagttcatactgcagatgaacttgtagttcatttaagtatctagatctctttccttcatgtagagaccttaatcaaagactcttctcaggattttatttcacagcctaagaaatgtttatttaatttaataaaatactctttttctttaaggttgggtccattaccaaatactaagtcatgttgaaaaaattatgtatatacatacatatgtctatatatatatatatatatatatatatatatatatatc

SEQ ID NO: 408907 - DNA, 382 bp, Homo sapiens
aataatgctgtgggttttcctcctccattcattgccaccttgccttgaaacttaatggggccacgtgtgtttccatgaatgtcattctctttggccaactcccccggcagccccaggagctccttttcaggaaaaggaagaaggtgtttgcttagcatctagtatacgagtccttgttggaaaggtgggattcttgtttctccttgggtctcttttaggctgagatgtggtcaaggaaggcctgtggtgtggctcgccttttttaatgctcgtctctggagacctgagttgctgctgactcccagcttgccccttctgtcccctggccatttctgtgtcggggtggctgagacactattgcattggccactttgtgttccca

SEQ ID NO: 408908 - DNA, 967 bp, Homo sapiens
caagaacttcggagctcagaacaggtgatactcactcctcctttggggagaggccgtgggcatggcttcacttttcagctggattataaaggatgtgaagttagcctgactgagcagaaggggagggaagacagcactccaggaaagtggaacgaacaacagagtccaaagggccctccagcctacccactcccaagtacctggaagaagctctccacgtgttcccttggggcctcctcccggagtgcagggtcatacaggttgaaggcccaattaagcctgtcatctacagttccccgaagaatcacggacaaaccagccacaaagtcctgggaaggaggcaggagggagctgtgtcctcgggtactcttcacccaactccttctctgggtttggcctggagatcctggccctgaactccaggaaacaggcttccctggcccacctcgcccagctcacctcaaaactgaccgagccatcatggttggtgtcaaaggcattgaagagaaaagtggcataggtgctggagtctgcagggtgagtgtggagaagttggcttccacacaggagaggacttcctccctctaaggagctccccataccccccatcaccttggcattcccagctcctccagaatccctccctccctcagcctagagaaggacaactgcttccccttgggccttgtcccctcacctccttgaggaaagaactgggagtaaatctgcttgaagttctcctcattgacaattccgctgggacattcctggaaggagagggcaccaggctgagggcagagacaaaatccccttccgttcaccgcccccaccctccatggcccaagactcccagggagggggataatcttcaagcctccagaggactcaccacgtggctcatgtgatgggagggaagacttctttcccagtgcacaaataaaaaacatggaacgaaactgacagtcta

SEQ ID NO: 408909 - DNA, 1049 bp, Homo sapiens
tcactgaccctcgtcccgcccccgccattcgccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcattcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatccactggccgtataatcgaagttctgagtacacaatagctccgcaagaggaagttcacgcaacttcatactaa

SEQ ID NO: 408910 - DNA, 1239 bp, Homo sapiens
ccctaccacacagtcgctctagccatggctaaaaggggccaaagtatagcttaggccatggcttcagaaggtgtaagccccaagccttggcagcttacacatggtattgagcctgagggtgcacagaagtcaagaattaaggtttaggaatgtctgcctagatttcagaagatgtatggaaactctgaatgtccagacagatgtttgctgcaggggtggggacctcatggagaacctctgctagagcagtacagaagagaaaatgtggggttgaggccccacacagagcccccactggggcactgcctagtggagctgtgagaagaggccaccgtcttccagacctcagaatggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcattcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatccactggccgtataatcgaagttctgagtacacaatagctccgcaagaggaagttcacgcaacttcatactaa

SEQ ID NO: 408911 - DNA, 992 bp, Homo sapiens
tcactgaccctcgtcccgcccccgccattcgccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcattcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatccactggccgtataatcgaagttctgagtacacaatagctccgcaagaggaagttcacgcaacttcatactaa

SEQ ID NO: 408912 - DNA, 1077 bp, Homo sapiens
tcactgaccctcgtcccgcccccgccattcgccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgtaacttgtatctttttatattgtagatgttgtggtcaacaatgctggaattctgagggatcattcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatccactggccgtataatcgaagttctgagtacacaatagctccgcaagaggaagttcacgcaacttcatactaa

SEQ ID NO: 408913 - DNA, 881 bp, Homo sapiens
cgcatctcttgaggaggaaagagccggaaacacctggtctctcaagcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggagccctggatgcttttggaagaatagatgttgtggtcaacaatgctggaattctgagggatcattcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatccactggccgtataatcgaagttctgagtacacaatagctccgcaagaggaagttcacgcaacttcatactaa

SEQ ID NO: 408914 - DNA, 743 bp, Homo sapiens
cgcgtcagaaacacttcatacttgtacctctgggatagggtcctggtgtcgctcacgtccaccagatgcctggaaaggggtcctcgggcaccgagcagcgacccaatgaggcctccctgctcctcctgcacagccgcaccgccacgaacaggagcaccgagaagaggaagaacgacgacaccaaggccaacgccaccaccaccaccttggtcaccaggtagcccggctcggcggcccgcccggggcatcagctcggtgcagggcgcggagccgttctgcagcgggaacagcacgaagagtgagctgtcgttggcgtccagcaccagcacgcgcaccagcgcctcgctgctcagcgccgtggagccgcggtctgaagcgcccacgcggaactcgaactcctgcagggcctcgtagtccagcgacctgagggcgaacagaatcgcggtcttgaatgctgaaaagagctgcaacggtctcaggagaattttcgcggatggggcttgtgaatgaagccatggtcagttccggagcgttatcgttgatatctaccacctgtattatgacagtgcattttccagaaagacctgccccatcagaggctttaatatccacctgatatgacacaattttttcaaaatctagttttctgattattttaatttctccccttcgttcattaagtgcaaatgtcttagaaatctcttcatcaccataaaaaatgagtagaatatctcaccattaat

SEQ ID NO: 408915 - DNA, 337 bp, Homo sapiens
tgttgatggagaccagggaggcgaggggcagaatcgcggtcttgaatgctgaaaagagctgcaacggtctcaggagaattttcgcggatggggcttgtgaatgaagccatggtcagttccggagcgttatcgttgatatctaccacctgtattatgacagtgcattttccagaaagacctgccccatcagaggctttaatatccacctgatatgacacaattttttcaaaatctagttttctgattattttaatttctccccttcgttcattaagtgcaaatgtcttagaaatctcttcatcaccataaaaaatgagtagaatatctcaccattaat

SEQ ID NO: 408916 - DNA, 469 bp, Homo sapiens
catttcatgggctttttccttttcctttttttgaagccttagcctgcagcgccaccatgcgttgtctttgcttcgaaacgaattgctacaattgatctattctctattctattaggagtttggaaattgggaggaaatgatgtaatcacaatatcacgcaatgaatcgcggtcttgaatgctgaaaagagctgcaacggtctcaggagaattttcgcggatggggcttgtgaatgaagccatggtcagttccggagcgttatcgttgatatctaccacctgtattatgacagtgcattttccagaaagacctgccccatcagaggctttaatatccacctgatatgacacaattttttcaaaatctagttttctgattattttaatttctccccttcgttcattaagtgcaaatgtcttagaaatctcttcatcaccataaaaaatgagtagaatatctcaccattaat

SEQ ID NO: 408917 - DNA, 508 bp, Homo sapiens
cgcgtcagaaacacttcatacttgtacctctgggatagggtcctggtgtcgctcacgtccaccagatgcctggaaaggggtcctcgggcaccgagcagcgacccaatgaggcctccctgctcctcctgcacagccgcaccgccacgaacaggagcaccgagaagaggaagaacgacgacaccaaggccaacgccaccaccacaatcgcggtcttgaatgctgaaaagagctgcaacggtctcaggagaattttcgcggatggggcttgtgaatgaagccatggtcagttccggagcgttatcgttgatatctaccacctgtattatgacagtgcattttccagaaagacctgccccatcagaggctttaatatccacctgatatgacacaattttttcaaaatctagttttctgattattttaatttctccccttcgttcattaagtgcaaatgtcttagaaatctcttcatcaccataaaaaatgagtagaatatctcaccattaat

SEQ ID NO: 408918 - DNA, 311 bp, Homo sapiens
attcaaagcccttttcttcctccagtctcctcgagccacccacatccccctgctcactgtcctttttccttccttctttttgtgtttttgaaacagagtctctgttgcccaggctggagtgcagtggtacaatctcagctcactgcaacctccacctcccaggttcaagtgattccctgcctcagccagctacctggggattacagggacccaccaccacgcccagctaatttttgtatttttagtaaagacggggtttcaccatgttggcgaggctggtctcgaactcctgacctcaagtgatccaccca

SEQ ID NO: 408919 - DNA, 1837 bp, Homo sapiens
ggagagatcgtccaggaggcggtgttgatgcggcaaagggcaacaggaagggcattaggacttgaaatcggagacgcacgcaggggagggagtcagtgtcggaacctggtaggccctgggagaactccggcttttcgtctgcgtgagctggagaagagccgaaggtttctgcgcacagcacggacctgcgtgcctcagctttaaggaaatcaccgtggccgccgctgtgaacgcagagaagggcgcgagcgtgggagcaggaacccaaggcggtgggaaacggtggggctttctgagtgtattggaaagtagagcccacagatctgctgcagaccagaaaggggcgcgagaaagagcggacagaggcagacgccggggctggcggcgatggagcagcagtcggaggacgcggaaggcctgcgagagtcgcccgcggcccagcgccggccttcgggtcccaccttgcgggtgatgttgtgcacgtaggggcacgtgttgcaggcgaagcggtggcagcgttgtccctcctccacgatcagcccgttcccgcagccggggcagaacagcagcatggtctcgaactccgcaggctccaactcccggcagctcccactgccgctcagcgccgatgcgccgcccgcctcgagctcacattggtcctggcagccttcccggcacaccaaccaaccaatagacagggcgattctgcgctcccggcctgctgcaggctgtctcgcacttgtcattggtcactgcagccgccccacccccccggcgcgccagtggctgggcggcctcgctggggcgggccgcagttcctgcgcgtgcgcgcttggcctccctagtgcgggctggcagtgcgggcagagcccggctgagaggggcggccctggaggagacggaggcggcgggtgggcccgaggcgcaagaggaagatgaggacgaagaagaggcgctgccgcactccgaggccatggacgtgttccaggagggtctggctatggtggtgcaggacccgctgctctgcgatctgccgatccaggttactctggaagaagtcaactcccaaatagccctagaatacggccaggcaatgacggtccgagtgtgcaagatggatggagaagtaatgcccgtggttgtagtgcagagtgccacagtcctggacctgaagaaggccatccagagatacgtgcagctcaagcaggagcgtgaagggggcattcagcacatcagctggtcctacgtgtggaggacgtaccatctgacctctgcaggagagaaactcacggaagacagaaagaagctccgagactacggcatccggaatcgagacgaggtttccttcatcaaaaagctgaggcaaaagtgagcctccagacaggacaaccctcttcatcactggtggctgagctttttcccagcaggaatgggtcctcgaatcatcgtgcctctttcacagaaaggacgttgtggtggcctcaccccaggcatgcccaacaggaactgtcagcataaacctgggggcctcaggactaggacagggtgagccagtgctccctcctttcatgtacttggcctgagaatgacctctccctaggtcaaatgccctagtcacatggcagacacggctggcactgttaataaactgttggtttagttgaaggacaaaaaaaaagggggcggtgaagttactctggggcgagtaggaccagtttggaaagggcatgtgggattaagagaaggggggtaaagtgcgaaaagcatggtttggagagattggggggagagagcgagaggaggggaaaggtgagaagggggaggtgtataagagagg

SEQ ID NO: 408920 - DNA, 345 bp, Homo sapiens
aaattttgcacacctgccttactcagtcccgaagcctggcctgggtcctgatgatcagggatatactcagcgtgaactgacaggcctctacccacccctgggggcaggtcctcatgtgagtttattctcttgcctgtttcttagcacctctttcccccagagactctgtccactatggacattaaaatgtgagtggaacatgagattggggctctgatgaattgggaaaccgtaacatacaggcaaccacccttccttgcccttcgtaaaatggagcaccactttttggccactatcggcttgttctttgttgttgctcaaggtggtaaagagagccagggttcc

SEQ ID NO: 408921 - DNA, 638 bp, Homo sapiens
ctgatgatcagggatatactcagcgtgaactgacaggcctctacccacccctgggggcaggtcctcatgtgagtttattctcttgcctgtttcttagcacctctttcccccagagactctgtccactatggacattaaaatgtgagtggaacatgagattggggctctgatgaattgggaaaccgtaacatacaggcaaccacccttccttgcccttcgtaaaatggagcaccactttttggccactatcggcttgttctttgttgttgctcaaggtggtaaagagagccagggttcccacttctgcccttggtcttttgtaggttactctggaagaagtcaactcccaaatagccctagaatacggccaggcaatgacggtccgagtgtgcaagatggatggagaagtaatgcgtaagtgctaccctcctcccttcaggttatgtggtccaggctttcacagcaggaagacctaacagtgctggtcagcctgctcagaaactcacaggccatgcccaggggtactggggcaaccacaaacctgccctgtgcacagaggtgttggttcctttcctgccatcggaggctgtggctttgggttctcaccatggatcttctcccatctgtgtccgtggttg

SEQ ID NO: 408922 - DNA, 856 bp, Homo sapiens
gaaacatcaagagaatgtattccctttccttcttctccctcttcctccttttgccccatccccctctgctctcctgtgctcccctttacttctccctgcatcaggatcctcagctctccccgatcattggtacaattgtttcagaaatcttcagttattttccctgttttccatcccgtttctcatttttatcctcattcatacctgcaactctggacttctaatgcacagctggctccaagctctactgtactacttctctgttagcatataacgggcagtggctttcttttctctgtttcatctgctttctgtcttgcagaaagcacccgttcatgaattcccacatacaccttcatttttttctgctgttgaaaacattttattcttttttgaagttctatactttttattttactcgtatctcaggatacgagtaaacattaacttagtctgccatcttgattctgaacaacttgcttccttctcctagaagattagatcatctctaaagtccctgtatataatattgtatgtttgtaagcatcattctttcagacaaatgtaacgtttcaatccaaatgttgatttacttattctgacacctcatgtcctcttttagctctgcacttttctgccctttattttttggttcacacttttttctaagtatatgggttcagatggccttttacatgattgaaaactgtaaaggaaaaaggtagtagtcaacagtacaatcatggctttaataaccctttattttatgtgacaccaaaaagaattgaaaaatacaaggattgcaatttttaaattatgacgtaggcagctttgaatacatttatgtgttttccct

SEQ ID NO: 408923 - DNA, 772 bp, Homo sapiens
gggtaattgcctgtgctctctggccctctgggtgggggatcattggtacaattgtttcagaaatcttcagttattttccctgttttccatcccgtttctcatttttatcctcattcatacctgcaactctggacttctaatgcacagctggctccaagctctactgtactacttctctgttagcatataacgggcagtggctttcttttctctgtttcatctgctttctgtcttgcagaaagcacccgttcatgaattcccacatacaccttcatttttttctgctgttgaaaacattttattcttttttgaagttctatactttttattttactcgtatctcaggatacgagtaaacattaacttagtctgccatcttgattctgaacaacttgcttccttctcctagaagattagatcatctctaaagtccctgtatataatattgtatgtttgtaagcatcattctttcagacaaatgtaacgtttcaatccaaatgttgatttacttattctgacacctcatgtcctcttttagctctgcacttttctgccctttattttttggttcacacttttttctaagtatatgggttcagatggccttttacatgattgaaaactgtaaaggaaaaaggtagtagtcaacagtacaatcatggctttaataaccctttattttatgtgacaccaaaaagaattgaaaaatacaaggattgcaatttttaaattatgacgtaggcagctttgaatacatttatgtgttttccct

SEQ ID NO: 408924 - DNA, 2724 bp, Homo sapiens
caaggaccccacgcctgtgtctctgtgacagagctcaaagggccctgggccttccctccctggctcggctgtgcttgggagggttccccagtccagaatccctaaggagcatggggcagctgatccatccctggtgtacaaactgctgactgcagacagatgctgagctacccaaaccaacacctagcctctccctgaagatcctcccaggctgagagagttctgggtgtcctaggaccaaggacactggcagacttccagaagggcccccaaagccctaacctgtccagccagagcatgcgtctcagcagagctgtcttcccaagcctttgatgacaaaccaatttccctcgatgatgtgcttctgagtgctctgctgaggaacaatgggaagtctgcccagcagaagaaaatctctgccaagcccaagcttgagttcctctgtccaaggccagggacctgtgaccatggaagcagagagaagcaaggccacagccgtggccctgggcagtttcccggcaggtggcccggccgagctgtcgctgagactcggggagccattgaccatcgtctctgaggatggagactggtggacggtgctgtctgaagtctcaggcagagagtataacatccccagcgtccacgtggccaaagtctcccatgggtggctgtatgagggcctgagcagggagaaagcagaggaactgctgttgttacctgggaaccctggaggggccttcctcatccgggagagccagaccaggagaggctcttactctctgtcagtccgcctcagccgccctgcatcctgggaccggatcagacactacaggatccactgccttgacaatggctggctgtacatctcaccgcgcctcaccttcccctcactccaggccctggtggaccattactctgagctggcggatgacatctgctgcctactcaaggagccctgtgtcctgcagagggctggcccgctccctggcaaggatatacccctacctgtgactgtgcagaggacaccactcaactggaaagagctggacagctccctcctgttttctgaagctgccacaggggaggagtctcttctcagtgagggtctccgggagtccctcagcttctacatcagcctgaatgacgaggctgtctctttggatgatgcctaggcccaaaggagaggccaaaagggaaaccaaggctgcacacctagaaccccaattcagcctcctgggcaccccagaggcaaggctgtgcactcagggagggagggtgggacacagaggtgcatctagggtcccacctgtacccttgctctttcctctcttagcccttagaagtcacctacttccttccagtgccatgatcccacctgcgacctctagtgcgagtgcagagaaggtgggaccagggccagggttccaaaaagagaataagcctcctggggggtctgacctagttagttcttgagtttggggtttccagtaccatctggatgccctgcctgttgagccccattctacatccccaccattaaccaggccccacccacaaggtagaaacaacccctagagtcaacgagaaagtcattttcagaaaatctacaagtctcgttgagaccaccaccatacctcagaaggtaggactgtggcctagaagggaaaggaaagctgagatgatgtcttaccgtagcagcagatcttggatggtccaggctctatgtgacctccagagcaaagagaaagacttcggacagtctaggtcctcaaatgtcccccattgaggacaacagccccagctctttttcttttttttgagacggagtcttgccctgttgcccatgctggagtgcaatggcacgatctcagctcactgcaacctccatctcctggattcaaacaattctcctgcctcagcctccagaatagctgggattacaggcgtacaccaccatgcctggctaatttttttgtatttttagtagacatggggtttcaccacattggccaggctggtgtcgaactcctgacctcaggtgatccacccaccttggcctcccaaagtgctgggattacaggtgtgagccacggcacccagcctagctctcagatctctatttcattttgtggcttaccattccctagcacactggccttgccatcttgtggccgaataaaaaataacacctcttaagtctagcacactgcagtgaggccaggcacctcagtgctgggcaggggcatcagaaggtgctaagccctctctccacaatgccaagacggagaccacagcctacaccaaatccagcccttgatttccctgctgcctccataaacagaaagaggtctgctggatccgctaagggatcagggagaggaagaaagagggatggggtgggaggcaccccctccagtgctcctactggttcccaagctacaggtggggtgggaaaggctttatcaggtatcatcaacaggttctcaattaaagatttgatttattcaagtatgtgaaaacattctacaatggaaactcttattagatgctgcatgtactgtgctatggaccacgcacatacagccatgctgtttcagaagacttgaaatgccattgatagtttaaaaactctacacccgatggagaatcgaggaagacgatttaatgtttcatctgaatccagaggtgcatcaaattaaatgacagctccacttggcaaataat

SEQ ID NO: 408925 - DNA, 2037 bp, Homo sapiens
caaggaccccacgcctgtgtctctgtgacagagctcaaagggccctgggccttccctccctggctcggctgtgcttgggagggttccccagtccagaatccctaaggagcatggggcagctgatccatccctggtgtacaaactgctgactgcagacagatgctgagctacccaaaccaacacctagcctctccctgaagatcctcccaggctgagagagttctgggtgtcctaggaccaaggacactggcagacttccagaagggcccccaaagccctaacctgtccagccagagcatgcgtctcagcagagctgtcttcccaagcctttgatgacaaaccaatttccctcgatgatgtgcttctgagtgctctgctgaggaacaatgggaagtctgcccagcagaagaaaatctctgccaagcccaagcttgagttcctctgtccaaggccagggacctgtgaccatggaagcagagagaagcaaggccacagccgtggccctgggcagtttcccggcaggtggcccggccgagctgtcgctgagactcggggagccattgaccatcgtctctgaggatggagactggtggacggtgctgtctgaagtctcaggcagagagtataacatccccagcgtccacgtggccaaagtctcccatgggtggctgtatgagggcctgagcagggagaaagcagaggaactgctgttgttacctgggaaccctggaggggccttcctcatccgggagagccagaccaggagaggctcttactctctgtcagtccgcctcagccgccctgcatcctgggaccggatcagacactacaggatccactgccttgacaatggctggctgtacatctcaccgcgcctcaccttcccctcactccaggccctggtggaccattactctgagctggcggatgacatctgctgcctactcaaggagccctgtgtcctgcagagggctggcccgctccctggcaaggatatacccctacctgtgactgtgcagaggacaccactcaactggaaagagctggacagctccctcctgttttctgaagctgccacaggggaggagtctcttctcagtgagggtctccgggagtccctcagcttctacatcagcctgaatgacgaggctgtctctttggatgatgcctaggcccaaaggagaggccaaaagggaaaccaaggctgcacacctagaaccccaattcagcctcctgggcaccccagaggcaaggctgtgcactcagggagggagggtgggacacagaggtgcatctagggtcccacctgtacccttgctctttcctctcttagcccttagaagtcacctacttccttccagtgccatgatcccacctgcgacctctagtgcgagtgcagagaaggtgggaccagggccagggttccaaaaagagaataagcctcctggggggtctgacctagttagttcttgagtttggggtttccagtaccatctggatgccctgcctgttgagccccattctacatccccaccattaaccaggccccacccacaaggtagaaacaacccctagagtcaacgagaaagtcaagacggagaccacagcctacaccaaatccagcccttgatttccctgctgcctccataaacagaaagaggtctgctggatccgctaagggatcagggagaggaagaaagagggatggggtgggaggcaccccctccagtgctcctactggttcccaagctacaggtggggtgggaaaggctttatcaggtatcatcaacaggttctcaattaaagatttgatttattcaagtatgtgaaaacattctacaatggaaactcttattagatgctgcatgtactgtgctatggaccacgcacatacagccatgctgtttcagaagacttgaaatgccattgatagtttaaaaactctacacccgatggagaatcgaggaagacgatttaatgtttcatctgaatccagaggtgcatcaaattaaatgacagctccacttggcaaataat

SEQ ID NO: 408926 - DNA, 744 bp, Homo sapiens
ccttgcagaaaacactgatgcccaacacactgattcgcggtccaggaaacacgggtcttccaagttccaaggggctggggttccccaacgatcaagttcctgtgctgtaatcaagagggtcctttggactggatagggagcacttgggagctgtacaccatcagtcataatggatggcagtgtaaaagatgatccaaatgaccatgaacaaggcaaaagaggtcataaacccttccttcgtgagctcccacgtgccaccatattcttcctcatcaatctgtaggtaattgctgaagtagaggtacaggactcctgcattgatcaggcagaatctgagatgctcctgaggagtggtgcaccagacccaggagtgccactgtagggctgcttctttgctttagtcatcacacacacacacagctccagagcagcaatggcctttcctgtaacaggaaaaaaagcctctatttaaaaagaaatgataccatgaaaatataagatacccaagacttaccctgctattcccaagaaccctcgtaatggcaaaactccccaaatgacacccaggaccacagcaatgatctgtcggaaccagtagatcacatctaaaaattcatccttatcctcccaggccgcgtcgctccgcagcaccttactccagacggagactttgagggccccgttggccagctgcggctgaggcggctcctccttccgccgcccgccgctcatcctcccgtcgcg

SEQ ID NO: 408927 - DNA, 399 bp, Homo sapiens
gaggtgcatcaaattaaatgacagctccacttggcaaataatagctgttacttgatggtatccaagaagaaatggttggtgatggataaattcagaaatgcttccccaaaggtgggtggtttttaaaaagtttcaggtcacaacccttgcagaaaacactgatgcccaacacactgattcgcggtccaggaaacacgggtcttccaagttccaaggggctggggttccccaacgatcaagttcctgtgctgtaatcaagagggtcctttggactggatagggagcacttgggagctgtacaccatcagtcataatggatggcagtgtaaaagatgatccaaatgacctagtgaggagacaagcactgttcataggtcacctggcttaacacaggccgat

SEQ ID NO: 408928 - DNA, 2558 bp, Homo sapiens
gcggccgctgggcgcagcgttcgggggttgcacggcccgcggcggcgacgaaaacaacgaccaggacgctcggcgcccctgtccgcagagtcgccactcccgcctcttctccggtctctagcgacgcgggcccgcggcttcctcctttcctgcccagttcccgcgggcctcggggttgcagcggctagaagcgccgaggagcgccaggaggacccggccggctgcgaggattcacgcgcccgccaccccgcccggcccgggcttcatgtgaaagagggacgggcctggccccaaggcccgcgcccgactcctcgcgcgcccctccggtccccgggggccctgcggcagcccccgacctggggccgcggtgacaggccgcgctggggcggaggggcgggctcggcgggggcggcccctccttgggcctgcggctctctacgtccctgcggagcagccggccataaagaatgctgatgggagaaccattttcctaattttcaaattgttgagctgtttgccataatggatgatcagcaagctttgaactcaatcatgcaagatttggctgtccttcataaggccagtcgaccagcattatccttgcaggaaaccagaaaagcaaaatcttcatcaccaaaaaaacagaatgatgtccgagtcaaatttgaacatagaggagaaaaaagaatccttcagttccccagaccagttaaactggaagatctgagatctaaagctaaaattgcctttggacagtctatggatctacattataccaataacgagttggtaattccattaactactcaagatgacttggacaaagctctggaactgctggatcgtagtattcatatgaagagcctcaagatattacttgtaataaatggaagtacacaggctactaatttagaaccattgccatcactagaagatttggataatacagtatttggagcagagaggaaaaaacggctatctataataggtcctactagtagagatagaagttctcctcccccgggttacattccagatgaattacaccaggttgcccggaatgggtcattcactagtatcaacagtgaaggagagttcattccagagagcatggaacaaatgctggatccattatctttaagcagccctgaaaattctggctcaggaagttgtccatcacttgatagtcctttggatggagagagctatccaaaatcacgaatgcctagggctcagagctacccagataatcatcaggaattttcagactatgataaccctatctttgagaaatttggaaaaggaggaacatatccaagaaggtatcatgtttcatatcatcatcaagagtataatgatggtcgtaaaacttttccaagagctagaaggacccaggggaaccagcttacggtctcctgtgagtttcagtcctactgatcattccttaagcactagtagtggaagcagtatctttaccccagagtatgatgatagtcgaataagaagaaggggaagtgacatagacaatcctactttgacagtaatggacatcagcccacccagccgttcacctcgagctccgaccaactggagattgggcaaactgcttggccaaggagcctttggaagggtctacctctgttatgatgttgatacaggaagagaattggctgttaagcaagttcaatttgaccccgatagtcctgagaccagcaaggaagtaaatgcacttgagtgtgaaattcagttgctgaaaaactttctacatgagcgaattgttcagtattatggctgtttgagggatccccaggaaaaaacactttccatatttatggaatatatgccagggggttcaattaaggaccaattaaaagcatatggcgctcttactgagaatggtactaggaaatacacccgtcagattctggagggtgtccattatttgcacagtaatatgattctccaccgcgacatcaaaggcgcaaatatccttcgagattcaacaggcaacgtcaaactaggagattttggggccagcaaacggcttcagaccatctgtctctcagggacaggaatgaagtctgtcacgggcacaccatactggatgagccctgaagtcatcagtggacaaggctatggaagaaaagcagacatctggagtgttgcatgtaccgtggtagaaatgctaactgaaaagccgccttgggctgaatttgaagcaatggctgccatctttaaaatcgccactcagccaacaaacccaaagctgccacctcatgtctcagactatactcgagatttcctcaaacggatttttgtagaggccaaactgagaccttcagctgatgaactcttaaggcacatgtttgtgcattatcactagcagccagtaacctctcctgtgcctctacctagctcccatctattcattcaccttctctctgactgcacttttcttttttataaaaaaagagagagggggagaaaaaagacaagagggaaagtatttctcttgattcttggttaaattgttaataataataatatcctaatttata

SEQ ID NO: 408929 - DNA, 2733 bp, Homo sapiens
cacccggctaatttttgtatttttttgtatagatggggtttcaccgtgttggacaggctggtctcgaactcctgggctcaagcaatccgcctgcctaggcctcccaaagtgctgggattatggcatgagcactgcacttggtcataaacacctttcttttatgtaactctatcctttccctttcctgtgtgctgttaatattatgtgaattatattattatatattgtatacccagcaacacagttataattattgcgttatgcagttttttttttaaaccaacatattagtttcctattgctgtttatatagagttagcctttggctgacacctgagaacttggatttcaggagagttcctgcctccaactgataatggtttgtacaaacactatggtttatgctgaatacctgcttttcttctgggagtctggaattttggtatgtgttaggcaagggggtgcctacatgatcaaccttcaatataaaacacctccccctagcgaaatgtgtaaagtattcatattgtatatttttcattagtattatttaaactgacttttttttttcttttcctggctccttttctgtttctttttattaatatgctgatctgttttatcttctcacggccataaagaatgctgatgggagaaccattttcctaattttcaaattgttgagctgtttgccataatggatgatcagcaagctttgaactcaatcatgcaagatttggctgtccttcataaggccagtcgaccagcattatccttgcaggaaaccagaaaagcaaaatcttcatcaccaaaaaaacagaatgatgtccgagtcaaatttgaacatagaggagaaaaaagaatccttcagttccccagaccagttaaactggaagatctgagatctaaagctaaaattgcctttggacagtctatggatctacattataccaataacgagttggtaattccattaactactcaagatgacttggacaaagctctggaactgctggatcgtagtattcatatgaagagcctcaagatattacttgtaataaatggaagtacacaggctactaatttagaaccattgccatcactagaagatttggataatacagtatttggagcagagaggaaaaaacggctatctataataggtcctactagtagagatagaagttctcctcccccgggttacattccagatgaattacaccaggttgcccggaatgggtcattcactagtatcaacagtgaaggagagttcattccagagagcatggaacaaatgctggatccattatctttaagcagccctgaaaattctggctcaggaagttgtccatcacttgatagtcctttggatggagagagctatccaaaatcacgaatgcctagggctcagagctacccagataatcatcaggaattttcagactatgataaccctatctttgagaaatttggaaaaggaggaacatatccaagaaggtatcatgtttcatatcatcatcaagagtataatgatggtcgtaaaacttttccaagagctagaaggacccaggggaaccagcttacggtctcctgtgagtttcagtcctactgatcattccttaagcactagtagtggaagcagtatctttaccccagagtatgatgatagtcgaataagaagaaggggaagtgacatagacaatcctactttgacagtaatggacatcagcccacccagccgttcacctcgagctccgaccaactggagattgggcaaactgcttggccaaggagcctttggaagggtctacctctgttatgatgttgatacaggaagagaattggctgttaagcaagttcaatttgaccccgatagtcctgagaccagcaaggaagtaaatgcacttgagtgtgaaattcagttgctgaaaaactttctacatgagcgaattgttcagtattatggctgtttgagggatccccaggaaaaaacactttccatatttatggaatatatgccagggggttcaattaaggaccaattaaaagcatatggcgctcttactgagaatggtactaggaaatacacccgtcagattctggagggtgtccattatttgcacagtaatatgattctccaccgcgacatcaaaggcgcaaatatccttcgagattcaacaggcaacgtcaaactaggagattttggggccagcaaacggcttcagaccatctgtctctcagggacaggaatgaagtctgtcacgggcacaccatactggatgagccctgaagtcatcagtggacaaggctatggaagaaaagcagacatctggagtgttgcatgtaccgtggtagaaatgctaactgaaaagccgccttgggctgaatttgaagcaatggctgccatctttaaaatcgccactcagccaacaaacccaaagctgccacctcatgtctcagactatactcgagatttcctcaaacggatttttgtagaggccaaactgagaccttcagctgatgaactcttaaggcacatgtttgtgcattatcactagcagccagtaacctctcctgtgcctctacctagctcccatctattcattcaccttctctctgactgcacttttcttttttataaaaaaagagagagggggagaaaaaagacaagagggaaagtatttctcttgattcttggttaaattgttaataataataatatcctaatttata

SEQ ID NO: 408930 - DNA, 1162 bp, Homo sapiens
gggacgccggggacacccggttgggctctgctgctcccttctgggttccgaggcccaagcccttggcagtgtttgtgagtggaagggaggtcacgctatcgtccgcggccccagcagccctgtgccctcgttggatcccgcgacgcggctcctttaagagcctcgcgggtcgcccgccgctaggtcgctccccggccatgcgggcgctgcgggccggcctgaccctggcgttgggcgcggggctgggtgcggtcgtcgagggctggcggcggcggcgggaggacgcgcgggcggcgccgggactgctgggccggctgcccgtgctgcccgtggcggcggcagccgagttgccccctgtgcccgggggaccccgcggcccgggcgagctggccaagtacgggctgccggggctggcgcagctcaagagccgcgagtcgtacgtgctgtgctacgacccgcgcacccgcggcgcgctctgggtggtggagcagctgcgacccgagcgtctccgcggcgacggcgaccggcgcgagtgcgacttccgcgaggacgactcggtgcacgcgtaccaccgtgccaccaacgccgactaccgcggcagtggcttcgaccgcggtcacctggccgccgccgccaaccaccgctggagccagaaggccatggacgacacgttctacctgagcaacgtcgcgccccaggtgccccacctcaaccagaatgcctggaacaacctggagaaatatagccgcagcttgacccgcagctaccaaaacgtctatgtctgcacagggccactcttcctgcccaggacagaggctgatgggaaatcctacgtaaagtaccaggtcatcggcaagaaccacgtggcagtgcccacacacttcttcaaggtgctgatcctggaggcagcaggtgggcaaattgagctccgcacctacgtgatgcccaacgcacctgtggatgaggccatcccactggagcgcttcctggtgcccatcgagagcattgagcgggcttcggggctgctctttgtgccaaacatcctggcgcgggcaggcagcctcaaggccatcacggcgggcagtaagtgagggtggagcccagtgagactgtgggtgtgtgcaggccggggagtattaaaggtggtgatttttggagacaa

SEQ ID NO: 408931 - DNA, 1088 bp, Homo sapiens
gcagcgtttattgtcgcccactctgcctgacccagtgttgggcataaggaaaacagagggaaagagttaaccaccctggagagagttccagcctcaaggaggagccaggcaggctacagaagtctcacagtgagggcgtggtcctgcaggttgacagaagttagaggacagatcagggaaggctgcctggaagaggtggctttgggttcatccaggccccctgcccacgtgtgcctgggtctgcccacaggacagaggctgatgggaaatcctacgtaaagtaccaggtcatcggcaagaaccacgtggcagtgcccacacacttcttcaaggtgctgatcctggaggcagcaggtgggcaaattgagctccgcacctacgtgatgcccaacgcacctgtggatgaggccatcccactggagcgcttcctggtgcccatcgagagcattgagcgggcttcggggctgctctttgtgccaaacatcctggcgcgggcaggcagcctcaaggccatcacggcgggcagtaagtgagggtggagcccagtgagactgtgggtgtgtgcaggccggggagtattaaaggtggtgatttttggagacaaaaaaaaaaaaaaaaaaaaaaaaaaaaaaaaaaaaaaaaaaaaaaaaaaaaaaaaaaaaaagaaaagaaaagaaaaaaaaaaacaaaaaaaagaaaaagagagaggggggagcgcgcgcgccgatagacacaccctccacagtgggagggcccgaacgcacaccgcagccgcgcaccctttagaggccacaccgggggcgcgcgccacaagcatgagagagagcggctatagcattatatgatacgaacaaagagcgaacgcgcgtgcgcaggcgcaatccaatcatctaaaacagacgccacaagatacaaagctcaggcatgagaaacgccatagggcgcctgagcgggcagtcgattgggcacaccttcaggcacagagcacaaaaagaggccaaatttcgtccatgacacccaatctaggagggacgataagacgcaactatctcggtgcgagcgaaaggagaagacataacaacgccacg

SEQ ID NO: 408932 - DNA, 729 bp, Homo sapiens
ggctgggtgtgaatcggccgaggcaggctctcccgccttcagtctctgctctgcttggagcaccgcggacctgggcaggaagagtggccctgtgcaggtccgcggtgcaccaggctctcccgccttcagtctctgctctgcttggagcacttccctccacccttctcgggagtttgaatctagatctgcctgacccagggcctccactcttgctcctgtgcagccctgcctctcaggtggaagcaactgagcacctctgggtgtgctccgtggtttttctggcctgcagagggctggggctgagaggcaacaggtccaggctgagcagctcactctggaatccacaggctcgggatggagtccaggcctcatcacctagttccttggtgctgtgggcaaatgacctgtgtccccctctgcaaaacctgtgacctcttggttgatgtcacatgcttccccagggcctggtccatggtaagggctcggcataggctggccaaggcggtggttggggcactgatcaaatttcattagcaggtgcctcctagggcctggtggaagggaggagactctgctgagggggagcccccgtccggtgtcctggcacctgtgctggtgctgggatatcacctgtcatggtccttgcccacttgttgctcacctctgtggggagagatggacagtcgttaagtctcccctcagacgaatgtgaatattcagaaggctcga

SEQ ID NO: 408933 - DNA, 1646 bp, Homo sapiens
gggacgccggggacacccggttgggctctgctgctcccttctgggttccgaggcccaagcccttggcagtgtttgtgagtggaagggaggtcacgctatcgtccgcggccccagcagccctgtgccctcgttggatcccgcgacgcggctcctttaagagcctcgcgggtcgcccgccgctaggtcgctccccggccatgcgggcgctgcgggccggcctgaccctggcgttgggcgcggggctgggtgcggtcgtcgagggctggcggcggcggcgggaggacgcgcgggcggcgccgggactgctgggccggctgcccgtgctgcccgtggcggcggcagccgagttgccccctgtgcccgggggaccccgcggcccgggcgagctggccaagtacgggctgccggggctggcgcagctcaagagccgcgagtcgtacgtgctgtgctacgacccgcgcacccgcggcgcgctctgggtggtggagcagctgcgacccgagcgtctccgcggcgacggcgaccggcgcgagtgcgacttccgcgaggacgactcggtgcacgcgtaccaccgtgccaccaacgccgactaccgcggcagtggcttcgaccgcggtcacctggccgccgccgccaaccaccgctggagccagaaggccatggacgacacgttctacctgagcaacgtcgcgccccaggtgccccacctcaaccagaatgcctggaacaacctggagaaatatagccgcagcttgacccgcagctaccaaaacgtctatgtctgcacagggccactcttcctgcccaggacagaggctgatgggaaatcctacgtaaagtaccaggtcatcggcaagaaccacgtggcagtgcccacacacttcttcaaggtgctgatcctggaggcagcaggtgggcaaattgagctccgcacctacgtgatgcccaacgcacctgtggatgaggccatcccactggagcgcttcctggtgcccatcgagagcattgagcgggcttcggggctgctctttgtgccaaacatcctggcgcgggcaggcagcctcaaggccatcacggcgggcagtaagtgagggtggagcccagtgagactgtgggtgtgtgcaggccggggagtattaaaggtggtgatttttggagacaaaaaaaaaaaaaaaaaaaaaaaaaaaaaaaaaaaaaaaaaaaaaaaaaaaaaaaaaaaaaagaaaagaaaagaaaaaaaaaaacaaaaaaaagaaaaagagagaggggggagcgcgcgcgccgatagacacaccctccacagtgggagggcccgaacgcacaccgcagccgcgcaccctttagaggccacaccgggggcgcgcgccacaagcatgagagagagcggctatagcattatatgatacgaacaaagagcgaacgcgcgtgcgcaggcgcaatccaatcatctaaaacagacgccacaagatacaaagctcaggcatgagaaacgccatagggcgcctgagcgggcagtcgattgggcacaccttcaggcacagagcacaaaaagaggccaaatttcgtccatgacacccaatctaggagggacgataagacgcaactatctcggtgcgagcgaaaggagaagacataacaacgccacg

SEQ ID NO: 408934 - DNA, 828 bp, Homo sapiens
ggctgggtgtgaatcggccgaggcaggctctcccgccttcagtctctgctctgcttggagcaccgcggacctgggcaggaagagtggccctgtgcaggtccgcggtgcaccaggctctcccgccttcagtctctgctctgcttggagcacttccctccacccttctcgggagtttgaatctagatctgcctgacccagggcctccactcttgctcctgtgcagccctgcctctcaggtggaagcaactgagcacctctgggtgtgctccgtggtttttctggcctgcagagggctggggctgagaggcaacaggtccaggctgagcagctcactctggaatccacaggctcgggatggagtccaggcctcatcacctagttccttggtgctgtgggcaaatgacctgtgtccccctctgcaaaacctgtgacctcttggttgatgtcacatgcttccccagggcctggtccatggacagaggctgatgggaaatcctacgtaaagtaccaggtcatcggcaagaaccacgtggcagtgcccacacacttcttcaaggtgctgatcctggaggcagcaggtgggcaaattgagctccgcacctacgtgatgcccaacgcacctgtggatgaggccatcccactggagcgcttcctggtgcccatcgagagcattgagcgggcttcggggctgctctttgtgccaaacatcctggcgcgggcaggcagcctcaaggccatcacggcgggcagtaagtgagggtggagcccagtgagactgtgggtgtgtgcaggccggggagtattaaaggtggtgatttttggagacaa

SEQ ID NO: 408935 - DNA, 432 bp, Homo sapiens
tgagagaagggcaagggagaagggagcgtagatgtttttcccaggagtccaccttgtacgtcattcctaatatgaacaccctatgtttattataaaaagaactctcatatactttatcttatttgttctagtctcacaaattggcgaggcctcaatcaagttgtagtccaggtgctttctttggagggaaagggctatgagcgcacatcttctaagtacacgacatcagcagtgtagtacgtgcaccatgccttacaagtgagacacaaaaaatttattggtagtaaacttcctataatagacattaccagcctaagacttcctgagaaagacaccctgtcaatcatctgatcagacctgtacttgcacagagctctgctcaagctatgagttcaataactgtttgttgcattatacttgactccaactttg

SEQ ID NO: 408936 - DNA, 4341 bp, Homo sapiens
  misc_feature (3766)..(3767): n is a, c, g, or t
  misc_feature (3991)..(3991): n is a, c, g, or t
  misc_feature (4017)..(4017): n is a, c, g, or t
  misc_feature (4070)..(4070): n is a, c, g, or t
  misc_feature (4077)..(4077): n is a, c, g, or t
  misc_feature (4176)..(4176): n is a, c, g, or t
  misc_feature (4281)..(4281): n is a, c, g, or t
cgtgaggcttggtaggactgcggacggtgagtggggatggactggagttgaagagctcgagatgaagggcttgagggcgtgtgttatttgttttcttcaagcatttggtcgagattaagaattaaaaatgtcatccaaacaagaaataatgagtgaccagcggtttagacgggttgcaaaggacccgagattttgggaaatgccagaaaaggatcgaaaagtcaaaattgacaagagatttcgagccatgtttcatgacaagaagttcaagttgaactatgccgtggataaaagagggcgccccattagccatagcactacagaggatttgaagcgtttttacgacctttcagattctgattccaatctctctggtgaagatagcaaagcattgagtcaaaagaaaataaagaagaaaaaaacccagactaaaaaagaaatcgattcaaaaaatctagttgagaaaaagaaagaaaccaagaaggctaatcacaagggttctgaaaataaaactgatttagataattctataggaattaaaaaaatgaaaacctcatgtaaatttaagatagattcaaacataagtccgaagaaggatagcaaagaatttacacaaaaaaataagaaagagaaaaaaaacattgttcaacatactacagactcttctctcgaagaaaaacaaaggacattagactcaggcacctctgaaattgtgaaatctcccagaatcgagtgttctaagacaagaagagaaatgcaatcagtggttcaactcataatgacaagagacagtgatggttatgaaaactcaacagatggtgaaatgtgtgacaaagatgctctggaggaagattcagaaagcgttagtgaaataggaagtgatgaggaatctgaaaatgaaattacaagtgttggtagagcttcaggtgatgacgatggaagtgaagatgatgaagaggaggatgaagatgaagaggaggatgaagatgaggatagtgaggatgatgataaaagtgacagtggccctgatcttgcaaggggtaaaggaaatatagaaactagttctgaagatgaagatgatacggcagatttgtttccagaagaatctggttttgagcatgcttggagagaattagataaagatgctcctcgtgctgatgagattacacgtcgattagcagtttgtaacatggactgggatagattaaaggcaaaagatttgctggctctgttcaattcatttaaacccaaaggaggtgtaatattttccgtcaagatatatccttcagaatttggaaaggagaggatgaaggaagagcaagttcaaggaccagtagagctattaagtattcctgaagatgccccagaaaaagactggacgtctagagaaaaattgagagattatcaattcaaacgactgaagtactattatgcagtagtagactgtgattctccggaaacagctagtaaaatttatgaggattgtgatggcctggaatttgaaagtagttgttctttcatagatctaaggtttataccagatgatattacttttgatgatgagcctaaggatgtagcctcagaagtgaatttaacagcatataaaccaaaatatttcacttctgctgcaatgggaacatcaacggtggaaatcacttgggatgagactgatcatgaaagaattacaatgctcaacaggaagtttaaaaaggaagagcttttggacatggattttcaagcctacttagcttcctctagtgaagatgaagaggagatagaagaggagctacaaggtgatgatggagtcaatgtagaagaagatgggaaaacaaagaaaagtcagaaggatgatgaagaacaaattgctaaatacaggcagctcttgcaggttattcaagaaaaagaaaagaaaggcaaagaaaatgatatggaaatggaaattaaatgggttccaggtcttaaagaaagtgcagaagagatggtcaaaaacaaattggaaggaaaggataaactgaccccttgggaacaatttttagagaagaagaaagagaaaaaaagactgaaaaggaaacagaaggctcttgctgaagaggccagtgaagaggaacttccctctgatgttgatttgaatgacccatactttgctgaagaagttaaacaaataggtataaataaaaaatcggtaaaatctgcaaaagatggcacatctccagaagaagaaattgaaatagaaagacaaaaggctgaaatggctttgcttatgatggatgaggacgaggacagtaagaaacacttcaattacaacaagattgtggagcaccagaatctgagcaaaaagaagaaaaagcagctcatgaaaaagaaggaattaatagaggatgactttgaggtaaatgttaacgatgcacggtttcaggcaatgtacacttcccacttgttcaatttggacccctcagatcccaatttcaagaaaacaaaagctatggaaaaaatccttgaggagaaggcccggcaaagagaacgaaaagaacaagaacttactcaggcaataaagaaaaaagagagtgagattgaaaaggaatcacaaaggaagtccattgatcctgctttgtcaatgttgattaaatctataaaaaccaaaacagagcagtttcaagcaagaaaaaagcaaaaagtcaaataactggatgttacttatttttgaactgaatacatcttttcctaaaatgtacaaaaatagtaggagggaatatttattgggaacaaagctatctttcaagaacatgaataaaatctttttctggacatagtaaaatttttctccataaataattgtacttaattgtggatgactgacaaatttttattgtatattcctacagatcagtcataattaaattacctgcattatagggtttataaaatttttatattttacaatgttcagttctaactagtggaaagttactctagctttttaaaaggctgtttacaattctgtgtaaaaatagagcagtatctactcaagtttgtgtaaatgttagggataatttgaaaaatatatatatttaatacattaatttctctggaagcaggaggcatgtttaaataactattaaaataatttatttttctagccataaaggatggaagtcaagaactttttgttgtttagtcatgttaagtatagtttatgaaattaacttgtaaataaaagtgtaaaatattttcattattttgtatagcactgatttattccattttatgcatctcaaagtactctctggaaaaatatctgaaaaccgattttaactttttaagaggacaactccatttaaaggcagttctagagttgcattgctcgtaaattgcatttgaaatattcatgagctctccagtggtttttctgtttggtagcaacagaaaagtcttctgtctgtccttcacatttttggaatactttagaaggatggatatgctgctgtagagtttaaggataccttaattcttcttaaaattaaaacacatctttaaggccttaacactcttggatctcatctggtctaaatattatagacaactgacagtcaaattagatatgctgtataagtaaatgtaaataaaaccagacttgtaacttggagcaaattataaatatggtaacttctgaaagacaacaggaatttgaccaggtttgtggttaaacttgacatttggggtattaaaaatcaaacctactgaccaggcaaggtggctctcacctgtnntcccagcactttgggaggctgaggcaggagaattgcttgaggccaggagttttgagaccaacctgggcaatatagtaagaccataggctgggtgtggtagcctacgcctgtaatccccccactttgggagactgaggcaggcacatcacttgaggtcaggagttcaagaccaggctggccaacacagtgagaccccccatctctaccgaaactacaaaaaattngccgggcgtgatggtgcatgcctgtngtcccagctactcaggaggctgaagcaggagaatcacttgaacttgggaggcngaggttncagtgagccgagattgagccactgcactccagcctgggcaacaggagaccctgtctcaaaatatatatatatacacgtctgtgtgtgtgtgcgcgcacncgtgcgtataacaagccaagtgtggtgatacatacctgtggtccttgctactcaggaggctgagatgggaggatcatatgagcccaggagtttgagtttacagtnagctgtgattgtatcactgcattccagcctgggtgacagagcaagaccctgtctctattt

SEQ ID NO: 408937 - DNA, 3232 bp, Homo sapiens
cgtgaggcttggtaggactgcggacggtgagtggggatggactggagttgaagagctcgagatgaagggcttgagggcgtgtgttatttgttttcttcaagcatttggtcgagattaagaattaaaaatgtcatccaaacaagaaataatgagtgaccagcggtttagacgggttgcaaaggacccgagattttgggaaatgccagaaaaggatcgaaaagtcaaaattgacaagagatttcgagccatgtttcatgacaagaagttcaagttgaactatgccgtggataaaagagggcgccccattagccatagcactacagaggatttgaagcgtttttacgacctttcagattctgattccaatctctctggtgaagatagcaaagcattgagtcaaaagaaaataaagaagaaaaaaacccagactaaaaaagaaatcgattcaaaaaatctagttgagaaaaagaaagaaaccaagaaggctaatcacaagggttctgaaaataaaactgatttagataattctataggaattaaaaaaatgaaaacctcatgtaaatttaagatagattcaaacataagtccgaagaaggatagcaaagaatttacacaaaaaaataagaaagagaaaaaaaacattgttcaacatactacagactcttctctcgaagaaaaacaaaggacattagactcaggcacctctgaaattgtgaaatctcccagaatcgagtgttctaagacaagaagagaaatgcaatcagtggttcaactcataatgacaagagacagtgatggttatgaaaactcaacagatggtgaaatgtgtgacaaagatgctctggaggaagattcagaaagcgttagtgaaataggaagtgatgaggaatctgaaaatgaaattacaagtgttggtagagcttcaggtgatgacgatggaagtgaagatgatgaagaggaggatgaagatgaagaggaggatgaagatgaggatagtgaggatgatgataaaagtgacagtggccctgatcttgcaaggggtaaaggaaatatagaaactagttctgaagatgaagatgatacggcagatttgtttccagaagaatctggttttgagcatgcttggagagaattagataaagatgctcctcgtgctgatgagattacacgtcgattagcagtttgtaacatggactgggatagattaaaggcaaaagatttgctggctctgttcaattcatttaaacccaaaggaggtgtaatattttccgtcaagatatatccttcagaatttggaaaggagaggatgaaggaagagcaagttcaaggaccagtagagctattaagtattcctgaagatgccccagaaaaagactggacgtctagagaaaaattgagagattatcaattcaaacgactgaagtactattatgcagtagtagactgtgattctccggaaacagctagtaaaatttatgaggattgtgatggcctggaatttgaaagtagttgttctttcatagatctaaggtttataccagatgatattacttttgatgatgagcctaaggatgtagcctcagaagtgaatttaacagcatataaaccaaaatatttcacttctgctgcaatgggaacatcaacggtggaaatcacttgggatgagactgatcatgaaagaattacaatgctcaacaggaagtttaaaaaggaagagcttttggacatggattttcaagcctacttagcttcctctagtgaagatgaagaggagatagaagaggagctacaaggtgatgatggagtcaatgtagaagaagatgggaaaacaaagaaaagtcagaaggatgatgaagaacaaattgctaaatacaggcagctcttgcaggttattcaagaaaaagaaaagaaaggcaaagaaaatgatatggaaatggaaattaaatgggttccaggtcttaaagaaagtgcagaagagatggtcaaaaacaaattggaaggaaaggataaactgaccccttgggaacaatttttagagaagaagaaagagaaaaaaagactgaaaaggaaacagaaggctcttgctgaagaggccagtgaagaggaacttccctctgatgttgatttgaatgacccatactttgctgaagaagttaaacaaataggtataaataaaaaatcggtaaaatctgcaaaagatggcacatctccagaagaagaaattgaaatagaaagacaaaaggctgaaatggctttgcttatgatggatgaggacgaggacagtaagaaacacttcaattacaacaagattgtggagcaccagaatctgagcaaaaagaagaaaaagcagctcatgaaaaagaaggaattaatagaggatgactttgaggtaaatgttaacgatgcacggtttcaggcaatgtacacttcccacttgttcaatttggacccctcagatcccaatttcaagaaaacaaaagctatggaaaaaatccttgaggagaaggcccggcaaagagaacgaaaagaacaagaacttactcaggcaataaagaaaaaagagagtgagattgaaaaggaatcacaaaggaagtccattgatcctgctttgtcaatgttgattaaatctataaaaaccaaaacagagcagtttcaagcaagaaaaaagcaaaaagtcaaataactggatgttacttatttttgaactgaatacatcttttcctaaaatgtacaaaaatagtaggagggaatatttattgggaacaaagctatctttcaagaacatgaataaaatctttttctggacatagtaaaatttttctccataaataattgtacttaattgtggatgactgacaaatttttattgtatattcctacagatcagtcataattaaattacctgcattatagggtttataaaatttttatattttacaatgttcagttctaactagtggaaagttactctagctttttaaaaggctgtttacaattctgtgtaaaaatagagcagtatctactcaagtttgtgtaaatgttagggataatttgaaaaatatatatatttaatacattaatttctctggaagcaggaggcatgtttaaataactattaaaataatttatttttctagccataaaggatggaagtcaagaactttttgttgtttagtcatgttaagtatagtttatgaaattaacttgtaaataaaagtgtaaaatattttca

SEQ ID NO: 408938 - DNA, 2727 bp, Homo sapiens
cgtgaggcttggtaggactgcggacggtgagtggggatggactggagttgaagagctcgagatgaagggcttgagggcgtgtgttatttgttttcttcaagcatttggtcgagattaagaattaaaaatgtcatccaaacaagaaataatgagtgaccagcggtttagacgggttgcaaaggacccgagattttgggaaatgccagaaaaggatcgaaaagtcaaaattgacaagagatttcgagccatgtttcatgacaagaagttcaagttgaactatgccgtggataaaagagggcgccccattagccatagcactacagaggatttgaagcgtttttacgacctttcagattctgattccaatctctctggtgaagatagcaaagcattgagtcaaaagaaaataaagaagaaaaaaacccagactaaaaaagaaatcgattcaaaaaatctagttgagaaaaagaaagaaaccaagaaggctaatcacaagggttctgaaaataaaactgatttagataattctataggaattaaaaaaatgaaaacctcatgtaaatttaagatagattcaaacataagtccgaagaaggatagcaaagaatttacacaaaaaaataagaaagagaaaaaaaacattgttcaacatactacagactcttctctcgaagaaaaacaaaggacattagactcaggcacctctgaaattgtgaaatctcccagaatcgagtgttctaagacaagaagagaaatgcaatcagtggttcaactcataatgacaagagacagtgatggttatgaaaactcaacagatggtgaaatgtgtgacaaagatgctctggaggaagattcagaaagcgttagtgaaataggaagtgatgaggaatctgaaaatgaaattacaagtgttggtagagcttcaggtgatgacgatggaagtgaagatgatgaagaggaggatgaagatgaagaggaggatgaagatgaggatagtgaggatgatgataaaagtgacagtggccctgatcttgcaaggggtaaaggaaatatagaaactagttctgaagatgaagatgatacggcagatttgtttccagaagaatctggttttgagcatgcttggagagaattagataaagatgctcctcgtgctgatgagattacacgtcgattagcagtttgtaacatggactgggatagattaaaggcaaaagatttgctggctctgttcaattcatttaaacccaaaggaggtgtaatattttccgtcaagatatatccttcagaatttggaaaggagaggatgaaggaagagcaagttcaaggaccagtagagctattaagtattcctgaagatgccccagaaaaagactggacgtctagagaaaaattgagagattatcaattcaaacgactgaagtactattatgcagtagtagactgtgattctccggaaacagctagtaaaatttatgaggattgtgatggcctggaatttgaaagtagttgttctttcatagatctaaggtttataccagatgatattacttttgatgatgagcctaaggatgtagcctcagaagtgaatttaacagcatataaaccaaaatatttcacttctgctgcaatgggaacatcaacggtggaaatcacttgggatgagactgatcatgaaagaattacaatgctcaacaggaagtttaaaaaggaagagcttttggacatggattttcaagcctacttagcttcctctagtgaagatgaagaggagatagaagaggagctacaaggtgatgatggagtcaatgtagaagaagatgggaaaacaaagaaaagtcagaaggatgatgaagaacaaattgctaaatacaggcagctcttgcaggttattcaagaaaaagaaaagaaaggcaaagaaaatgatatggaaatggaaattaaatgggttccaggtcttaaagaaagtgcagaagagatggtcaaaaacaaattggaaggaaaggataaactgaccccttgggaacaatttttagagaagaagaaagagaaaaaaagactgaaaaggaaacagaaggctcttgctgaagaggccagtgaagaggaacttccctctgatgttgatttgaatgacccatactttgctgaagaagttaaacaaataggtataaataaaaaatcggtaaaatctgcaaaagatggcacatctccagaagaagaaattgaaatagaaagacaaaaggctgaaatggctttgcttatgatggatgaggacgaggacagtaagaaacacttcaattacaacaagattgtggagcaccagaatctgagcaaaaagaagaaaaagcagctcatgaaaaagaaggaattaatagaggatgactttgaggtaaatgttaacgatgcacggtttcaggcaatgtacacttcccacttgttcaatttggacccctcagatcccaatttcaagaaaacaaaagctatggaaaaaatccttgaggagaaggcccggcaaagagaacgaaaagaacaagaacttactcagaatctaagcaaaagaagaaaaagcagctcatgaaaaagaaggaattaatagaggatgactttgaggtaaatgttaacgatgcacggtttcaggcaatgtacacttcccacttgttcaatttggacccctcagatcccaatttcaagaaaacaaagctatggaaaaaatccttgaggagaagg

SEQ ID NO: 408939 - DNA, 636 bp, Homo sapiens
tgagagaagggcaagggagaagggagcgtagatgtttttcccaggagtccaccttgtacgtcattcctaatatgaacaccctatgtttattataaaaagaactctcatatactttatcttatttgttctagtctcacaaattggcgaggcctcaatcaagttgtagtccaggtgctttctttggagggaaagggctatgagcgcacatcttctaagtacacgacatcagcagtgtagtacgtgcaccatgccttacaatatttgttttcttcaagcatttggtcgagattaagaattaaaaatgtcatccaaacaagaaataatgagtgaccagcggtttagacgggttgcaaaggacccgagattttgggaaatgccagaaaaggatcgaaaagtcaaaattgacaagagatttcgagccatgtttcatgacaagaagttcaagttgaactatgccgtggataaaagagggcgccccattagccatagcactacagaggatttgaagcgtttttacgacctttcagattctgattccaatctctctggtgaagatagcaaagcattgagtcaaaagaaaataaagaagaaaaaaacccagactaaaaaagaaatcgattcaaaaaatctagttga

SEQ ID NO: 408940 - DNA, 4283 bp, Homo sapiens
  misc_feature (3708)..(3709): n is a, c, g, or t
  misc_feature (3933)..(3933): n is a, c, g, or t
  misc_feature (3959)..(3959): n is a, c, g, or t
  misc_feature (4012)..(4012): n is a, c, g, or t
  misc_feature (4019)..(4019): n is a, c, g, or t
  misc_feature (4118)..(4118): n is a, c, g, or t
  misc_feature (4223)..(4223): n is a, c, g, or t
cgtgaggcttggtaggactgcggacgtatttgttttcttcaagcatttggtcgagattaagaattaaaaatgtcatccaaacaagaaataatgagtgaccagcggtttagacgggttgcaaaggacccgagattttgggaaatgccagaaaaggatcgaaaagtcaaaattgacaagagatttcgagccatgtttcatgacaagaagttcaagttgaactatgccgtggataaaagagggcgccccattagccatagcactacagaggatttgaagcgtttttacgacctttcagattctgattccaatctctctggtgaagatagcaaagcattgagtcaaaagaaaataaagaagaaaaaaacccagactaaaaaagaaatcgattcaaaaaatctagttgagaaaaagaaagaaaccaagaaggctaatcacaagggttctgaaaataaaactgatttagataattctataggaattaaaaaaatgaaaacctcatgtaaatttaagatagattcaaacataagtccgaagaaggatagcaaagaatttacacaaaaaaataagaaagagaaaaaaaacattgttcaacatactacagactcttctctcgaagaaaaacaaaggacattagactcaggcacctctgaaattgtgaaatctcccagaatcgagtgttctaagacaagaagagaaatgcaatcagtggttcaactcataatgacaagagacagtgatggttatgaaaactcaacagatggtgaaatgtgtgacaaagatgctctggaggaagattcagaaagcgttagtgaaataggaagtgatgaggaatctgaaaatgaaattacaagtgttggtagagcttcaggtgatgacgatggaagtgaagatgatgaagaggaggatgaagatgaagaggaggatgaagatgaggatagtgaggatgatgataaaagtgacagtggccctgatcttgcaaggggtaaaggaaatatagaaactagttctgaagatgaagatgatacggcagatttgtttccagaagaatctggttttgagcatgcttggagagaattagataaagatgctcctcgtgctgatgagattacacgtcgattagcagtttgtaacatggactgggatagattaaaggcaaaagatttgctggctctgttcaattcatttaaacccaaaggaggtgtaatattttccgtcaagatatatccttcagaatttggaaaggagaggatgaaggaagagcaagttcaaggaccagtagagctattaagtattcctgaagatgccccagaaaaagactggacgtctagagaaaaattgagagattatcaattcaaacgactgaagtactattatgcagtagtagactgtgattctccggaaacagctagtaaaatttatgaggattgtgatggcctggaatttgaaagtagttgttctttcatagatctaaggtttataccagatgatattacttttgatgatgagcctaaggatgtagcctcagaagtgaatttaacagcatataaaccaaaatatttcacttctgctgcaatgggaacatcaacggtggaaatcacttgggatgagactgatcatgaaagaattacaatgctcaacaggaagtttaaaaaggaagagcttttggacatggattttcaagcctacttagcttcctctagtgaagatgaagaggagatagaagaggagctacaaggtgatgatggagtcaatgtagaagaagatgggaaaacaaagaaaagtcagaaggatgatgaagaacaaattgctaaatacaggcagctcttgcaggttattcaagaaaaagaaaagaaaggcaaagaaaatgatatggaaatggaaattaaatgggttccaggtcttaaagaaagtgcagaagagatggtcaaaaacaaattggaaggaaaggataaactgaccccttgggaacaatttttagagaagaagaaagagaaaaaaagactgaaaaggaaacagaaggctcttgctgaagaggccagtgaagaggaacttccctctgatgttgatttgaatgacccatactttgctgaagaagttaaacaaataggtataaataaaaaatcggtaaaatctgcaaaagatggcacatctccagaagaagaaattgaaatagaaagacaaaaggctgaaatggctttgcttatgatggatgaggacgaggacagtaagaaacacttcaattacaacaagattgtggagcaccagaatctgagcaaaaagaagaaaaagcagctcatgaaaaagaaggaattaatagaggatgactttgaggtaaatgttaacgatgcacggtttcaggcaatgtacacttcccacttgttcaatttggacccctcagatcccaatttcaagaaaacaaaagctatggaaaaaatccttgaggagaaggcccggcaaagagaacgaaaagaacaagaacttactcaggcaataaagaaaaaagagagtgagattgaaaaggaatcacaaaggaagtccattgatcctgctttgtcaatgttgattaaatctataaaaaccaaaacagagcagtttcaagcaagaaaaaagcaaaaagtcaaataactggatgttacttatttttgaactgaatacatcttttcctaaaatgtacaaaaatagtaggagggaatatttattgggaacaaagctatctttcaagaacatgaataaaatctttttctggacatagtaaaatttttctccataaataattgtacttaattgtggatgactgacaaatttttattgtatattcctacagatcagtcataattaaattacctgcattatagggtttataaaatttttatattttacaatgttcagttctaactagtggaaagttactctagctttttaaaaggctgtttacaattctgtgtaaaaatagagcagtatctactcaagtttgtgtaaatgttagggataatttgaaaaatatatatatttaatacattaatttctctggaagcaggaggcatgtttaaataactattaaaataatttatttttctagccataaaggatggaagtcaagaactttttgttgtttagtcatgttaagtatagtttatgaaattaacttgtaaataaaagtgtaaaatattttcattattttgtatagcactgatttattccattttatgcatctcaaagtactctctggaaaaatatctgaaaaccgattttaactttttaagaggacaactccatttaaaggcagttctagagttgcattgctcgtaaattgcatttgaaatattcatgagctctccagtggtttttctgtttggtagcaacagaaaagtcttctgtctgtccttcacatttttggaatactttagaaggatggatatgctgctgtagagtttaaggataccttaattcttcttaaaattaaaacacatctttaaggccttaacactcttggatctcatctggtctaaatattatagacaactgacagtcaaattagatatgctgtataagtaaatgtaaataaaaccagacttgtaacttggagcaaattataaatatggtaacttctgaaagacaacaggaatttgaccaggtttgtggttaaacttgacatttggggtattaaaaatcaaacctactgaccaggcaaggtggctctcacctgtnntcccagcactttgggaggctgaggcaggagaattgcttgaggccaggagttttgagaccaacctgggcaatatagtaagaccataggctgggtgtggtagcctacgcctgtaatccccccactttgggagactgaggcaggcacatcacttgaggtcaggagttcaagaccaggctggccaacacagtgagaccccccatctctaccgaaactacaaaaaattngccgggcgtgatggtgcatgcctgtngtcccagctactcaggaggctgaagcaggagaatcacttgaacttgggaggcngaggttncagtgagccgagattgagccactgcactccagcctgggcaacaggagaccctgtctcaaaatatatatatatacacgtctgtgtgtgtgtgcgcgcacncgtgcgtataacaagccaagtgtggtgatacatacctgtggtccttgctactcaggaggctgagatgggaggatcatatgagcccaggagtttgagtttacagtnagctgtgattgtatcactgcattccagcctgggtgacagagcaagaccctgtctctattt

SEQ ID NO: 408941 - DNA, 4515 bp, Homo sapiens
  misc_feature (3940)..(3941): n is a, c, g, or t
  misc_feature (4165)..(4165): n is a, c, g, or t
  misc_feature (4191)..(4191): n is a, c, g, or t
  misc_feature (4244)..(4244): n is a, c, g, or t
  misc_feature (4251)..(4251): n is a, c, g, or t
  misc_feature (4350)..(4350): n is a, c, g, or t
  misc_feature (4455)..(4455): n is a, c, g, or t
tgagagaagggcaagggagaagggagcgtagatgtttttcccaggagtccaccttgtacgtcattcctaatatgaacaccctatgtttattataaaaagaactctcatatactttatcttatttgttctagtctcacaaattggcgaggcctcaatcaagttgtagtccaggtgctttctttggagggaaagggctatgagcgcacatcttctaagtacacgacatcagcagtgtagtacgtgcaccatgccttacaatatttgttttcttcaagcatttggtcgagattaagaattaaaaatgtcatccaaacaagaaataatgagtgaccagcggtttagacgggttgcaaaggacccgagattttgggaaatgccagaaaaggatcgaaaagtcaaaattgacaagagatttcgagccatgtttcatgacaagaagttcaagttgaactatgccgtggataaaagagggcgccccattagccatagcactacagaggatttgaagcgtttttacgacctttcagattctgattccaatctctctggtgaagatagcaaagcattgagtcaaaagaaaataaagaagaaaaaaacccagactaaaaaagaaatcgattcaaaaaatctagttgagaaaaagaaagaaaccaagaaggctaatcacaagggttctgaaaataaaactgatttagataattctataggaattaaaaaaatgaaaacctcatgtaaatttaagatagattcaaacataagtccgaagaaggatagcaaagaatttacacaaaaaaataagaaagagaaaaaaaacattgttcaacatactacagactcttctctcgaagaaaaacaaaggacattagactcaggcacctctgaaattgtgaaatctcccagaatcgagtgttctaagacaagaagagaaatgcaatcagtggttcaactcataatgacaagagacagtgatggttatgaaaactcaacagatggtgaaatgtgtgacaaagatgctctggaggaagattcagaaagcgttagtgaaataggaagtgatgaggaatctgaaaatgaaattacaagtgttggtagagcttcaggtgatgacgatggaagtgaagatgatgaagaggaggatgaagatgaagaggaggatgaagatgaggatagtgaggatgatgataaaagtgacagtggccctgatcttgcaaggggtaaaggaaatatagaaactagttctgaagatgaagatgatacggcagatttgtttccagaagaatctggttttgagcatgcttggagagaattagataaagatgctcctcgtgctgatgagattacacgtcgattagcagtttgtaacatggactgggatagattaaaggcaaaagatttgctggctctgttcaattcatttaaacccaaaggaggtgtaatattttccgtcaagatatatccttcagaatttggaaaggagaggatgaaggaagagcaagttcaaggaccagtagagctattaagtattcctgaagatgccccagaaaaagactggacgtctagagaaaaattgagagattatcaattcaaacgactgaagtactattatgcagtagtagactgtgattctccggaaacagctagtaaaatttatgaggattgtgatggcctggaatttgaaagtagttgttctttcatagatctaaggtttataccagatgatattacttttgatgatgagcctaaggatgtagcctcagaagtgaatttaacagcatataaaccaaaatatttcacttctgctgcaatgggaacatcaacggtggaaatcacttgggatgagactgatcatgaaagaattacaatgctcaacaggaagtttaaaaaggaagagcttttggacatggattttcaagcctacttagcttcctctagtgaagatgaagaggagatagaagaggagctacaaggtgatgatggagtcaatgtagaagaagatgggaaaacaaagaaaagtcagaaggatgatgaagaacaaattgctaaatacaggcagctcttgcaggttattcaagaaaaagaaaagaaaggcaaagaaaatgatatggaaatggaaattaaatgggttccaggtcttaaagaaagtgcagaagagatggtcaaaaacaaattggaaggaaaggataaactgaccccttgggaacaatttttagagaagaagaaagagaaaaaaagactgaaaaggaaacagaaggctcttgctgaagaggccagtgaagaggaacttccctctgatgttgatttgaatgacccatactttgctgaagaagttaaacaaataggtataaataaaaaatcggtaaaatctgcaaaagatggcacatctccagaagaagaaattgaaatagaaagacaaaaggctgaaatggctttgcttatgatggatgaggacgaggacagtaagaaacacttcaattacaacaagattgtggagcaccagaatctgagcaaaaagaagaaaaagcagctcatgaaaaagaaggaattaatagaggatgactttgaggtaaatgttaacgatgcacggtttcaggcaatgtacacttcccacttgttcaatttggacccctcagatcccaatttcaagaaaacaaaagctatggaaaaaatccttgaggagaaggcccggcaaagagaacgaaaagaacaagaacttactcaggcaataaagaaaaaagagagtgagattgaaaaggaatcacaaaggaagtccattgatcctgctttgtcaatgttgattaaatctataaaaaccaaaacagagcagtttcaagcaagaaaaaagcaaaaagtcaaataactggatgttacttatttttgaactgaatacatcttttcctaaaatgtacaaaaatagtaggagggaatatttattgggaacaaagctatctttcaagaacatgaataaaatctttttctggacatagtaaaatttttctccataaataattgtacttaattgtggatgactgacaaatttttattgtatattcctacagatcagtcataattaaattacctgcattatagggtttataaaatttttatattttacaatgttcagttctaactagtggaaagttactctagctttttaaaaggctgtttacaattctgtgtaaaaatagagcagtatctactcaagtttgtgtaaatgttagggataatttgaaaaatatatatatttaatacattaatttctctggaagcaggaggcatgtttaaataactattaaaataatttatttttctagccataaaggatggaagtcaagaactttttgttgtttagtcatgttaagtatagtttatgaaattaacttgtaaataaaagtgtaaaatattttcattattttgtatagcactgatttattccattttatgcatctcaaagtactctctggaaaaatatctgaaaaccgattttaactttttaagaggacaactccatttaaaggcagttctagagttgcattgctcgtaaattgcatttgaaatattcatgagctctccagtggtttttctgtttggtagcaacagaaaagtcttctgtctgtccttcacatttttggaatactttagaaggatggatatgctgctgtagagtttaaggataccttaattcttcttaaaattaaaacacatctttaaggccttaacactcttggatctcatctggtctaaatattatagacaactgacagtcaaattagatatgctgtataagtaaatgtaaataaaaccagacttgtaacttggagcaaattataaatatggtaacttctgaaagacaacaggaatttgaccaggtttgtggttaaacttgacatttggggtattaaaaatcaaacctactgaccaggcaaggtggctctcacctgtnntcccagcactttgggaggctgaggcaggagaattgcttgaggccaggagttttgagaccaacctgggcaatatagtaagaccataggctgggtgtggtagcctacgcctgtaatccccccactttgggagactgaggcaggcacatcacttgaggtcaggagttcaagaccaggctggccaacacagtgagaccccccatctctaccgaaactacaaaaaattngccgggcgtgatggtgcatgcctgtngtcccagctactcaggaggctgaagcaggagaatcacttgaacttgggaggcngaggttncagtgagccgagattgagccactgcactccagcctgggcaacaggagaccctgtctcaaaatatatatatatacacgtctgtgtgtgtgtgcgcgcacncgtgcgtataacaagccaagtgtggtgatacatacctgtggtccttgctactcaggaggctgagatgggaggatcatatgagcccaggagtttgagtttacagtnagctgtgattgtatcactgcattccagcctgggtgacagagcaagaccctgtctctattt

SEQ ID NO: 408942 - DNA, 2422 bp, Homo sapiens
  misc_feature (1847)..(1848): n is a, c, g, or t
  misc_feature (2072)..(2072): n is a, c, g, or t
  misc_feature (2098)..(2098): n is a, c, g, or t
  misc_feature (2151)..(2151): n is a, c, g, or t
  misc_feature (2158)..(2158): n is a, c, g, or t
  misc_feature (2257)..(2257): n is a, c, g, or t
  misc_feature (2362)..(2362): n is a, c, g, or t
tgaaagacatcttgattttggacttctggactccggaactgtgagagatgaagttatattaatttaagccaccaagtttgtggtaatttgttacagagccggaggaccccagtagggagagagtaccgatggagatggggctgaaaaggaaacagaaggctcttgctgaagaggccagtgaagaggaacttccctctgatgttgatttgaatgacccatactttgctgaagaagttaaacaaataggtataaataaaaaatcggtaaaatctgcaaaagatggcacatctccagaagaagaaattgaaatagaaagacaaaaggctgaaatggctttgcttatgatggatgaggacgaggacagtaagaaacacttcaattacaacaagattgtggagcaccagaatctgagcaaaaagaagaaaaagcagctcatgaaaaagaaggaattaatagaggatgactttgaggtaaatgttaacgatgcacggtttcaggcaatgtacacttcccacttgttcaatttggacccctcagatcccaatttcaagaaaacaaaagctatggaaaaaatccttgaggagaaggcccggcaaagagaacgaaaagaacaagaacttactcaggcaataaagaaaaaagagagtgagattgaaaaggaatcacaaaggaagtccattgatcctgctttgtcaatgttgattaaatctataaaaaccaaaacagagcagtttcaagcaagaaaaaagcaaaaagtcaaataactggatgttacttatttttgaactgaatacatcttttcctaaaatgtacaaaaatagtaggagggaatatttattgggaacaaagctatctttcaagaacatgaataaaatctttttctggacatagtaaaatttttctccataaataattgtacttaattgtggatgactgacaaatttttattgtatattcctacagatcagtcataattaaattacctgcattatagggtttataaaatttttatattttacaatgttcagttctaactagtggaaagttactctagctttttaaaaggctgtttacaattctgtgtaaaaatagagcagtatctactcaagtttgtgtaaatgttagggataatttgaaaaatatatatatttaatacattaatttctctggaagcaggaggcatgtttaaataactattaaaataatttatttttctagccataaaggatggaagtcaagaactttttgttgtttagtcatgttaagtatagtttatgaaattaacttgtaaataaaagtgtaaaatattttcattattttgtatagcactgatttattccattttatgcatctcaaagtactctctggaaaaatatctgaaaaccgattttaactttttaagaggacaactccatttaaaggcagttctagagttgcattgctcgtaaattgcatttgaaatattcatgagctctccagtggtttttctgtttggtagcaacagaaaagtcttctgtctgtccttcacatttttggaatactttagaaggatggatatgctgctgtagagtttaaggataccttaattcttcttaaaattaaaacacatctttaaggccttaacactcttggatctcatctggtctaaatattatagacaactgacagtcaaattagatatgctgtataagtaaatgtaaataaaaccagacttgtaacttggagcaaattataaatatggtaacttctgaaagacaacaggaatttgaccaggtttgtggttaaacttgacatttggggtattaaaaatcaaacctactgaccaggcaaggtggctctcacctgtnntcccagcactttgggaggctgaggcaggagaattgcttgaggccaggagttttgagaccaacctgggcaatatagtaagaccataggctgggtgtggtagcctacgcctgtaatccccccactttgggagactgaggcaggcacatcacttgaggtcaggagttcaagaccaggctggccaacacagtgagaccccccatctctaccgaaactacaaaaaattngccgggcgtgatggtgcatgcctgtngtcccagctactcaggaggctgaagcaggagaatcacttgaacttgggaggcngaggttncagtgagccgagattgagccactgcactccagcctgggcaacaggagaccctgtctcaaaatatatatatatacacgtctgtgtgtgtgtgcgcgcacncgtgcgtataacaagccaagtgtggtgatacatacctgtggtccttgctactcaggaggctgagatgggaggatcatatgagcccaggagtttgagtttacagtnagctgtgattgtatcactgcattccagcctgggtgacagagcaagaccctgtctctattt

SEQ ID NO: 408943 - DNA, 1492 bp, Homo sapiens
gcccggcgcacgcgcgtggcctcgcgcagggcggggagaggcggtggctgtgggcgtccggccccgaacctgtcagacctggggagccggcctccagcagcgggcgcggcgggcgcgagcacgaccccactctcctgcggccgcgggtggagcagcgcgagcccgcctcgctgagccggccgggggcggggagatgagttgcggccccgcggcagcgccccaggatggggagggacgcgcggcactgccctcgagaactggcgctccggtgaagtaggcgccgccggccgtccgcctcccccaagccgttccgcaccgcggccgctcagcctctgccatggccggctctggcgcgtggaagcgcctcaaatctatgctaaggaaggatgatgcgccgctgtttttaaatgacaccagcgcctttgacttctcggatgaggcgggggacgaggggctttctcggttcaacaaacttcgagttgtggtggccgatgacggttccgaagccccggaaaggcctgttaacggggcgcacccgaccctccaggccgacgatgattccttactggaccaagacttacctttgaccaacagtcagctgagtttgaaggtggactcctgtgacaactgcagcaaacagagagagatactgaagcagagaaaggtgaaagccaggttgaccattgctgccgttctgtacttgcttttcatgattggagaacttgtaggtgagttgtgttgccaactcactttccgtttacctttcctcgagagtctttgtcaagctgtagttacacaggctttgaggtttaacccatcttttcaggaagtttgtatttatcaagacactgatctcatgtgaaaaggccacacggttccaaagtgcagctcaatctaagtacaatataaactccccgagataactttgactttctcttctagttgttcaaccactgtcatctaccgtaaagttaaggacgttatcttcattgtatgtcatgtaacttcctctttttacaaaggtctggtaaaataccaggttaattttcgcaacgtttaaaatagtaaatgatcgtaaataacttaagatcatagaattttacagtatgaagggaccttactgaacacctgctccacctcctttttttttttacatgtaaggatttccagggcacaaaccagtggaataagtcgtgagggccacttagggagttaatggaagagccacatctacagtcccagcatttttttcctctacatttgacctaagtggtttcttttatacgatttccttttgtatttatagccaagagatttgcaaaattaattaccaactaacatgaaatttttgcctcgtaagaagggcctgaaatgaaccagaggactccgccaaagttctatgagcctggttttcttgttcattttttaattatacgaacaatccgttctcaatataagatacattcttagtttagaggttattttcaatcac

SEQ ID NO: 408944 - DNA, 1085 bp, Homo sapiens
gcccggcgcacgcgcgtggcctcgcgcagggcggggagaggcggtggctgtgggcgtccggccccgaacctgtcagacctggggagccggcctccagcagcgggcgcggcgggcgcgagcacgaccccactctcctgcggccgcgggtggagcagcgcgagcccgcctcgctgagccggccgggggcggggagatgagttgcggccccgcggcagcgccccaggatggggagggacgcgcggcactgccctcgagaactggcgctccggtgaagtaggcgccgccggccgtccgcctcccccaagccgttccgcaccgcggccgctcagcctctgccatggccggctctggcgcgtggaagcgcctcaaatctatgctaaggaaggatgatgcgccgctgtttttaaatgacaccagcgcctttgacttctcggatgaggcgggggacgaggggctttctcggttcaacaaacttcgagttgtggtggccgatgacggttccgaagccccggaaaggcctgttaacggggcgcacccgaccctccaggccgacgatgattccttactggaccaagacttacctttgaccaacagtcagctgagtttgaaggtggactcctgtgacaactgcagcaaacagagagagatactgaagcagagaaaggtgaaagccaggttgaccattgctgccgttctgtacttgcttttcatgattggagaacttgtaggtggatacattgcaaatagcctagcaatcatgacagatgcacttcatatgttaactgacctaagcgccatcatactcaccctgcttgctttgtggctatcatcaaaatcaccaaccaaaagattcacctttggatttcatcgcttaggtaggtagttggtgtttcttttgctttataatattttatagtaaaaccacaatgaactataaccctgattaactgaactcgttccagtgatatcttgtttgaacaaagcaaatgaaaatagataaacaaaatttattcagaaacatcttttccagggtacatttagcctagtcagctaaacagtttacacatataaaattatatgatgat

SEQ ID NO: 408945 - DNA, 2258 bp, Homo sapiens
  misc_feature (1084)..(1084): n is a, c, g, or t
gcccggcgcacgcgcgtggcctcgcgcagggcggggagaggcggtggctgtgggcgtccggccccgaacctgtcagacctggggagccggcctccagcagcgggcgcggcgggcgcgagcacgaccccactctcctgcggccgcgggtggagcagcgcgagcccgcctcgctgagccggccgggggcggggagatgagttgcggccccgcggcagcgccccaggatggggagggacgcgcggcactgcctctggcgcgtggaagcgcctcaaatctatgctaaggaaggatgatgcgccgctgtttttaaatgacaccagcgcctttgacttctcggatgaggcgggggacgaggggctttctcggttcaacaaacttcgagttgtggtggccgatgacggttccgaagccccggaaaggcctgttaacggggcgcacccgaccctccaggccgacgatgattccttactggaccaagacttacctttgaccaacagtcagctgagtttgaaggtggactcctgtgacaactgcagcaaacagagagagatactgaagcagagaaaggtgaaagccaggttgaccattgctgccgttctgtacttgcttttcatgattggagaacttgtaggtggatacattgcaaatagcctagcaatcatgacagatgcacttcatatgttaactgacctaagcgccatcatactcaccctgcttgctttgtggctatcatcaaaatcaccaaccaaaagattcacctttggatttcatcgcttagaggttttgtcagctatgattagtgtgctgttggtgtatatacttatgggattcctcttatatgaagctgtgcaaagaactatccatatgaactatgaaataaatggagatataatgctcatcaccgcagctgttggagttgcagttaatgtaataatggggtttctgttgaaccagtctggtcaccgtcactcccattcccactccctgccttcaaattcccctaccagaggttctgggtgtgaacgtaaccatgggcaggatagcctggcagtgagagctgcatttgtacatgctttgggagatntggtacagagtgttggtgtgctaatagctgcatacatcatacgattcaagccagaatacaagattgctgaccccatctgtacatacgtattttcattacttgtggcttttacaacatttcgaatcatatgggatacagtagttataatactagaaggtgtgccaagccatttgaatgtagactatatcaaagaagccttgatgaaaatagaagatgtatattcagtcgaagatttaaatatctggtctctcacttcaggaaaatctactgccatagttcacatacagctaattcctggaagttcatctaaatgggaggaagtacagtccaaagcaaaccatttattattgaacacatttggcatgtatagatgtactattcagcttcagagttacaggcaagaagtggacagaacttgtgcaaattgtcagagttctagtccctaattttatgtattgttttagcattgctgaattcactttatttatcctgcagtcacagacttgagagcaataaatgcaaacctaaatgagaaaatggaatccctgacagctgtgtccgtatcaagcatcagtctctcaaacagttgccccagcctgacagtgctagtctctgtttaatggtaaaaggagactttgccataattttcagatgaagatgtttcccaaacactgtttacagaatgagatgtgactcctacagatacctcatagaagacaatccaagatcatacttcattaacttgacagagtacgtgtcttaaaggaagcatcaagaattcaatatttgcatttaaaaatactttttaaggccattttatattaagccagtgctggaaaactgaattttttttattatgtataataatctcgacacccagcttctggaattgctgctttctttttacagaaattactacccaacagatttcaggaagtactagtagttatcccaaaagtggaataagcatgtattcctaagtgtttcagaaatgttttatttcacacataagtcttaatgttattgttatgattatactttataaacaaccttttccagatgctacagggttttgaatctcaaagttaacatttttcattatttgtaatcttagaaccaaatctttatttattgtggtcactgttattaaatgatttaggaaatactttcaata

SEQ ID NO: 408946 - DNA, 2355 bp, Homo sapiens
  misc_feature (1181)..(1181): n is a, c, g, or t
gcccggcgcacgcgcgtggcctcgcgcagggcggggagaggcggtggctgtgggcgtccggccccgaacctgtcagacctggggagccggcctccagcagcgggcgcggcgggcgcgagcacgaccccactctcctgcggccgcgggtggagcagcgcgagcccgcctcgctgagccggccgggggcggggagatgagttgcggccccgcggcagcgccccaggatggggagggacgcgcggcactgccctcgagaactggcgctccggtgaagtaggcgccgccggccgtccgcctcccccaagccgttccgcaccgcggccgctcagcctctgccatggccggctctggcgcgtggaagcgcctcaaatctatgctaaggaaggatgatgcgccgctgtttttaaatgacaccagcgcctttgacttctcggatgaggcgggggacgaggggctttctcggttcaacaaacttcgagttgtggtggccgatgacggttccgaagccccggaaaggcctgttaacggggcgcacccgaccctccaggccgacgatgattccttactggaccaagacttacctttgaccaacagtcagctgagtttgaaggtggactcctgtgacaactgcagcaaacagagagagatactgaagcagagaaaggtgaaagccaggttgaccattgctgccgttctgtacttgcttttcatgattggagaacttgtaggtggatacattgcaaatagcctagcaatcatgacagatgcacttcatatgttaactgacctaagcgccatcatactcaccctgcttgctttgtggctatcatcaaaatcaccaaccaaaagattcacctttggatttcatcgcttagaggttttgtcagctatgattagtgtgctgttggtgtatatacttatgggattcctcttatatgaagctgtgcaaagaactatccatatgaactatgaaataaatggagatataatgctcatcaccgcagctgttggagttgcagttaatgtaataatggggtttctgttgaaccagtctggtcaccgtcactcccattcccactccctgccttcaaattcccctaccagaggttctgggtgtgaacgtaaccatgggcaggatagcctggcagtgagagctgcatttgtacatgctttgggagatntggtacagagtgttggtgtgctaatagctgcatacatcatacgattcaagccagaatacaagattgctgaccccatctgtacatacgtattttcattacttgtggcttttacaacatttcgaatcatatgggatacagtagttataatactagaaggtgtgccaagccatttgaatgtagactatatcaaagaagccttgatgaaaatagaagatgtatattcagtcgaagatttaaatatctggtctctcacttcaggaaaatctactgccatagttcacatacagctaattcctggaagttcatctaaatgggaggaagtacagtccaaagcaaaccatttattattgaacacatttggcatgtatagatgtactattcagcttcagagttacaggcaagaagtggacagaacttgtgcaaattgtcagagttctagtccctaattttatgtattgttttagcattgctgaattcactttatttatcctgcagtcacagacttgagagcaataaatgcaaacctaaatgagaaaatggaatccctgacagctgtgtccgtatcaagcatcagtctctcaaacagttgccccagcctgacagtgctagtctctgtttaatggtaaaaggagactttgccataattttcagatgaagatgtttcccaaacactgtttacagaatgagatgtgactcctacagatacctcatagaagacaatccaagatcatacttcattaacttgacagagtacgtgtcttaaaggaagcatcaagaattcaatatttgcatttaaaaatactttttaaggccattttatattaagccagtgctggaaaactgaattttttttattatgtataataatctcgacacccagcttctggaattgctgctttctttttacagaaattactacccaacagatttcaggaagtactagtagttatcccaaaagtggaataagcatgtattcctaagtgtttcagaaatgttttatttcacacataagtcttaatgttattgttatgattatactttataaacaaccttttccagatgctacagggttttgaatctcaaagttaacatttttcattatttgtaatcttagaaccaaatctttatttattgtggtcactgttattaaatgatttaggaaatactttcaata

SEQ ID NO: 408947 - DNA, 306 bp, Homo sapiens
attaactggaaatgtgaaagagcttgttggatatacaggtcaagaatacaaagcgaatttgggccacagagaaacatttggtactttttagcacaagatgggggcaggtttgcttacaataagtgtacaatcagaagagaagaggacccaaggctataggttctaaagaactttaacatttagaagtcaaacataggaattcacaaaagataccaaccttctctggtcagctctaaatgggcatataataaactatcacggggactatgtaaagcttgcatagtgcttgtaatattcaaagtactc

SEQ ID NO: 408948 - DNA, 3139 bp, Homo sapiens
  misc_feature (1086)..(1086): n is a, c, g, or t
  misc_feature (1243)..(1243): n is a, c, g, or t
  misc_feature (1536)..(1536): n is a, c, g, or t
  misc_feature (1593)..(1593): n is a, c, g, or t
  misc_feature (1621)..(1621): n is a, c, g, or t
  misc_feature (1763)..(1763): n is a, c, g, or t
tgctgggtgagaccactggcaccataactctccccagcctcaactctggtttttttcctctgttctttccatgttccccttggaagtcgctgttggtcgtggcactgaggcccagatcatgccacctcctctaacaagtggctgagtggacaccccacacattctacccaagggccgtgagtggccaagatcggggctcagaagtctctgaatcttcacagctggtcacgttcagctcggtcacttcctgtaagattccaggcactgcatgcactgacatgggtgcgtgtgggcccactgggtcctgcctgggagccttccctggatgttcattttttgcaggtctgtgtttgtcttggagtaaggattattctcgcttgctggggtcatggtgttttggcctctcctggcctggactctcaaaaactcatcatccttcataggtctgaaggcttctacattcccaccagcaggtggaccatatgaactcaaaactagttgtggcagagggaccctgaagagatctacccctggattgccctttacagttcatgagttcccccaactggagtgcagacaagagcactgattgatggaccaggtagacttgaaaccaggaatagcacaaaagttatcaaagaggctcagccatggagattgcaagctggggatggaagtatgcctggaattgagctgttctcacacctggtacctgagttatacccctggtgtctgggtaccaaggtcactagccttgccacttttctatgttcctgatcccctactaaacagtccaccttttcgcctacttcccctgactcctgtaccctgtcccctctttctgcctagtttgaagacactggtcatcccataacatgtcctgggctaatacatatcctcaaatcgttcttgaaaatctgttcctcttccctcctccccctcccccccccctctttccacggtctccctctgatgccgagccgaagctggacggtactgctgccatctcggctcactgcaacctccctgcctgattctcttgcctcagcctgccgagtgcctgcgattgcaggcgcgtgccgccangcctgactggttttcgtattttttttggtggagacggggtttcgctgtgttggccgggctggtctccagctcctaaccacgagtgatccgccagcctcggcctcccgaggtgccgggattgcagacggagtctcgttcattcagtgctcaatggtgnccaggctggagtgcagtggcgtgatctcggctcgctacaacctccacctcccagcaacccgccttggcctcccaaagtgccgagattgcagcctctgcccggcggccaccccgtctgggaagtgaggagcgtctccgcctggccgcccatcatctgggatgtgaggagcccctctgcctggctgcccagtctggaaagtgaggagcgtctctgcccggccgccatcccatctaggaagtgaggagcgcctcttcccggccgccatcacatctgggaagtgaggagcgtctctncccggccgcccatcgtctgagatgtggggagcatctctgccctgccgccccgtccgngatgtgaggagcgtctctgcccggccgncccgtctgagaagtgaggagaccctctgcctggcaactgccccgtctgagaagtgaggagcccctccgcccggcagccgccccgtctgagaagtgaggagcccctccgcccagcagccaccccgtctgggaagtgaggagcntctccgcccggcagccgccccgtctgagaagtgaggagcctctccgcccagcagccacctcgtccgggagggaggtgggggggtcagccccccgcccggccagccgccctgtccggaagggaggtgggggggtcagccccccgcgcggccagccgacccgtccgggagggaggtgggggggtcagccccctgcccggccagccgccccgtccgggaggtgcggggcgcctctgcccggccgcccctactgggaagtgaggagcccctctgcccggccagccgccccatctgggagggaggtgggggggtcagccccccgccctgccagccgccctgtccgggagggaggtgggggggtcagccccccgcctggccagccaccccgtccgggaggtgaggggcgcctctgcccggccgcccctactgggaagtgaggagcccctctgcctggccagccgccccgtccaggagggaggtggggggggggtcagccccccgcctggcgagccgccctgtccgggaggtgaggggcgcctctgcccggccgcccctactgggaaatgaggagcccctctgcccggccaccaccccatctgggaggtgtacccaacagctcgttgagaacgggccatgatgacaatggcggttttgtggaatagaaaggggggaaagatggggaaaagattgagaaatcggatggttgccgtgtctgtgtagaaagaggtagacgtgggagacttttcattttgttctgtactaagaaaaattcttctgccttgggatcctgttgatctgtgaccttacccccaaccctgtgctctctgaaacatgtgctgtatccactcagggttgaatggattaagggcggtgcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctcccctattgtcctgtgaccctgccaaatccccctctacgagaaacacccaagaatgatcaataaaaaaaaaagaaaaaaaaaaaatctgttcctctgtgagatgggcctgatctctcccacgggtggagcagaggagtagagggtccagggcctgagtctcccataggctaagtatttgccctgagtcataaagccagtgggaggcagtgctacagtttgattccaggaagtctcagaccaaagttctctcttaaccacttacctttcctgggcttaatagttagttcatttatgtttttcctggcactacttcattggacctcattttagtttctt

SEQ ID NO: 408949 - DNA, 3498 bp, Homo sapiens
  misc_feature (1445)..(1445): n is a, c, g, or t
  misc_feature (1602)..(1602): n is a, c, g, or t
  misc_feature (1895)..(1895): n is a, c, g, or t
  misc_feature (1952)..(1952): n is a, c, g, or t
  misc_feature (1980)..(1980): n is a, c, g, or t
  misc_feature (2122)..(2122): n is a, c, g, or t
tgctgggtgagaccactggcaccataactctccccagcctcaactctggtttttttcctctgttctttccatgttccccttggaagtcgctgttggtcgtggcactgaggcccagatcatgccacctcctctaacaagtggctgagtggacaccccacacattctacccaagggccgtgagtggccaagatcggggctcagaagtctctgaatcttcacagctggtcacgttcagctcggtcacttcctgtaagattccaggcactgcatgcactgacatgggtgcgtgtgggcccactgggtcctgcctgggagccttccctggatgttcattttttgcaggtctgtgtttgtcttggagtaaggattattctcgcttgctggggtcatggtgttttggcctctcctggcctggactctcaaaaactcatcatccttcataggtctgaaggcttctacattcccaccagcaggtggaccatatgaactcaaaactagttgtggcagagggaccctgaagagatctacccctggtgaatgcccccaggagtgggctgttctcacacctggtgcccagcctgtgccctcgcaggtcttggtgcctccactcagctcaattccagtcttctggccatgccccgctgtgtccctttctctctccttagtgcctagctgtgcaatgtttgcctctccttaacatgtcctcagctgaccccatatcctcagtccttgcaaccctgttcctcagtgacacctgtgtattctctccagtggagacacaggtgggacacccccaagctcatggtacatgcctgtcatcagtacccctggactgtcatggtgggtcagtctgccctaggctggactgaccaacctgttcattcccccacaggattgccctttacagttcatgagttcccccaactggagtgcagacaagagcactgattgatggaccaggtagacttgaaaccaggaatagcacaaaagttatcaaagaggctcagccatggagattgcaagctggggatggaagtatgcctggaattgagctgttctcacacctggtacctgagttatacccctggtgtctgggtaccaaggtcactagccttgccacttttctatgttcctgatcccctactaaacagtccaccttttcgcctacttcccctgactcctgtaccctgtcccctctttctgcctagtttgaagacactggtcatcccataacatgtcctgggctaatacatatcctcaaatcgttcttgaaaatctgttcctcttccctcctccccctcccccccccctctttccacggtctccctctgatgccgagccgaagctggacggtactgctgccatctcggctcactgcaacctccctgcctgattctcttgcctcagcctgccgagtgcctgcgattgcaggcgcgtgccgccangcctgactggttttcgtattttttttggtggagacggggtttcgctgtgttggccgggctggtctccagctcctaaccacgagtgatccgccagcctcggcctcccgaggtgccgggattgcagacggagtctcgttcattcagtgctcaatggtgnccaggctggagtgcagtggcgtgatctcggctcgctacaacctccacctcccagcaacccgccttggcctcccaaagtgccgagattgcagcctctgcccggcggccaccccgtctgggaagtgaggagcgtctccgcctggccgcccatcatctgggatgtgaggagcccctctgcctggctgcccagtctggaaagtgaggagcgtctctgcccggccgccatcccatctaggaagtgaggagcgcctcttcccggccgccatcacatctgggaagtgaggagcgtctctncccggccgcccatcgtctgagatgtggggagcatctctgccctgccgccccgtccgngatgtgaggagcgtctctgcccggccgncccgtctgagaagtgaggagaccctctgcctggcaactgccccgtctgagaagtgaggagcccctccgcccggcagccgccccgtctgagaagtgaggagcccctccgcccagcagccaccccgtctgggaagtgaggagcntctccgcccggcagccgccccgtctgagaagtgaggagcctctccgcccagcagccacctcgtccgggagggaggtgggggggtcagccccccgcccggccagccgccctgtccggaagggaggtgggggggtcagccccccgcgcggccagccgacccgtccgggagggaggtgggggggtcagccccctgcccggccagccgccccgtccgggaggtgcggggcgcctctgcccggccgcccctactgggaagtgaggagcccctctgcccggccagccgccccatctgggagggaggtgggggggtcagccccccgccctgccagccgccctgtccgggagggaggtgggggggtcagccccccgcctggccagccaccccgtccgggaggtgaggggcgcctctgcccggccgcccctactgggaagtgaggagcccctctgcctggccagccgccccgtccaggagggaggtggggggggggtcagccccccgcctggcgagccgccctgtccgggaggtgaggggcgcctctgcccggccgcccctactgggaaatgaggagcccctctgcccggccaccaccccatctgggaggtgtacccaacagctcgttgagaacgggccatgatgacaatggcggttttgtggaatagaaaggggggaaagatggggaaaagattgagaaatcggatggttgccgtgtctgtgtagaaagaggtagacgtgggagacttttcattttgttctgtactaagaaaaattcttctgccttgggatcctgttgatctgtgaccttacccccaaccctgtgctctctgaaacatgtgctgtatccactcagggttgaatggattaagggcggtgcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctcccctattgtcctgtgaccctgccaaatccccctctacgagaaacacccaagaatgatcaataaaaaaaaaagaaaaaaaaaaaatctgttcctctgtgagatgggcctgatctctcccacgggtggagcagaggagtagagggtccagggcctgagtctcccataggctaagtatttgccctgagtcataaagccagtgggaggcagtgctacagtttgattccaggaagtctcagaccaaagttctctcttaaccacttacctttcctgggcttaatagttagttcatttatgtttttcctggcactacttcattggacctcattttagtttctt

SEQ ID NO: 408950 - DNA, 362 bp, Homo sapiens
cctttatttcttattctttttcctggcctcagtcctaggggaagtgaactgtgtacccaggtgtgtatctggcatttctctagcaggtttttaaataattttatctatcataattattttcatcaggacagaaatctttccatattctttatcaagatactctatcatgaaaattgtcaaatatatgcaaaaacaaagagaatgacccttcatataccattactcagatacactgagtaccaagattttgtcatactcagttcatctgtcgtctccctcttttttgtcaaagtaaaaatctcagatgtgtcatttcacccttatttactttaggttatttctcagaaaaatggagagttctc

SEQ ID NO: 408951 - DNA, 257 bp, Homo sapiens
atcccagcactttgggaggccgaggcgggcagatcacttgaggcagaaggtaacacagttggtgagtggcttcgccgggatttgaacccaggtgttccctggtcgactgagagaaggatgtgagagtgggctgggtggaggctggttggtgttgaataaggcagagggaggagccccagagatgctgagcaggctctggcttgctgctgttaattggccagggagccattctgtacccccagtggcttaggcctgat

SEQ ID NO: 408952 - DNA, 231 bp, Homo sapiens
tcaaaatagtgatttcagttactctcgtataaagtggagggcaggaacgatggacagctatcatcttaaaagcttattggagtcagacgatggttcctcacatctgctgacctgtaactatggaataaacaactctgatgaccatttgttcattatcatactggagtcatgttcctgaggaattccagggcagtaaaaatttagaagctaaatgtttaactttccagaatg

SEQ ID NO: 408953 - DNA, 1024 bp, Homo sapiens
tctcgcgctgcaggagacaggacacctcaggccccacccgcttgcagcagaggcagcctcgcctacccctcgccaacctcgagtgctccaccgggagaacagccgaggcttagcaagtccctgaatgcctgtggggcagagccagcagtgctgagctacccgagcagactctgcacagcagactgctccggtcagttgcattccgacacgatcccacaggccaacagaacccagacatgctgggctctcatcccctggttctgggcccttcacaggctggctctgttgcaaggggcagtgctgcctgaagtggccaagccaccagatcccacaccaaccctgggcagtgtcttccatgaggacagcagaagatgagcggagctcaggcagagcccggggccagatggcctgccaggcagtgtcccgggaacagcttccatttcccaaagccggcctcacccctcggatacactgtgggccagtaaggcctcagaacctgcagcccagcaaggctggctatgctttgaggcaagacccatgaggacccagtgagcctctcagaggggctgaaggggcccaacagggtggggctgagcctgagggatgggaacccaacaacagctccctacagggccaccatcagaagctgaggcccggggcacagatgggccaagcctcagagtcagcatctcctggcgggcatggccctgagcggaggccagaatctctaggacaccagctcctcgtcccggagggccatgtcaaagagaggtgtggaagaatgcgactgggacgggggcgaggcagatcgcaggtgaagggacagtttccggcacctgatggggcgtggagggaggcagaagccagactctctggcctgcccaccctgcgcctcagaaccagcccagctccaccaaccggcatggccacctcccccttgggacagcaggaacaagccaggcaacgctctacagagagcagagatgctgtccggggtggacagggaacactggatggctcccag

SEQ ID NO: 408954 - DNA, 1334 bp, Homo sapiens
gtcagggtcatctttctttttaaagaattaagccatattttgtgagggccagaacttgcattatttagtatatttcccccttcccccaatggaaagcaaagttaaaggtaaagtacatatttcaaaacaattttattgacctctttatacagaattttacttggaaaactttgggggctttgaatgcattacataatatttatattgtattgagcttttttattcctcacactatatttacattaataaattgattgagaagtttatagtaaagggaaacttacagaacacttttgtatcatttaaaagatgacctgaccaaaaactttacaggattcataaatcagggatcattttgctattgacttcacagtaatcagtagttttataggtaatattatagttaatttgcagcattttagtacttgtattatttatttttggtcagaaatagtaaattaaaatattttttgatagtttataggtaataatcaacccataacttttaaaagaaacaaaacatttctattattgagttaacatttgattatacaaactaggaaaggcagggaaattccccttctccccagtgattctattaagatgacctttatgttaaactttcaaagtactttatgaatttagttaccagttactatttattaattgacaattttctgaaaaatcccgtttcagcagacttaatgaaggtgaaagcaacccttatgtgctttctacttatttgaatgttcctcaagtattttatattaaaaaaaaaaaagaaggaaaagagaaaacagtgcctctgtttttagaaaactactgctcagtaaagttgtttaaaccatttctggtagctaatgacaattttatattaaattgtatactaactttagtgagactgatttttttagttgtttacagtacaaatacttgtatttgttttttaattgcagtatttccaatgtcgcagtaatttagtaaaactctgtggctgccttgattttgacagattttgttaatataaactgattgttaggcaattagttatatttatgcataaatcaattgcactataattcatgaattatttattacaatattttctaatgaattcatgtatctgtcttgtgttgtaaatgtactgtaattctgttcctactttgtgttgttatatatctaaatctgattgtatgaattttaattgttcagttaacgtgtttctaggttgtaatttgtagtaaagcacttcaatgcttttgcacttaaatttacaacactgttggtgtgtgattgatttactcattcagtaaaagaaaaaaagaaaagaaaag

SEQ ID NO: 408955 - DNA, 564 bp, Homo sapiens
ttcctgattactcacaggtgaagttcagagataattttagcccattccagaaattcttcagtttttttttaaatttagttatttctgtaaaataatgtccatttgaagatgtacttgtgaaaaatatgatttgattttggtgactcttgtgtccactccttgaacctacattctgataaaaagttaaaatccttatgtgacagagatggaaatgtaagtatgaggtggaggaaaatgtgttttccgtagccagggtggagtggaaccaccactatgtggaagtggaaactcccattccgtgtgatgaagaaatgcttgtggcatgcagggcagatggagtgtgaaatagcttcaggacaagaggtacccagggaccttgtttggcattctggggaaagaaaggactttaattggtctggcttttttccaaaaagttagacagagtcatctagcaagctgctgtcttctttttcattgccttcaacaacaagcactttataaagcaagtgacaagtttttcttttttgaaaccagagtttaagatttacatgaccagaaagttct

SEQ ID NO: 408956 - DNA, 618 bp, Homo sapiens
ttcctgattactcacaggtgaagttcagagataattttagcccattccagaaattcttcagtttttttttaaatttagttatttctgtaaaataatgtccatttgaagatgtacttgtgaaaaatatgatttgattttggtgactcttgtgtccactccttgaacctacattctgataaaaagttaaaatccttatgtgacagagatggaaatgtaagtatgaggtggaggaaaatgtgttttccgtagccagggtggagtggaaccaccactatgtggaagtggaaactcccattccgtgtgatgaagaaatgcttgtggcatgcagggcagatggagtgtgaaatagcttcaggacaagaggtacccagggaccttggtttaaaattgcaatttcagaaggaatgcaagcaaacttctggatttcagacagtttggcattctggggaaagaaaggactttaattggtctggcttttttccaaaaagttagacagagtcatctagcaagctgctgtcttctttttcattgccttcaacaacaagcactttataaagcaagtgacaagtttttcttttttgaaaccagagtttaagatttacatgaccagaaagttct

SEQ ID NO: 408957 - DNA, 675 bp, Homo sapiens
aaagatagaaagatggagataaaggaagagatggagagagatccagagccggggtgggtgataatccaagttggggagaaggagggatagaaactgaatctgctagaggctgggcacagtggctcagacctgtaatcccagcactttgggaggccgaggcaggcaaatcacttgagataaggagttcaagaccagcctggccaacatggtgaaaccccggctctactaaaaatacaaaaaaaattagccaggcactgtggcaggtgcctataatcccagctactcaggaggctgaggcaggagaatcacttgaacccgggaggcggaggttgcagttagagttaatcgagatcacaccactacactccagcctgggcaacagagcgagactccatctcaaaaaactgagtctgctagaggatgccacaaacagctgggggtaagattgctggcaggagtggggaagctgagcaggacagggacagtcacagcctatggtgctgcagaggccaggagtccgagcagtttctttgccctggactctgaagacacggctaggaccagtggaggggagggaccagggcaggtttaactgttatttgagggacagagtcactcgtgcagaaacaggcagccaggggtgatgcagggaactcaagttttggggtagtgggg

SEQ ID NO: 408958 - DNA, 328 bp, Homo sapiens
  misc_feature (289)..(289): n is a, c, g, or t
  misc_feature (310)..(310): n is a, c, g, or t
gtggaggttgccatgagccaagattgtgccactgcactccaccctgagtgacagaacaagactccatctcaaaaacaaaacaaaacaaaacaaaaaacagaaaatccaaaagaatctatagggaacttagaacaaatagagtagttcagcaaggattttagataaaagaacaagaaacaaaaattaatggcaattctttttactagaaaattaattaaaaatacattcaggccaggcacggtggctcacgcctgtaaccccagcactttggcttcccagagtgttgggnttacaggtgtgagccaccgtncccggccaaattcccttt

SEQ ID NO: 408959 - DNA, 347 bp, Homo sapiens
gacctctgagggttgtggttatgtgttgagaatgaagtctcatcaggaatgagtgagcttgtttcttcctctaacccctctccatggggtggaaagtaggggcagagcatgcagcagagaatctgttcttgtggcccagggatgtccagtgtctgatcagtactctcatcatctcttgtcaatgacagctcactctacggaacagtggtagtcaactggaaaagctgcctcgtgtcatttggatgccactttccccagtgccgcttgagtccatcatcatggccatagattccacccctgccccctgtttgtgtggcaggactgtttcctataaatcctatatgacc

SEQ ID NO: 408960 - DNA, 272 bp, Homo sapiens
atcatttgtagtacactcaagctaacctactctgtaatattatccttgatcttttgctcctttgaagaaagaccttcaaaatacctagtttttgtatcaattgttgattactctagtttttaacttttttggagcgcttatggtgagggttacatagctgagagctgctcagtgtttcaggggagcttcagccgtaggtgggaagcagttgaagcaaactgtaacaaagaagtcacttccatcagaaaataaaattcccaccagctgttaaa

SEQ ID NO: 408961 - DNA, 296 bp, Homo sapiens
taaatttcatgtgttcagaatgttaaagacaaaagccttcctgacaaaatgaaggcaactttgcaaatgtgagaccattcagtcagtgcccccatgggtgctcctgagagcagcatcgcgctgggataagtttttcctctttgctgtgtgaagagagggcatgtggagtctacggaaaaatactaccaagtgaggaagaggaacatcatcctgagcacttgaagaaagagcactctgatgaaaacaattcacaaatcagaagaaaggtttagaaaattgaggtcaggtggtggtgg

SEQ ID NO: 408962 - DNA, 196 bp, Homo sapiens
atacccaaggggctggggtttcggccaccctgtggcagagcttttagaagccagggcccttggctcggcagtgctggctcatagtaggtgcttagttcatgcctgtctccttggatgaaatctgaccatagacaccagtgcaaagcaggtgttcaacacaggagggtgtactgaacccgatctctctatcaccagg

SEQ ID NO: 408963 - DNA, 533 bp, Homo sapiens
gaaaaatagactcatgaatgtcaggtccatggagtgtgattagggctgcttaagaaaatagctgttaattcttatgctgcctgatggattgagagtggctgcctgaggctctgtgttgaggattctaaggctgtatctgggctcattaggaaagagtattcttctgattgactagcagtgtctctcacggatgcaggcttagagaagcacagcacatgtgccttggcaaaggcagtcctggatcatcccttaatgctaagtcccattggccccatttgttcaaagagagggtagaaaaggtgaaaggattaaactgagttggtgttatcagaagtattttagccatggaacctttttttaaaaaacaagatcttggaaatctaatgtagaaacaggtaaaagcagaaacacctgttgaagcagcgtttggggccaacttgtttggtgttgccccttatgcccccaagaccctgaggtacttccctttaacccctatggttctgggtaagattgaaaatcactggctcaggaca

SEQ ID NO: 408964 - DNA, 365 bp, Homo sapiens
tacttgtacatgtcttttggagcacacgtgtacacatttctttctgtatatactgggagtggaattgctggggtgtggtcatggatacacatctgttcaactttttagtaagtttaaattcttctgaacagttttccaaacaaatgaaccgtcttatactctcaccagcagtatatcaatgttctgctttctccacatctttgaaaatacttgacatcatcagtttaaagaatattttcattactctcataggtaatatagtggcatttgattgttgataattgtggtttaattttccattttctgattgctgcctatttgtatattcttgcaatttctcttcgctccttgctccgggcattgga

SEQ ID NO: 408965 - DNA, 297 bp, Homo sapiens
tttcaagcttccatatttgtgaaacagaaatcaaatatgcttttgagagcatactttaagcccaatggaaagaacatccaaacatgaaccactctttgcacatggcagcagaagacctcgctgcaagttctgctccctgtagaataccaacagagctaaatcagactctaaaggcatatgttgcctgatatcactttattatgggaattcattttgtgagtgttgggggttcacaggagccaaatcattcccttcttcccttctaggttagatccaactagaaacatacacagtact

SEQ ID NO: 408966 - DNA, 495 bp, Homo sapiens
caaaagaccttgcaaaagccggatggacaatgggataagggagaggaaggagtctaagattgcacatctttgtcagtcatatgcttggtggcatcttgagcagaactagagggaagagaagtgaagtttgggacaggagtgggaatgggtgtgaccttagacttggttaatttgaaatggtactaacatctccaggtgggagagttagcagaagattggaattgggccaattaggggaaaggggtaggctgaagctagagagagacagagagatgcccttttgaaggtcatcttcacagaggtaacaattgaagctattgaagcagctgagatcacagcagaaagccaggaacacaatcctagggaagacccacatttattgggtagaagtcagatgtggaaccactagaagaagcagacatacatttagaaatagtaacaaaagcatggtggtgtgatattaaggaagcctaggaaattcaaggtaaaaaaaaa

SEQ ID NO: 408967 - DNA, 470 bp, Homo sapiens
agtgctacctccacaaacagccaattaagaaataatattattcaaatgaaaccggctaatttttttgtatttttcagtagagacggggtttcaccgtgttagccaggatggtctcgatctcctgaccttgtgatccgcccacctcggcctcccagagtgctgggattacaggcgtgagccaccgcgcccatccgcaactgtagttttatattttgccacccatcacatccaacaaccaaactgaactgatttatcctttaaagaatctatatttacccacacccatagccattctagaaacagaatgggaatgggtgttctttacctcactaactgtactcattttgccacctaaggcatctcacactatattcaactaccagaattatacttgtatgtaacgccattcctccccctttaaccttttgtttcatttgatttctgtattaatcaacttcactgcagaaaca

SEQ ID NO: 408968 - DNA, 223 bp, Homo sapiens
ggaaatcctcaatttatatgacttcttaagttttgtttgttacacactttggtttctcatagtaataatgcagatgatgaattattctcagttaatagggttaaaaatgtattattgggtttccacttcttaaaatctgtattcacctcctttcccttctgatgccccagcaaaataaaatgtttaaaaatgagaaatgaagaagccagtaacagtaaatagg

SEQ ID NO: 408969 - DNA, 247 bp, Homo sapiens
caaagagtctgagatacaattagaactgggacctctggtgaagttaagttgaattgtaatcagttggctatacttgtcgtcttccctccctcacaccccaggattactgtatttctgagtcagcactccttttctatctcacctgctcaatttgatgcagagaacttgccaagcatccttttggattagcagcattgatgtgggtgtgttcagttctctgtctggggtgtgtcttttacaacttttt

SEQ ID NO: 408970 - DNA, 222 bp, Homo sapiens
gtgaagacaaaccagctgcatcaaactgcaggcacctcaggaatcagcagatcatgcagggcacaaagaggtgaaaccagtcaagtgtacagtggagacgatttctcaattttttttccttggaatactagcatcactcaaaaatgtcaatagtgtttggtgaacaaaataagctttttaaattaaatgtacagaaatccctgcttatcagaatgacacctt

SEQ ID NO: 408971 - DNA, 233 bp, Homo sapiens
agaatttactatacgtaacattgttttttacataaaaaaacatgatactcaaaatgtgttgaatgacttacacatttgcattttacatgtattatttcctatctcttagtgctttctgttggatgtttttacactaggaagtttctgtactataacagagcacatctacgaaacatttaatccgattcatttccttgcatgcctaatcgataaagagtaatgcataaaaacac

SEQ ID NO: 408972 - DNA, 319 bp, Homo sapiens
gtattttccctgccccagccctacaatcagctatttctcaaaggagtcttggttccttttattggatttagcaaccaagatttgggttctggatttagcaaccaagattgctacgggagtgtcattgcttcttttagcttacagaactagaaaatgtatgtatgtaggtataccaactcacatatgcgcacatctgtaattatgtatccacctgtacaattattaacctaaacatgaattccattagatatctgttagatgtctccaactgtaatctagtaccacaaagttcattcttgccttttctttttgcttatct

SEQ ID NO: 408973 - DNA, 254 bp, Homo sapiens
cagcctggcaatagaatgtccagggacacctcccactggcacctctgaccggctgcatgccatggagttagatgcttccgttctttttcctcagtttcctcacctggggaggagtttcctggtacattgtgaagatggttgagcatgggactgagctgcagtggccagtggagtaagttcttcaatgggagtggctgagcccagcactttggtggggtctgaatgaggccaatagaggaatatttagttcacaa

SEQ ID NO: 408974 - DNA, 426 bp, Homo sapiens
tgcacacgccgagtgaccagacccggccaacatcatcacttttgaatgaaatttttagtttggtgatgactttattatttgtatttgatccttgtccatttttctctagatctggtactaatttcatgtggaaaataaatcgttaggaggttttcattttgtacgttttggctgcaaacaaccacaacccagtctttaggttttcactgagggatttttgttttagcccaattattgtatgacatgtatctgctccagaggttcttataggtgaaatgagatttttatgtatctgtattcaaacacatagatagatagatagatagatagatagcgaaacatatagacatacctctgaaaatacaaccagccatataatgtaagcctgttgtgtgttaatgaatgatagggtaataatacattatg

SEQ ID NO: 408975 - DNA, 346 bp, Homo sapiens
cacactttacaagaaggaaacagaagtctagggaagtaggtaattaacattacccacaatccgtgggcaggaccgggatttgaattggcaatgtggctccagtgcctgggtgctccacattgggagatggtcccatcaggaggtcgtctcttgacatctccaacaagccatccctttgccatgttactaccattccaggtagcctgagtgcccccaagtgaccaaggaaaagcttacccttagagggtctttactcccaatgccccccaccttcccatcctctacctttttgttgtttaaaattcagctgacctgttagttgccacctgggaaggtctgaccactt

SEQ ID NO: 408976 - DNA, 242 bp, Homo sapiens
acaggtaatgagtcctagaatcaactttttttttttggatggagtcttgctctgtcgcccaggctggagtgcagtggcgcgatcttggctcactacaagctccgcctcctgggttcacgccattctcctgcctcagtctcccaagtagctgagggggaaggatcaattgagcctaggaggtcacggctgtggtgagtcgttatcagacactccactccaccctgggcaagagagtgagacct

SEQ ID NO: 408977 - DNA, 197 bp, Homo sapiens
aaagaatagaattgaggcatactgcgtcttaactacacagttttttgagagtgtttcacgtccatgtttgtacttatttaatgcccaagaatgccacaactatctcattttgtagttttgtacatggtaaatcttacagtttcatgagtttgtttaacatgtactcaatgaagtattcttaaaccatttattttatt

SEQ ID NO: 408978 - DNA, 247 bp, Homo sapiens
tgcatgcctagccatgggaaagcacagcctccaaaggataaggaaagctttttgagtaaatacaacatcctaaagtgacaatctttgaaacaaggccgttcacctgttgccaagtcctgtccttccaggaccgggtgtcacagcctggatgttaacagtcgcgttctcagacccccgcctctgtatctgtctcccggttcaccagcaaacacttctctgagaaaccacctgggtgcagggcagatgc

SEQ ID NO: 408979 - DNA, 759 bp, Homo sapiens
actatactttaggcataaaaaatatctgggcagagggaaccaaccatcccaaatttacacagaaagatttaattctttggtgttattatatccatcctcaccaaaatgaagcttaacgccaaaatatagaagtaagaagaagaaggaaatcacagtatagtctgtgggttaaattaattttgtcacaagaattcatttggaagatgcttctcatatatctacagagttgaccaaatcccctcccagtgaccttccatttagttggaatatctaagcagacataaatagtaacatcagggcacttcagaatcttcatccgatttatatcttcataggtccatgtttctattttcaaatgtcctttatttcaaagcagcatgtcactaaaaaaaagaaatgggcaatcatcattcctcaaaagatacgtgcatttggttgggcaaaatcatccaggctaccagttggataataaaagtcgaaatgtactatttgattttttcctatgtttccaagcaagtatttctcaccagacactgcccccatcatatcccctttcctcttctcgaattagctggttttcttagtgacaatctgaactcatgaggttgaattcaccattgcttacttcctggtagtccataaaaagtaccctagagaagtaagagcccacagggatagagtttgcacaataagattcctgaaagcctgcatgttcctgtaacattccatttacagaagactccagccaatccaatgtaa

SEQ ID NO: 408980 - DNA, 400 bp, Homo sapiens
aaagcatgttatttagaaataggctaaataccagaagaagctgctgtgtgagtcaaaagtgactccttccagaacttgggaatgggaggaggaaggggagagagacagctccagaggagtcagttacatggcttcctcccaggccactcctagagtcgtgcactaggtgtgccctagttacaaaccttgtcctgtcagtatttgactttttaaatgatgcatacgtattgctttgataaaaacagaaacaaagattgttctgaaattagtaacatccgtaacttcaaagatgattattacaggtgacaaaggtaatcaaaagttattttaaacttttgtctttaagcattgaaatgatattactgtctgtcacgacaatcttttcaatttggaattcttc

SEQ ID NO: 408981 - DNA, 336 bp, Homo sapiens
tttatttacaaagggccagataataaatattttaagtctgtcataactgctcactctgctgtcagagctcaaaagcagccataaactttagggtaagtaacaagtgggcatggtttgatgtggcctgaaggctttggcagcctctgctattgacagtaagttctgtagattttgtgaactggttgtgaaaggtttttctgaggagttacaactggagtggagaatgagcagttgaataaaaggagcaattgaataaaaggacaaattaggttgtgtatggaatgcttaggagacatcgaacaaatcagcctggctagtgtttagacacttcattcc

SEQ ID NO: 408982 - DNA, 250 bp, Homo sapiens
gagaaagccaacagtcatagtgcgggaggaggcacgcctgggatgcaatacccaacagtctcctccctgctttcctgcaatttgcaggtcattgtctttcttatttgtagctttttttttttttcttcagtagccggtaaacaatcgaacgccgggtagggaggtcagaggggatggggctgtgggagagattctactcaggctaggtgctttagatttggacctggctgtgtccctactttattaaaat

SEQ ID NO: 408983 - DNA, 569 bp, Homo sapiens
  misc_feature (62)..(62): n is a, c, g, or t
attattttctgggatctattatttggtatgttggaaatcaagtacaaagctacgtaaaaganttcttcatattgcaaaaacattaccgcaatactttgtaaaataagggctatagcataagaaaagatcacagtcccacaactcaagcaatcctcctgcgtcggactctcaaactgctggggtactgcacctggccctgtcactcatatatgtaatgatcatatctattaattcttcggctctttttaaagattaagttggaagaatttttaccaaacttgagttgaaaacagcattattgcccttgtgaatccacagaacatgcttccaaagaactgcccttcattcatctctgtcatgccgtttgcaaacttaagcttcgagggcctttctaagtctctcttctacacactttctttttgcttgttggcacttgtatgtcacagagtagcgaatgccttttatggctgagcagtttttcagactgttaccttttcatcactacacctcaacactagcatttataatacattccaagcagtcacttcaggttatgatggttttgtgct

SEQ ID NO: 408984 - DNA, 2221 bp, Homo sapiens
  misc_feature (1060)..(1060): n is a, c, g, or t
ctcttggaacgcctccctcttgccttccccttttggggacagatcccgaagttcgagcatccctcggataggccgggtgtcaggcctggtctctcaggcccgtccaggcccatcttgacgattccaagaccacccccttgagcaagaatgccatcccctctgggtcccccatgcctgcccgtcatggacccagagaccacccttgaggagcctgagactgcccgcctccgcttccgagggttctgctaccaggaggtggcaggtccccgagaagccctggcccggctgcgtgagctgtgttgccagtggctgcagcctgaggcacactccaaggagcagatgctggagatgctggtgctggagcagttcctgggcacactgcctcccgagatccaggcctgggtgcgcggtcagcggccaggcagtcctgaggaggccgctgccctagtcgaaggactgcagcatgaccctgggcaactgttgggctggatcacagcccatgtcctgaagcaggaggtgctccctgcagcccagaagacagaggaaccacttgggagcccccacccctcagggacagtggagtcccctggggaaggtccccaggacaccagaatagaggggtctgtccagctcagctgcagtgtgaaggaggagcccaatgtcgatggacaggaagtggcaccctccagccctccacttgcagcacagtcccctgaggggaaccatggacaccaagaaccagcctccacatccttccacccacccaggattcaggaggagtgggggctgctggaccggtcacagaaggaactgtactgggatgcgatgctggagaagtacggcacagtggtctccctgggtgaggaccagccagccccaccccgcccctctccctggggcctgcacccaccctgcagcaggcctagctgggcagggcctctgtgctaccagccctacccagctctcccaccttccagaggaacaccctgtcacctaccagaaccgaccccacccctccttcatgcaaaccccatgcctaactgtgccccccacccgggcngggttaccgccccaccagccagaggcacaggcccagtcagagctggggatgctgctcacggggacaggcgtctgcagaagcctgcgctcgggaaatgagagtgagggtccacctggctgcccagaggcccagccgccccagggcccagggccggcagcctgggagggcttgtctggggctgccactcctgcccccactgtgcgcccagggacaccgccagtgcccactcagcccacacctgcagagacgagactggagccggctgccacccccaggaagccctacacgtgcgagcagtgtggccgcggcttcgactggaagtcagtgttcgtcatccaccaccggacacacacgagtgggccaggtgtgcagtccccggggctagccaccggggaaagcacagagaagccaccacaaggggaggtggcctttccgcaccacccccgacgctcactcacaggcccccggagttacccgtgtgaggagtgcgggtgcagcttcagctggaagtcgcagctggtcatccaccgcaagagccacacaggccagcggcgtcacttctgcagtgactgtggccgcgccttcgactggaagtcgcagctggtcatccaccgcaagggccaccggccggaggttccatgagcagccagacagcacagtccctcggggcctcggtgttctcggggcctggatacagcctctggggcaccagcagaagactctggaggcagcaggggatgccagagtgaacaaggggtcccaagccagttccctgcccctggtctggtctcccccaaaagacctgggtgcaaggaaaaggagctgctctctctcttcttgcccctgcctcctagagggaggtctgggttcccttctatggctgaccagtgcctgtggggtgactgccaagcaccaggctccctccctccctgtgacatggcctgggctgacaacactccctctcctgggacctccttgcctcaggtgggtgttcaaaaactgtgccttcccactcgtctgtgcagaggctgggcctgaggtctcagtgtggagagcagcagaagacccaggaaagcacagttggcttccgtttctcctgctccctgtgtgtgttagaattttaacataaattccactttcataataagaaaaaaaaataag

SEQ ID NO: 408985 - DNA, 2373 bp, Homo sapiens
aggcgggcggatatgccctagcgttatctaggggctggcccggggaatggcgtgggggcggcggggccaagcaagcgccacctctgattgggcaaaaccccctcccctcacctgccaatagaaaccggcccactgtacagacgcgcaagtttataacccgggaagagctgctctcagagcggagggagaccatataaccctgggactctgccgtacctcctagaggaacagagcgcctctcaggcgtcagaggctgctgcaaatgcgggtcagcgggtcacggtcgcgcctgtcttgctgatgctcatgggaaatgtagttcaaagggcatgggcggtgccttcggtgcaggcgagagattggtcagcgcggcgtcgccggggcaacacccggctgaggcgccccgcgttgtgcggcgccacatccgggaagcggcctccaagcaaccgctccgggttgaggcccatcttgacgattccaagaccacccccttgagcaagaatgccatcccctctgggtcccccatgcctgcccgtcatggacccagagaccacccttgaggagcctgagactgcccgcctccgcttccgagggttctgctaccaggaggtggcaggtccccgagaagccctggcccggctgcgtgagctgtgttgccagtggctgcagcctgaggcacactccaaggagcagatgctggagatgctggtgctggagcagttcctgggcacactgcctcccgagatccaggcctgggtgcgcggtcagcggccaggcagtcctgaggaggccgctgccctagtcgaaggactgcagcatgaccctgggcaactgttgggctggatcacagcccatgtcctgaagcaggaggtgctccctgcagcccagaagacagaggaaccacttgggagcccccacccctcagggacagtggagtcccctggggaaggtccccaggacaccagaatagaggggtctgtccagctcagctgcagtgtgaaggaggagcccaatgtcgatggacaggaagtggcaccctccagccctccacttgcagcacagtcccctgaggggaaccatggacaccaagaaccagcctccacatccttccacccacccaggattcaggaggagtgggggctgctggaccggtcacagaaggaactgtactgggatgcgatgctggagaagtacggcacagtggtctccctggggttaccgccccaccagccagaggcacaggcccagtcagagctggggatgctgctcacggggacaggcgtctgcagaagcctgcgctcgggaaatgagagtgagggtccacctggctgcccagaggcccagccgccccagggcccagggccggcagcctgggagggcttgtctggggctgccactcctgcccccactgtgcgcccagggacaccgccagtgcccactcagcccacacctgcagagacgagactggagccggctgccacccccaggaagccctacacgtgcgagcagtgtggccgcggcttcgactggaagtcagtgttcgtcatccaccaccggacacacacgagtgggccaggtgtgcagtccccggggctagccaccggggaaagcacagagaagccaccacaaggggaggtggcctttccgcaccacccccgacgctcactcacaggcccccggagttacccgtgtgaggagtgcgggtgcagcttcagctggaagtcgcagctggtcatccaccgcaagagccacacaggccagcggcgtcacttctgcagtgactgtggccgcgccttcgactggaagtcgcagctggtcatccaccgcaagggccaccggccggaggttccatgagcagccagacagcacagtccctcggggcctcggtgttctcggggcctggatacagcctctggggcaccagcagaagactctggaggcagcaggggatgccagagtgaacaaggggtcccaagccagttccctgcccctggtctggtctcccccaaaagacctgggtgcaaggaaaaggagctgctctctctcttcttgcccctgcctcctagagggaggtctgggttcccttctatggctgaccagtgcctgtggggtgactgccaagcaccaggctccctccctccctgtgacatggcctgggctgacaacactccctctcctgggacctccttgcctcaggtgggtgttcaaaaactgtgccttcccactcgtctgtgcagaggctgggcctgaggtctcagtgtggagagcagcagaagacccaggaaagcacagttggcttccgtttctcctgctccctgtgtgtgttagaattttaacataaattccactttcataataagaaaaaaaaataag

SEQ ID NO: 408986 - DNA, 2019 bp, Homo sapiens
ctcttggaacgcctccctcttgccttccccttttggggacagatcccgaagttcgagcatccctcggataggccgggtgtcaggcctggtctctcaggcccgtccaggcccatcttgacgattccaagaccacccccttgagcaagaatgccatcccctctgggtcccccatgcctgcccgtcatggacccagagaccacccttgaggagcctgagactgcccgcctccgcttccgagggttctgctaccaggaggtggcaggtccccgagaagccctggcccggctgcgtgagctgtgttgccagtggctgcagcctgaggcacactccaaggagcagatgctggagatgctggtgctggagcagttcctgggcacactgcctcccgagatccaggcctgggtgcgcggtcagcggccaggcagtcctgaggaggccgctgccctagtcgaaggactgcagcatgaccctgggcaactgttgggctggatcacagcccatgtcctgaagcaggaggtgctccctgcagcccagaagacagaggaaccacttgggagcccccacccctcagggacagtggagtcccctggggaaggtccccaggacaccagaatagaggggtctgtccagctcagctgcagtgtgaaggaggagcccaatgtcgatggacaggaagtggcaccctccagccctccacttgcagcacagtcccctgaggggaaccatggacaccaagaaccagcctccacatccttccacccacccaggattcaggaggagtgggggctgctggaccggtcacagaaggaactgtactgggatgcgatgctggagaagtacggcacagtggtctccctggggttaccgccccaccagccagaggcacaggcccagtcagagctggggatgctgctcacggggacaggcgtctgcagaagcctgcgctcgggaaatgagagtgagggtccacctggctgcccagaggcccagccgccccagggcccagggccggcagcctgggagggcttgtctggggctgccactcctgcccccactgtgcgcccagggacaccgccagtgcccactcagcccacacctgcagagacgagactggagccggctgccacccccaggaagccctacacgtgcgagcagtgtggccgcggcttcgactggaagtcagtgttcgtcatccaccaccggacacacacgagtgggccaggtgtgcagtccccggggctagccaccggggaaagcacagagaagccaccacaaggggaggtggcctttccgcaccacccccgacgctcactcacaggcccccggagttacccgtgtgaggagtgcgggtgcagcttcagctggaagtcgcagctggtcatccaccgcaagagccacacaggccagcggcgtcacttctgcagtgactgtggccgcgccttcgactggaagtcgcagctggtcatccaccgcaagggccaccggccggaggttccatgagcagccagacagcacagtccctcggggcctcggtgttctcggggcctggatacagcctctggggcaccagcagaagactctggaggcagcaggggatgccagagtgaacaaggggtcccaagccagttccctgcccctggtctggtctcccccaaaagacctgggtgcaaggaaaaggagctgctctctctcttcttgcccctgcctcctagagggaggtctgggttcccttctatggctgaccagtgcctgtggggtgactgccaagcaccaggctccctccctccctgtgacatggcctgggctgacaacactccctctcctgggacctccttgcctcaggtgggtgttcaaaaactgtgccttcccactcgtctgtgcagaggctgggcctgaggtctcagtgtggagagcagcagaagacccaggaaagcacagttggcttccgtttctcctgctccctgtgtgtgttagaattttaacataaattccactttcataataagaaaaaaaaataag

SEQ ID NO: 408987 - DNA, 1193 bp, Homo sapiens
aggcgggcggatatgccctagcgttatctaggggctggcccggggaatggcgtgggggcggcggggccaagcaagcgccacctctgattgggcaaaaccccctcccctcacctgccaatagaaaccggcccactgtacagacgcgcaagtttataacccgggaagagctgctctcagagcggagggagaccatataaccctgggactctgccgtacctcctagaggaacagagcgcctctcaggcgtcagaggctgctgcaaatgcgggtcagcgggtcacggtcgcgcctgtcttgctgatgctcatgggaaatgtagttcaaagggcatgggcggtgccttcggtgcaggcgagagattggtcagcgcggcgtcgccggggcaacacccggctgaggcgccccgcgttgtgcggcgccacatccgggaagcggcctccaagcaaccgctccgggttgaggcccatcttgacgattccaagaccacccccttgagcaagaatgccatcccctctgggtcccccatgcctgcccgtcatggacccagagaccacccttgaggagcctgagactgcccgcctccgcttccgagggttctgctaccaggaggtggcaggtccccgagaagccctggcccggctgcgtgagctgtgttgccagtggctgcagcctgaggcacactccaaggagcagatgctggagatgctggtgctggagcagttcctgggcacactgcctcccgagatccaggcctgggtgcgcggtcagcggccaggcagtcctgaggaggccgctgccctagtcgaaggactgcagcatgaccctgggcaactgttgggctggatcacagcccatgtcctgaagcaggaggtgctccctgcagcccagaagacagaggaaccacttgggagcccccacccctcagggacagtggagtcccctggggaaggtccccaggacaccagaatagaggggtctgtccagctcagctgcagtgtgaaggaggagcccaatgtcgatggacaggaagtggcaccctccagccctccacttgcagcacagtcccctgaggggaaccatggacaccaagaaccagcctccacatccttccacccacccaggattcaggaggagtgggggcaggtggcacgggaccgaaaggacgtgcctgggattgcacgtggcgacagaag

SEQ ID NO: 408988 - DNA, 723 bp, Homo sapiens
agccaagtcactggggcggtggggacgatacttctcatttgtagcctttcaatttggtgctctgtctggctgttttgagagctaaactccccattgctcttctggaaggagagctcgctgtccagtactgcgcgggatgaccgagtgaacaggggactggagacgagatgtggctggagactgagagaagcagaggagtcacactccactcacctccacctcccaaagtgccgggatcacaggcttgtgccactgcgcccaaacataactgaaggttttacagacatgtctgtggcaccacagaacacgaacggtcccaatggaaaccccacgcccaatttcctcagggaactgctgtggcggaggcttgcaccccacgtggtggccctaggtacaacggattccggcgggcagagcgccttagatcccgagtctgcagcccagggcagagtgccaacttctcctcatcccttcgtacgccatagaatggaaagacactggggctcctctgttaggagcgtaggagggacaggctggacaaaagggctcccgaacagcaggttcggaggagagcaacccggccctgacccccgcccccaacaccgttcccgacctcgctccccaatatcccggctctgcaccaattcctcccgcaagccaaggaaccccgaggcactcctagtctctaaaccgtttatttctccccaccagaaggttggggtg

SEQ ID NO: 408989 - DNA, 728 bp, Homo sapiens
ggaaggggtgccccatcccaagatgggtgccacccttccagactccctggagcttctattctccttcctcttcctaatcttcaccccacccagccccattgctcttctggaaggagagctcgctgtccagtactgcgcgggatgaccgagtgaacaggggactggagacgagatgtggctggagactgagagaagcagaggagtcacactccactcacctccacctcccaaagtgccgggatcacaggcttgtgccactgcgcccaaacataactgaaggttttacagacatgtctgtggcaccacagaacacgaacggtcccaatggaaaccccacgcccaatttcctcagggaactgctgtggcggaggcttgcaccccacgtggtggccctaggtacaacggattccggcgggcagagcgccttagatcccgagtctgcagcccagggcagagtgccaacttctcctcatcccttcgtacgccatagaatggaaagacactggggctcctctgttaggagcgtaggagggacaggctggacaaaagggctcccgaacagcaggttcggaggagagcaacccggccctgacccccgcccccaacaccgttcccgacctcgctccccaatatcccggctctgcaccaattcctcccgcaagccaaggaaccccgaggcactcctagtctctaaaccgtttatttctccccaccagaaggttggggtg

SEQ ID NO: 408990 - DNA, 830 bp, Homo sapiens
  misc_feature (40)..(40): n is a, c, g, or t
atatatatatttagagtaatgtataaaattaaattaaaanaatattaatctagctgatctactggctgacctttgccgtgggccgctccttccgaggcttcggctacggcctgacgtttctgccactgctgtcgatgctgatgtggaacctctactacatgttcgtggtggagccggagcgcatgctcactgccaccgagagccgcctggactacccggaccacgcccgctcggcctccgactacaggccccgcccctggggctgagcctctccgccctcgccctcggagtagggggtagcggcttgggtctgacacatctttgaaccttgtggccaggcctggacttcgcccccaggcctaggaccgcgggcagccaaccagtcagaatgcctctcatttaggcctgcaagtcccatccaagggaaatgtgtggagatgcaagaaggcaacaccaaggggaccttatcaatagccctgtcccctgcccgcctccaaagtcccccaacaaagtatgaaggaagccccacctgggggtctccaggaagtcgaggctggcctctgaggttccacagaaaagcaagatgggggagtgaaggggccggctggaacttgatgctccaacctccagagtttcgaggcacagcaagacaggttcagtaatgtccttccctccagagagcgggccttaatttatggactggtactctgagtacttcttggggtgcagcagcagaaccaagccgccccctagcagcatgagccctggggcacccagggccactggcatgatgcccaggactaggggggacaagccgtccactggaggga

SEQ ID NO: 408991 - DNA, 2215 bp, Homo sapiens
gttgccagaactaactctgggcagcatggcgtctttccggcttctccaaacccttgcgaaaaactttattggcaaagctatcagagaacggacagtgtacccactgaggcggccaaagcttaactggatcagggcaggatgacatgaccttgtggtagatcccagaactgaggccccaggatgacagaacaggagaccctggccctactggaagtgaagaggtctgattccccagagaagagctcaccccaggccttggttcccaatggccggcagccagaaggggaaggtggggccgaatccccgggagctgagtccctcagagtggggtcttcagctggatctcccacagccatagagggggctgaggatggtctagacagcacagtaagtgaggctgccaccttgccctgggggactggccctcagcccagtgctccgttcccggatccccctggctggcgggacattgaaccagagccccctgagtcagaaccacttaccaagctagaggagctgcccgaagacgatgccaacctgctgcctgagaaagcggcccgtgccttcgtgcctattgacctacagtgcattgagcggcagccccaagaagaccttatcgtgcgctgtgaggcaggcgagggcgagtgccgaaccttcatgcccccccgggtcacccaccccgaccccactgagcgcaagtgggctgaggcagtggtgaggccgcctggctgttcctgtgggggctgcgggagctgtggagaccgtgagtggctaagggctgtggcctccgtgggagccgcactcattctcttcccttgcctactatacggggcatatgccttcctgccgtttgatgtcccacggctgcccaccatgagttcccgcctgatctacacactgcgctgcggggtctttgccaccttccccattgtgctggggatcctggtgtacgggctgagcctgttatgcttttctgcccttcggccctttggggagccacggcgggaggtggagatccaccggcgatatgtggcccagtcggtccagctctttattctctacttcttcaacctggccgtgctttccacttacctgccccaggataccctcaaactgctccctctgctcactggtctctttgccgtctcccggctgatctactggctgacctttgccgtgggccgctccttccgaggcttcggctacggcctgacgtttctgccactgctgtcgatgctgatgtggaacctctactacatgttcgtggtggagccggagcgcatgctcactgccaccgagagccgcctggactacccggaccacgcccgctcggcctccgactacaggccccgcccctggggctgagcctctccgccctcgccctcggagtagggggtagcggcttgggtctgacacatctttgaaccttgtggccaggcctggacttcgcccccaggcctaggaccgcggtgggtggaaccctgctactgccccaacagggactccaatcaatcggagttctccccttgccggagctgcccttcacctttggggcccgagacagtcataagggatggacttagttttcttgcagggaaaaaggtggacagccgtgtttcttaaggatgctgagggcatggggccaggaccaggggagaggcacagctccttcctgagcagcctctcaccactgccacaaggctccctaatgctggtctctgctccactccccggcttcccgtgaggcaggaggcagagccacagccaaggccctgaccacttctgtgccagttgtctaagcagagcgcctcagggacgctggaaatgccttaaggatagaggctgggcatcacatcaaatgggactgtggtgtttggtgaaaaccttcctgaggatctggattcaggaccctccatgactggcctatttactgtttacagctggccagtgcagagctgctgctcttttacctttttaggcccctgtaacttcccacctttaaactgcccagaaggcatgcctctcccacaggaagaggggagcagacagggaaatctgcctaccaagaggggtgtgtgtgtctttgtgcccacacgtggtggctggggagtgcctggatggtgcggtggttgatgttaacctagtgtgtgtgtgtgtgtgtgtgtgtgtgtgtgtgtgtgtgtgtgtgtaacaataaattactaccagtcaaaaa

SEQ ID NO: 408992 - DNA, 2166 bp, Homo sapiens
gagggagacagagagaaatacttgcagagccagcaggtagctgggcagctccttcccggacggacggatggacagacgctggggaccctccactccatatggaaagatgacatgaccttgtggtagatcccagaactgaggccccaggatgacagaacaggagaccctggccctactggaagtgaagaggtctgattccccagagaagagctcaccccaggccttggttcccaatggccggcagccagaaggggaaggtggggccgaatccccgggagctgagtccctcagagtggggtcttcagctggatctcccacagccatagagggggctgaggatggtctagacagcacagtaagtgaggctgccaccttgccctgggggactggccctcagcccagtgctccgttcccggatccccctggctggcgggacattgaaccagagccccctgagtcagaaccacttaccaagctagaggagctgcccgaagacgatgccaacctgctgcctgagaaagcggcccgtgccttcgtgcctattgacctacagtgcattgagcggcagccccaagaagaccttatcgtgcgctgtgaggcaggcgagggcgagtgccgaaccttcatgcccccccgggtcacccaccccgaccccactgagcgcaagtgggctgaggcagtggtgaggccgcctggctgttcctgtgggggctgcgggagctgtggagaccgtgagtggctaagggctgtggcctccgtgggagccgcactcattctcttcccttgcctactatacggggcatatgccttcctgccgtttgatgtcccacggctgcccaccatgagttcccgcctgatctacacactgcgctgcggggtctttgccaccttccccattgtgctggggatcctggtgtacgggctgagcctgttatgcttttctgcccttcggccctttggggagccacggcgggaggtggagatccaccggcgatatgtggcccagtcggtccagctctttattctctacttcttcaacctggccgtgctttccacttacctgccccaggataccctcaaactgctccctctgctcactggtctctttgccgtctcccggctgatctactggctgacctttgccgtgggccgctccttccgaggcttcggctacggcctgacgtttctgccactgctgtcgatgctgatgtggaacctctactacatgttcgtggtggagccggagcgcatgctcactgccaccgagagccgcctggactacccggaccacgcccgctcggcctccgactacaggccccgcccctggggctgagcctctccgccctcgccctcggagtagggggtagcggcttgggtctgacacatctttgaaccttgtggccaggcctggacttcgcccccaggcctaggaccgcggtgggtggaaccctgctactgccccaacagggactccaatcaatcggagttctccccttgccggagctgcccttcacctttggggcccgagacagtcataagggatggacttagttttcttgcagggaaaaaggtggacagccgtgtttcttaaggatgctgagggcatggggccaggaccaggggagaggcacagctccttcctgagcagcctctcaccactgccacaaggctccctaatgctggtctctgctccactccccggcttcccgtgaggcaggaggcagagccacagccaaggccctgaccacttctgtgccagttgtctaagcagagcgcctcagggacgctggaaatgccttaaggatagaggctgggcatcacatcaaatgggactgtggtgtttggtgaaaaccttcctgaggatctggattcaggaccctccatgactggcctatttactgtttacagctggccagtgcagagctgctgctcttttacctttttaggcccctgtaacttcccacctttaaactgcccagaaggcatgcctctcccacaggaagaggggagcagacagggaaatctgcctaccaagaggggtgtgtgtgtctttgtgcccacacgtggtggctggggagtgcctggatggtgcggtggttgatgttaacctagtgtgtgtgtgtgtgtgtgtgtgtgtgtgtgtaacaataaattactaccagtctt

SEQ ID NO: 408993 - DNA, 1929 bp, Homo sapiens
gttgccagaactaactctgggcagcatggcgtctttccggcttctccaaacccttgcgaaaaactttattggcaaagctatcagagaacggacagtgtacccactgaggcggccaaagcttaactggatcagggcaggatgacatgaccttgtggtagatcccagaactgaggccccaggatgacagaacaggagaccctggccctactggaagtgaagaggtctgattccccagagaagagctcaccccaggccttggttcccaatggccggcagccagaaggggaaggtggggccgaatccccgggagctgagtccctcagagtggggtcttcagctggatctcccacagccatagagggggctgaggatggtctagacagcacagtaagtgaggctgccaccttgccctgggggactggccctcagcccagtgctccgttcccggatccccctggctggcgggacattgaaccagagccccctgagtcagaaccacttaccaagctagaggagctgcccgaagacgatgccaacctgctgcctgagaaagcggcccgtgccttcgtgcctattgacctacagtgcattgagcggcagccccaagaagaccttatcgtgcgctgtgaggcaggcgagggcgagtgccgaaccttcatgcccccccgggtcacccaccccgaccccactgagcgcaagtgggctgaggcagtggtgaggccgcctggctgttcctgtgggggctgcgggagctgtggagaccgtgagtggctaagggctgtggcctccgtgggagccgcactcattctcttcccttgcctactatacggggcatatgccttcctgccgtttgatgtcccacggctgcccaccatgagttcccgcctgatctacacactgcgctgcggggtctttgccaccttccccattgtgctggggatcctggtgtacgggctgagcctgttatgcttttctgcccttcggccctttggggagccacggcgggaggtggagatccaccggcgatatgtggcccagtcggtccagctctttattctctacttcttcaacctggccgtgctttccacttacctgccccaggataccctcaaactgctccctctgctcactggtctctttgccgtctcccggctgatctactggctgacctttgccgtgggccgctccttccgaggcttcggctacggcctgacgtttctgccactgctgtcgatgctgatgtggaacctctactacatgttcgtggtggagccggagcgcatgctcactgccaccgagagccgcctggactacccggaccacgcccgctcggcctccgactacaggccccgcccctggggctgagcctctccgccctcgccctcggagtagggggtagcggcttgggtctgacacatctttgaaccttgtggccaggcctggacttcgcccccaggcctaggaccgcgggcagccaaccagtcagaatgcctctcatttaggcctgcaagtcccatccaagggaaatgtgtggagatgcaagaaggcaacaccaaggggaccttatcaatagccctgtcccctgcccgcctccaaagtcccccaacaaagtatgaaggaagccccacctgggggtctccaggaagtcgaggctggcctctgaggttccacagaaaagcaagatgggggagtgaaggggccggctggaacttgatgctccaacctccagagtttcgaggcacagcaagacaggttcagtaatgtccttccctccagagagcgggccttaatttatggactggtactctgagtacttcttggggtgcagcagcagaaccaagccgccccctagcagcatgagccctggggcacccagggccactggcatgatgcccaggactaggggggacaagccgtccactggaggga

SEQ ID NO: 408994 - DNA, 1130 bp, Homo sapiens
agcaggctggtacgccggtgtagatatgtcgaccagcgtcgtctttccggcttctccaaacccttgcgaaaaactttattggcaaagctatcagagaacggacagtgtacccactgaggcggccaaagcttaactggatcagggcaggatgacatgaccttgtggtagatcccagaactgaggccccaggatgacagaacaggagaccctggccctactggaagtgaagaggtctgattccccagagaagagctcaccccaggccttggttcccaatggccccgcccctggggctgagcctctccgccctcgccctcggagtagggggtagcggcttgggtctgacacatctttgaaccttgtggccaggcctggacttcgcccccaggcctaggaccgcggtgggtggaaccctgctactgccccaacagggactccaatcaatcggagttctccccttgccggagctgcccttcacctttggggcccgagacagtcataagggatggacttagttttcttgcagggaaaaaggtggacagccgtgtttcttaaggatgctgagggcatggggccaggaccaggggagaggcacagctccttcctgagcagcctctcaccactgccacaaggctccctaatgctggtctctgctccactccccggcttcccgtgaggcaggaggcagagccacagccaaggccctgaccacttctgtgccagttgtctaagcagagcgcctcagggacgctggaaatgccttaaggatagaggctgggcatcacatcaaatgggactgtggtgtttggtgaaaaccttcctgaggatctggattcaggaccctccatgactggcctatttactgtttacagctggccagtgcagagctgctgctcttttacctttttaggcccctgtaacttcccacctttaaactgcccagaaggcatgcctctcccacaggaagaggggagcagacagggaaatctgcctaccaagaggggtgtgtgtgtctttgtgcccacacgtggtggctggggagtgcctggatggtgcggtggttgatgttaacctagtgtgtgtgtgtgtgtgtgtgtgtgtgtgtgtaacaataaattactaccagtctt

SEQ ID NO: 408995 - DNA, 2198 bp, Homo sapiens
gttgccagaactaactctgggcagcatggcgtctttccggcttctccaaacccttgcgaaaaactttattggcaaagctatcagagaacggacagtgtacccactgaggcggccaaagcttaactggatcagggcaggatgacatgaccttgtggtagatcccagaactgaggccccaggatgacagaacaggagaccctggccctactggaagtgaagaggtctgattccccagagaagagctcaccccaggccttggttcccaatggccggcagccagaaggggaaggtggggccgaatccccgggagctgagtccctcagagtggggtcttcagctggatctcccacagccatagagggggctgaggatggtctagacagcacagtaagtgaggctgccaccttgccctgggggactggccctcagcccagtgctccgttcccggatccccctggctggcgggacattgaaccagagccccctgagtcagaaccacttaccaagctagaggagctgcccgaagacgatgccaacctgctgcctgagaaagcggcccgtgccttcgtgcctattgacctacagtgcattgagcggcagccccaagaagaccttatcgtgcgctgtgaggcaggcgagggcgagtgccgaaccttcatgcccccccgggtcacccaccccgaccccactgagcgcaagtgggctgaggcagtggtgaggccgcctggctgttcctgtgggggctgcgggagctgtggagaccgtgagtggctaagggctgtggcctccgtgggagccgcactcattctcttcccttgcctactatacggggcatatgccttcctgccgtttgatgtcccacggctgcccaccatgagttcccgcctgatctacacactgcgctgcggggtctttgccaccttccccattgtgctggggatcctggtgtacgggctgagcctgttatgcttttctgcccttcggccctttggggagccacggcgggaggtggagatccaccggcgatatgtggcccagtcggtccagctctttattctctacttcttcaacctggccgtgctttccacttacctgccccaggataccctcaaactgctccctctgctcactggtctctttgccgtctcccggctgatctactggctgacctttgccgtgggccgctccttccgaggcttcggctacggcctgacgtttctgccactgctgtcgatgctgatgtggaacctctactacatgttcgtggtggagccggagcgcatgctcactgccaccgagagccgcctggactacccggaccacgcccgctcggcctccgactacaggccccgcccctggggctgagcctctccgccctcgccctcggagtagggggtagcggcttgggtctgacacatctttgaaccttgtggccaggcctggacttcgcccccaggcctaggaccgcggtgggtggaaccctgctactgccccaacagggactccaatcaatcggagttctccccttgccggagctgcccttcacctttggggcccgagacagtcataagggatggacttagttttcttgcagggaaaaaggtggacagccgtgtttcttaaggatgctgagggcatggggccaggaccaggggagaggcacagctccttcctgagcagcctctcaccactgccacaaggctccctaatgctggtctctgctccactccccggcttcccgtgaggcaggaggcagagccacagccaaggccctgaccacttctgtgccagttgtctaagcagagcgcctcagggacgctggaaatgccttaaggatagaggctgggcatcacatcaaatgggactgtggtgtttggtgaaaaccttcctgaggatctggattcaggaccctccatgactggcctatttactgtttacagctggccagtgcagagctgctgctcttttacctttttaggcccctgtaacttcccacctttaaactgcccagaaggcatgcctctcccacaggaagaggggagcagacagggaaatctgcctaccaagaggggtgtgtgtgtctttgtgcccacacgtggtggctggggagtgcctggatggtgcggtggttgatgttaacctagtgtgtgtgtgtgtgtgtgtgtgtgtgtgtgtaacaataaattactaccagtctt

SEQ ID NO: 408996 - DNA, 2208 bp, Homo sapiens
agcaggctggtacgccggtgtagatatgtcgaccagcgtcgtctttccggcttctccaaacccttgcgaaaaactttattggcaaagctatcagagaacggacagtgtacccactgaggcggccaaagcttaactggatcagggcaggatgacatgaccttgtggtagatcccagaactgaggccccaggatgacagaacaggagaccctggccctactggaagtgaagaggtctgattccccagagaagagctcaccccaggccttggttcccaatggccggcagccagaaggggaaggtggggccgaatccccgggagctgagtccctcagagtggggtcttcagctggatctcccacagccatagagggggctgaggatggtctagacagcacagtaagtgaggctgccaccttgccctgggggactggccctcagcccagtgctccgttcccggatccccctggctggcgggacattgaaccagagccccctgagtcagaaccacttaccaagctagaggagctgcccgaagacgatgccaacctgctgcctgagaaagcggcccgtgccttcgtgcctattgacctacagtgcattgagcggcagccccaagaagaccttatcgtgcgctgtgaggcaggcgagggcgagtgccgaaccttcatgcccccccgggtcacccaccccgaccccactgagcgcaagtgggctgaggcagtggtgaggccgcctggctgttcctgtgggggctgcgggagctgtggagaccgtgagtggctaagggctgtggcctccgtgggagccgcactcattctcttcccttgcctactatacggggcatatgccttcctgccgtttgatgtcccacggctgcccaccatgagttcccgcctgatctacacactgcgctgcggggtctttgccaccttccccattgtgctggggatcctggtgtacgggctgagcctgttatgcttttctgcccttcggccctttggggagccacggcgggaggtggagatccaccggcgatatgtggcccagtcggtccagctctttattctctacttcttcaacctggccgtgctttccacttacctgccccaggataccctcaaactgctccctctgctcactggtctctttgccgtctcccggctgatctactggctgacctttgccgtgggccgctccttccgaggcttcggctacggcctgacgtttctgccactgctgtcgatgctgatgtggaacctctactacatgttcgtggtggagccggagcgcatgctcactgccaccgagagccgcctggactacccggaccacgcccgctcggcctccgactacaggccccgcccctggggctgagcctctccgccctcgccctcggagtagggggtagcggcttgggtctgacacatctttgaaccttgtggccaggcctggacttcgcccccaggcctaggaccgcggtgggtggaaccctgctactgccccaacagggactccaatcaatcggagttctccccttgccggagctgcccttcacctttggggcccgagacagtcataagggatggacttagttttcttgcagggaaaaaggtggacagccgtgtttcttaaggatgctgagggcatggggccaggaccaggggagaggcacagctccttcctgagcagcctctcaccactgccacaaggctccctaatgctggtctctgctccactccccggcttcccgtgaggcaggaggcagagccacagccaaggccctgaccacttctgtgccagttgtctaagcagagcgcctcagggacgctggaaatgccttaaggatagaggctgggcatcacatcaaatgggactgtggtgtttggtgaaaaccttcctgaggatctggattcaggaccctccatgactggcctatttactgtttacagctggccagtgcagagctgctgctcttttacctttttaggcccctgtaacttcccacctttaaactgcccagaaggcatgcctctcccacaggaagaggggagcagacagggaaatctgcctaccaagaggggtgtgtgtgtctttgtgcccacacgtggtggctggggagtgcctggatggtgcggtggttgatgttaacctagtgtgtgtgtgtgtgtgtgtgtgtgtgtgtgtaacaataaattactaccagtctt

SEQ ID NO: 408997 - DNA, 1098 bp, Homo sapiens
tatgtaacattatgatttacatattttatgtgtttattttttgcaaaccaggctgatctactggctgacctttgccgtgggccgctccttccgaggcttcggctacggcctgacgtttctgccactgctgtcgatgctgatgtggaacctctactacatgttcgtggtggagccggagcgcatgctcactgccaccgagagccgcctggactacccggaccacgcccgctcggcctccgactacaggccccgcccctggggctgagcctctccgccctcgccctcggagtagggggtagcggcttgggtctgacacatctttgaaccttgtggccaggcctggacttcgcccccaggcctaggaccgcggtgggtggaaccctgctactgccccaacagggactccaatcaatcggagttctccccttgccggagctgcccttcacctttggggcccgagacagtcataagggatggacttagttttcttgcagggaaaaaggtggacagccgtgtttcttaaggatgctgagggcatggggccaggaccaggggagaggcacagctccttcctgagcagcctctcaccactgccacaaggctccctaatgctggtctctgctccactccccggcttcccgtgaggcaggaggcagagccacagccaaggccctgaccacttctgtgccagttgtctaagcagagcgcctcagggacgctggaaatgccttaaggatagaggctgggcatcacatcaaatgggactgtggtgtttggtgaaaaccttcctgaggatctggattcaggaccctccatgactggcctatttactgtttacagctggccagtgcagagctgctgctcttttacctttttaggcccctgtaacttcccacctttaaactgcccagaaggcatgcctctcccacaggaagaggggagcagacagggaaatctgcctaccaagaggggtgtgtgtgtctttgtgcccacacgtggtggctggggagtgcctggatggtgcggtggttgatgttaacctagtgtgtgtgtgtgtgtgtgtgtgtgtgtgtgtaacaataaattactaccagtctt

SEQ ID NO: 408998 - DNA, 463 bp, Homo sapiens
ctgccacctacaagataaagagtaagcaagatagagacagcaggaatgagctctccgacggagggcatgaacagcaagtgcaaaggccctgcgactcgaaagagcatgaaagactgaggaagcggccagtgtggctccaacacagtggaggagtggggggatcctactgagatagaggccctggagctggctcctccacagctctcaggaatgacagtaaacacagacggccctgcatgtattccggctgtggcagccttcctcctgggctgcacatcaggctaacaagcccagccctcagcttcacagggattggagagctggtgaccctagtcaaggaagctggtgaccctggatcagttgcctcccctctctgtgcctaaatcccccaccccacttctgtcaattaggaggatgatgccttcttcaaagtgttgtcataaagattaaatccttattaaag

SEQ ID NO: 408999 - DNA, 564 bp, Homo sapiens
attgtgacccagtttctcgtcaaccagtaaaacatccagtaacacagccaatggaaataaatgaatgggtctctgtttatagtgaagattctttcgttctccagctccaggcttcatacggtaaaactctctgggaaggaaaggaactcagagtcccatgcagaaaattgttcagctggaggggtatcagaaagatggatttccaaagccaactgtttcctgtagtgtgtggatctctgcaagcagagcctcatctttcaatttcagctacatgaaagaggaagaaagggaaagatatatgtcatacgtgatatactttatgtggctttgaagacccctcttttgtggggctacggctaaagaacatagttccctgggatggaattggctcttcctatttccctacttcatgaaaactccagtagaagaccttagaaccttgtcctggttacatggatatgtttactttgtgaaaattcatcaagcactatgcacggtcatgatttgtacatttttttgtaagataacttcattaaaatttactttttttatttttaaaaaaaa

SEQ ID NO: 409000 - DNA, 851 bp, Homo sapiens
acccctaacgtaccttaaactgctgcaaaagaggcgtttctcgtggtgtcttgtgggagtggcggtgcgatccctctcagacttgtgagtccctgctggagtcagaagttttaggcgaatcccaggcgcgccaaggaaagtgctacaaaagccatccatcttgcaagcgttggtgccgaggcgcaacgctgagaacgcaaatactaaagggcgctgttctttcctcgtggagctcacagtccgctggggagaccgtgagatgacagcagagaaactagcgcgatcagtagtactcagcgcaaggacagcgagcagagaaggcaaacctagtgcttgctaaggaagacttcacagaggaggtagtgtcagggccgagactaggagaaggattctccaggcttcatacggtaaaactctctgggaaggaaaggaactcagagtcccatgcagaaaattgttcagctggaggggtatcagaaagatggatttccaaagccaactgtttcctgtagtgtgtggatctctgcaagcagagcctcatctttcaatttcagctacatgaaagaggaagaaagggaaagatatatgtcatacgtgatatactttatgtggctttgaagacccctcttttgtggggctacggctaaagaacatagttccctgggatggaattggctcttcctatttccctacttcatgaaaactccagtagaagaccttagaaccttgtcctggttacatggatatgtttactttgtgaaaattcatcaagcactatgcacggtcatgatttgtacatttttttgtaagataacttcattaaaatttactttttttatttttaaaaaaaa

SEQ ID NO: 409001 - DNA, 1051 bp, Homo sapiens
acccctaacgtaccttaaactgctgcaaaagaggcgtttctcgtggtgtcttgtgggagtggcggtgcgatccctctcagacttgtgagtccctgctggagtcagaagttttaggcgaatcccaggcgcgccaaggaaagtgctacaaaagccatccatcttgcaagcgttggtgccgaggcgcaacgctgagaacgcaaatactaaagggcgctgttctttcctcgtggagctcacagtccgctggggagaccgtgagatgacagcagagaaactagcgcgatcagtagtactcagcgcaaggacagcgagcagagaaggcaaacctagtgcttgctaaggaagacttcacagaggaggtagtgtcagggccgagactaggagaaggattgtaagtgactagattttactttatccttctcgttaaccaaaattaatttacctctcaccttttctcctgttgtcgtcccacccctatcgaggcagtcacaccttaaaaaaaaaaggaggggttattcctgcttttgccgtgctgtgatccagggcagaggtgaagtatgattttttttttttttatctgtagccctagaatatgacctcggtgatgagggtaacggtgtctccttggagccctagtggtttagatccatgaagatgcctgtgtttggtgagaaggtgtcaatagctccaccttcagcaaagacctctctgttcagctttttcgtttactgttagttccaaagggctagcatgctctttgccctaatacagtgacccagcatagcagtcttcctccagggccacctttgaaaatgatgccttaattcctgtatttcagttaactgaacctgtccagaaaccttagcacctgacttcctccaggagtgatccaataagctttcatcagaaaccctaataatgaccccactataccttaattttattgtatgtatatatatgccatataattattatagcaattacactatagttatttatataactaaatacctacatgtaactcagtatacgttaactccagaaccatgct

SEQ ID NO: 409002 - DNA, 1010 bp, Homo sapiens
acccctaacgtaccttaaactgctgcaaaagaggcgtttctcgtggtgtcttgtgggagtggcggtgcgatccctctcagacttgtgagtccctgctggagtcagaagttttaggcgaatcccaggcgcgccaaggaaagtgctacaaaagccatccatcttgcaagcgttggtgccgaggcgcaacgctgagaacgcaaatactaaagggcgctgttctttcctcgtggagctcacagtccgctggggagaccgtgagatgacagcagagaaactagcgcgatcagtagtactcagcgcaaggacagcgagcagagaaggcaaacctagtgcttgctaaggaagacttcacagaggaggtagtgtcagggccgagactaggagaaggattgtaagtgactagattttactttatccttctcgttaaccaaaattaatttacctctcaccttttctcctgttgtcgtcccacccctatcgaggcagtcacaccttaaaaaaaaaaggaggggttattcctgcttttgccgtgctgtgatccagggcagagctccaggcttcatacggtaaaactctctgggaaggaaaggaactcagagtcccatgcagaaaattgttcagctggaggggtatcagaaagatggatttccaaagccaactgtttcctgtagtgtgtggatctctgcaagcagagcctcatctttcaatttcagctacatgaaagaggaagaaagggaaagatatatgtcatacgtgatatactttatgtggctttgaagacccctcttttgtggggctacggctaaagaacatagttccctgggatggaattggctcttcctatttccctacttcatgaaaactccagtagaagaccttagaaccttgtcctggttacatggatatgtttactttgtgaaaattcatcaagcactatgcacggtcatgatttgtacatttttttgtaagataacttcattaaaatttactttttttatttttaaaaaaaa

SEQ ID NO: 409003 - DNA, 976 bp, Homo sapiens
acccctaacgtaccttaaactgctgcaaaagaggcgtttctcgtggtgtcttgtgggagtggcggtgcgatccctctcagacttgtgagtccctgctggagtcagaagttttaggcgaatcccaggcgcgccaaggaaagtgctacaaaagccatccatcttgcaagcgttggtgccgaggcgcaacgctgagaacgcaaatactaaagggcgctgttctttcctcgtggagctcacagtccgctggggagaccgtgagatgacagcagagaaactagcgcgatcagtagtactcagcgcaaggacagcgagcagagaaggcaaacctagtgcttgctaaggaagacttcacagaggaggtagtgtcagggccgagactaggagaaggattgtaagtgactagattttactttatccttctcgttaaccaaaattaatttacctctcaccttttctcctgttgtcgtcccacccctatcgaggcagtcacaccttaaaaaaaaaaggaggggttattcctgcttttgccgtgctgtgatccagggcagagctccaggcttcatacggtaaaactctctgggaaggaaaggaactcagagtcccatgcagaaaattgttcagctggaggggtatcagaaagatggatttccaaagccaactgtttcctgtagtgtgtggatctctgcaagcagagcctcatctttcaatttcagctacatgaaagaggaagaaagggaaagatatatgtcatacgtgatatactttatgtggctttgaagacccctcttttgtggggctacggctaaagaacatagttccctgggatggaattggctcttcctatttccctacttcatgaaaactccagtagaagaccttagaaccttgtcctggttacatggatatgtttacctttcacccccccatcaccggccccaaagctccaatgtcggagtctttctaggtcgcgaccggg

SEQ ID NO: 409004 - DNA, 214 bp, Homo sapiens
tcatgttgggcagaatggtctcaaactcctggcctcaagtgatccatctgcctcagcctcccaaagtgctgggatgacaggcataagccaccgcgcccagcctgagttttcttattcttattttatatacagtgtcaaaggttcttagttttacttaggaggagaaatagggaaaagtacatctgctccatcttcctggatgtggaagtccagt

SEQ ID NO: 409005 - DNA, 1196 bp, Homo sapiens
atagaacatttttgctcaaatcaaataatgatggtattgcaattctgcaaatgtttggagttactggcctaaaggtaagaggagcaagattagttgataagttgaatgaatagacagggcagagccagtatacctttggtgaactagtaagtttatttgcgtgggacattttttttctctttgcagtactggcatagctgggtgcagtggctcatgcctataatcccagcactttgggaggccgaggcgggcagatcacttgagcccaggagttagagaccagcctgggcaacatgatgaaaccccatctctacaaaaagtagaaaaattagccaggtgtggtggtgcacacctgtagtctaagctacttgggaggctgagataggaggattgcttgaggcagggaggtcaaggctgcagtgagctgagatcatgctactgcactccagtctgggtgacagggcaagattctgtctcaacaaacaaacaaacaaacaaactagtacagaatatttcattaaaatgtttatgtcatttgaattatgttaattatacttcctaaatggaataatggtatcttattattaaaccagaataataaatatgaacttgaatatatttaaatgctaggcaccattctatgaaaatctgtctgcttcatgtttattattgaaataatctaaattaattttagaacacttaaaatcgaaaacatctccaaagtgtagttcttctctttctaacagtatgatagttcatttgtttaagaaaactattcccattatttgggtattcaaacatgtttttacttaggagctctttttgcatggaatgtactagactatggtattggatgataatggaaagaagataatctccccattcgtaaaatcagaaatttatttgatcaataaaacttcttttctggaacacaactccttggatgtgtgagcctatcagacattaggagaataattttaataagcttttgaatggaagatttgatcactatgattagagacggagcagtgggagatgatagtgtcttggtgctagcaccaagctagcactaatagatgatggcacctatttatgacccaaattctaaatttcttttggtatttagagacatctcccaaatatgtatttccccatagtgattattctaactgacctttagcattctgtctgtccta

SEQ ID NO: 409006 - DNA, 328 bp, Homo sapiens
agggctcgtggggaaaaaacaagagatggtgcttccctaaggacagtgtccttattctggcaggaagatgacagggggaaccatggtggagagggaccatgcagacctgaagcagccagaactttccaccttgctcctttcttcatggtggggatttcctatgacacagcctgttgctttgtttactattatttatctgctatggtttatctataatgactactagtatttgtgtggtcagataatgggccattttgtttactctccatatttaaaaaacagtgttagaaatatataccccaaattaaaagggctattctgaaacagc

SEQ ID NO: 409007 - DNA, 401 bp, Homo sapiens
cggccgccctactcgtattcggcgctcatcgccatggccattcagagcgcgcccgagcgcaaactcactctcagccacatctaccagttcgtcgccgatagcttccccttctaccagcgcagcaaggccggctggcagaactccatccgccacaacctgtcgctcaacgactgcttcaagaaggtgccccgcgacgaggacgacccaggaaagggtaattattggactcttgatccgaactgcgagaaaatgtttgacaatgggaacttccgtcggaagcgaaagcgccgctctgaggccagcaatggctccacagtggctgctgggacatcaaagtccgaagaagggctctcctcaggattggggtctggagtgggtgggaagccagaagaagagagccc

SEQ ID NO: 409008 - DNA, 523 bp, Homo sapiens
cggccgccctactcgtattcggcgctcatcgccatggccattcagagcgcgcccgagcgcaaactcactctcagccacatctaccagttcgtcgccgatagcttccccttctaccagcgcagcaaggccggctggcagaactccatccgccacaacctgtcgctcaacgactgcttcaagaaggtgccccgcgacgaggacgacccaggtgagggccgctggcaggtgcttcccagccggggagggcggacgcgggtcgcaagggccggcgcaggggtcggtgtgcggctggaagatctgccaggagtcttcttgtccaggctgcgggtgggagcggatggaggaataaccacccaacccagaggacaaagggaaggagcaggagatcttcggaaggaagactcagtgagaaaggagcttgacctttacatccacattcgcagaggcgggccaattagagaaacgaaaaaaatctgtatcccagaacagaaggctacccctgggtggtgttccttaggccttt

SEQ ID NO: 409009 - DNA, 4282 bp, Homo sapiens
  misc_feature (1327)..(1327): n is a, c, g, or t
ttcatccttcgtccatctcgctttatccagaggacattcactgacattggcattaaatactatcgaaatgagtttaaaatgaaagtgccgatcatcatggtaaactctgtctctgaccttcacggctacatcgacaaaagccaactgacccgggaattaggggggactttggaatatcgccacggtcagtgggtaaatcaccgcactgccatcgaaaactttgccttgaccttgaagaccactgcccagatgctgcagacgtttgggtcctgcctggccacagcagagctgcccagaagcatgctatccacggaagaccttctcatgtcccacacaaggcagcgggacaagctgcaggatgagctgaaattacttggaaagcaggggaccacattgctgtcatgcatccaagaaccagcaaccaaatgtcccaacagcaaactcaatctcaaccaacttgagaatgtaactaccatggaaaggttattagttcaactggatgaaacagaaaaagcctttagtcacttttggtctgagcatcatctgaagcttaaccagtgcctacaactacagcattttgagcacgatttttgtaaggctaagcttgccctggataatttgctggaagagcaagcagagtttacaggcattggagacagcgtgatgcacgtggagcagattcttaaggaacacaaaaaactggaggaaaaaagccaggagcccctggaaaaggcccagctgctggcactggttggggaccagctcatccaaagccaccattatgcagcagatgccatcaggccccggtgtgtggagctcaggcacctctgtgacgatttcatcaatggaaacaagaaaaaatgggacattttaggaaagtccttagagtttcatagacagctggacaaggtcagccaatggtgtgaggcaggaatctacctcttggcttcccaagctgtagacaagtgccagtctcgagaaggggttgatatcgccttgaacgacattgcgacattcctgggcacagtcaaggagtacccgttgctcagccccaaggagttttacaacgagtttgagttgctgctcaccctcgatgcaaaggccaaagcccagaaagttttgcagaggctggatgatgtccaggaaatatttcacaagaggcaagtgagtctgatgaaactggcagccaaacagactcgtccagtgcaacctgtggccccacatcctgagtcttcaccaaaatgggtgtcatcaaaaaccagccagccctccacctcggtccctctagctcgtcctctgagaacgtctgaggaaccttatacggagncagagttgaactcccggggaaaggaagatgatgagactaaatttgaagtcaagagtgaagaaatctttgaaagccatcatgaaagggggaaccctgagctggagcagcaggccaggctcggagacctttccccccgcaggcgcattatacgtgacttgcttgagactgaagagatttacataaaagagattaaaagcataattgatggatatatcactccaatggattttatttggctaaagcatctaattccagatgttcttcagaataacaaggactttctctttgggaatattagagaactttacgaatttcacaacaggacttttctaaaagagttggaaaagtgtgctgagaaccctgaacttctggcacattgctttctcaagagaaaagaagatcttcagatatattttaaataccataagaatctgccccgagctagggcaatctggcaagagtgtcaagactgcgcctactttggggtatgccagcgccaactggatcacaatctccctctttttaagtatctcaaaggaccaagccagagacttataaaataccagatgctgttgaagggtctgctggatttcgagtctcctgaagatatggagatagacccaggtgaactaggaggctcggctaaggatgggccaaagagaaccaaagattcagcattctcaactgaactacaacaagctttggcagtgatagaggatttgatcaagtcctgtgagttggctgtggacctagcagcagtgactgaatgtccggacgatattggaaaactaggcaagctgttgctgcacggccctttcagcgtctggacaattcacaaggatcgttataaaatgaaggatttgattcgatttaaacccagccagaggcaaatctacctatttgaaaggggaatagtgttctgtaagatacgaatggagcctggggaccagggattatctcctcattacagcttcaagaaggccatgaagctgatgacactttcaattcgccagcttggaagggggagccatagaaagtttgagattgccagtcgaaatggacttgagaaatacatcctgcaggcagcttcaaaagaaatcagagactgttggttttcagaaataagtaaattattgatggaacaacaaaataatatcaaagaccaaggaaatccacagtttgaaatgagcacgagcaaaggcagtggagcaggatccggaccatggattaaaaatatggaaagagctaccactagcaaggaagacccggcctccagcacaggagggattaaaggctgctccagcagggagtttagctccatggacacctttgaagactgtgaaggcgcagaagacatggaaaaggagagcagtgctctgagtctcgcgggccttttccagtcggacgacagtcacgaaacctgttcctccaaatctgctttcctggagaggggagaaagcagccagggagaaaaagaagaacgcgatgaggaggaaacggcgacccgcagcaccgaggaggagcgcgctggggcgtccacgggccggctggctcctgcgggggcgacggctggtttccaggcgagggcgctgcgcccgaggacctccgcccaggagagctgacctccctgcggacgcccccgctcctcggctccagagcgcccgcattcccgggagaggcggtgtgggggcccgggccctgcccagctacgcagaaagcagccggagcctcggcggcggcagaaaggggacaaccagggcctcctccgaggagcccgaggggtgtcctgggtgcgcgcctagctccgcacgggggacctcggagctgctctaaggcgcctgcagaggcgagcagagcccgcagcccacgccttctcgaccgcgcacttcgacattcggagccgggcaattctttgctgcgtgggcttctctgtgctcccacggtaggatgtttagtagcacccctggcctctacccactaggtgccaggaatgcgccaccccatcctccaccccgcccccaaatcgtgacaatcaaaaatgcctgcagacacgcccgcatttctccagggcggggtgggaatcggttgagagccgcttagcccgagccttggaggagccggagccgctcaaacccggcgggggccgcagactgggagctcccggtccgcctcccagcatccctgcgagcgttcatggggtgttcgtgttagtgccaagattgcttcgttgtagagagagttcgttccaagttactttctgaggtattttatgtatcgatttattagtttttaaatgagttttgttagtttcagttgtattttatttttagttttattagttgattttcatttctttgtagctttctggttatttaattttatagtttcagttactggtttatagttactttattttcaaagttatttagttgttcattttcagttatttatatgtagttgttttgttttaggagttacagatgttcaaattaatttgcttggaatttatttatttatttatttatttttcgagacggagtctcgctctgtcgcccaggctggagtgcagtggtgtgatctcggctcactgcaaaccgcctcccgggttcacgccattctcctgcctcagcctcctgagtagctgggactacaggcgcccgccaccacgcccggctaattttttatttggatttttagtagagacggggtttccccgtgttagccaggatggtctcgatctcctgacctcgtgatccccctgcctcggcctcccaaagtgctgggattacaggcgtgagccaccgcgcccagccggaatttatttttaattatctttacaattattatctgagttatttaccttcatagttatttcactttatcttattggagtttttgagttatttatttttacagtaacttatttgactattaaacactcactggaagttcatg

SEQ ID NO: 409010 - DNA, 2776 bp, Homo sapiens
  misc_feature (2724)..(2724): n is a, c, g, or t
tatctttatgattttttattattctaaatgtggtacatattcactgtaaataatctaggaaaaaaataagacaaaaacttaagttgcctatcattttcccacttagaaagacaaccactttggcgtgttgcattttgatcttttttctctgtatagttactttatattgcttttcaggtcacatggtaaatggaaatgcagaggtattggcactggaaacttcttttcatataactcttcaggtagcataagggctccctgtctttctgttcaagtgtctcagtggagttcaaaagagcaaagaaaatgagtcttttttaaaaattgaataattagaactcatcacctatctaatgtcctcccagcatccagaaactcttgagtatcgctgtgctgagttacaaagctttgcattcttgcttccttacgaaagacaaacgccagtaaatgcaaatagggatcacctgggaatccaaagatgaaagttgtgtttttgttaaaagggacatgcccttctcccaggaaatgtaagggccaggtctaatgtcttattaatcaccctgtgttctggtaaccaattcggatgcaagaagagtggactagcaggtaaaccccaaaagccattgattacatttctctatggttagaccagcctaagagatatttagctataaggctgggtgggtgcagtgcctcacacctgtaatcccagcactttgggaggccgaggtgggaggattgcttgagcccaggagttcgagagcagcctcggcaacatggccaaaacctgtctcaaaaaaaggaaagaaagaaagagagagagacagagagaaagaaagaggaaggaaggaaggaaggaaggaaggaaggaaggaaggaaggaaggaagggaggaaggaaggaaaaattagcctggtgtggtggcatgcatctgtagtcccagctactcaggaggctaaggtggaagaatcacctgagcctggggtagacctctccaggctgcattaagccataattgcactactgcactccagcctgggtgacagagtgaaaccctgtcttaaattaaatatatatttagctgtctcctcctggagatgtagcaattactgttaatggaagagactcattttgctgaccgagtgacttccctgagaagtggacaggtatcagctggtttgggtttgtccccctcatagtgtaatttacagtggttagaccccttaaactcgatgccgtcccatgacaatttcccattgtctgggaatccttgtagacaccttacaagctcagacctgctgaggattacggtggctctgagttgtggtcaggcgaagtgcacagggcactgtttctttccaaaaggtcagccaatggtgtgaggcaggaatctacctcttggcttcccaagctgtagacaagtgccagtctcgagaaggggttgatatcgccttgaacgacattgcgacattcctgggcacagtcaaggagtacccgttgctcagccccaaggagttttacaacgagtttgagttgctgctcaccctcgatgcaaaggtaatgcttccgggttattttgatcctgtggttgggaaacggataggggagggagggactgtaccttcttcctgataaagtacacacagggtactgagcaggctgaattgagtgggctcactggttccgaagccctccggcggcctcttagactctcggcctgaacgtcctggcatactgagtcttcgtctgactcaaatcagtcatttctctattaatgcttatgagcattcctgatgtaccatgtgctgtgctgagtgctgaggataccatgatgattaaaaataggcatgcttccatccctcactgagcttacagtttgtgggagaggctgacattaacaaaataatcacacaaaaatgtgttacaagctgatataagtgctgtcaaggagggatgcagggtcaggcatgtgacagaggaacttgacctggactggggtcagagaaggctctcaggaagagtcacttgagcctggagaacgaatagacaagatgggagagcctttccagacaggaggaacagcatgtgcaaaggcttcagggctggagggagcctggcacagtgcagaccaaaaggtcagggtgctggaacctagagagcaatggaagtgtgttttgggtgaggttagagagaggcaggcaaggtaggctttgtgggccacatgagcgagtttggatttaagcagggagataacttgattggatttgcatttgagaagcatattcttccatgaagccagcagggttgtaggtagcacaccttcctctgagagccacatcatcaccttgtctgcacctctggtttaggagcttcttttaatcagcttccttgaaagagtccggaagaaagtgagttttaggcttttcttcttggaggcagaaacagagtgggaacgagggttctcagcagacttttcttagagagagagaaagctgcgtccgtttgccaatttgtttagtcatcctgtattctgggcagattaggacgtagccaccgctgtccataaatccctcctggttggaggaattgcatcaccatgttttctcaagttaggaaactgtatgaaatttcatactgtcctgatcagccacctaaaaaagtaaatagcaatttttaaaaatagattcacctgatttaacacccaggaggtctgtggaatcattnagtaatattaaaagggtttcattgtggtcctcttcaaaagtgaacatcagcc

SEQ ID NO: 409011 - DNA, 573 bp, Homo sapiens
ttctaatgtttcttgtaggctaagcttgccctggataatttgctggaagagcaagcagagtttacaggcattggagacagcgtgatgcacgtggagcagattcttaaggaacacaaaaaactggaggaaaaaagccaggagcccctggaaaaggcccagctgctggcactggttggggaccagctcatccaaagccaccattatgcagcagatgccatcaggccccggtgtgtggagctcaggcacctctgtgacgatttcatcaatggaaacaagaaaaaatgggacattttaggaaagtccttagagtttcatagacagctggacaaggtgagcaaaacacagccaagaacatgatgtctgcaagattttctgtgaagaagcttccatcatactcgtcctcccttccttgtgtgattgctgagaggcttgagtgctttatgtgaaaagatgttcgagaggcattaaaaactgtgcagatcctggggtgtagaagtatacctggcacgaaggtaaaaagtgctctggccatcccaccacatcccattaaagttaactgaagcccatttctat

SEQ ID NO: 409012 - DNA, 2752 bp, Homo sapiens
  misc_feature (2700)..(2700): n is a, c, g, or t
tatctttatgattttttattattctaaatgtggtacatattcactgtaaataatctaggaaaaaaataagacaaaaacttaagttgcctatcattttcccacttagaaagacaaccactttggcgtgttgcattttgatcttttttctctgtatagttactttatattgcttttcaggtcacatggtaaatggaaatgcagaggtattggcactggaaacttcttttcatataactcttcaggtagcataagggctccctgtctttctgttcaagtgtctcagtggagttcaaaagagcaaagaaaatgagtcttttttaaaaattgaataattagaactcatcacctatctaatgtcctcccagcatccagaaactcttgagtatcgctgtgctgagttacaaagctttgcattcttgcttccttacgaaagacaaacgccagtaaatgcaaatagggatcacctgggaatccaaagatgaaagttgtgtttttgttaaaagggacatgcccttctcccaggaaatgtaagggccaggtctaatgtcttattaatcaccctgtgttctggtaaccaattcggatgcaagaagagtggactagcaggtaaaccccaaaagccattgattacatttctctatggttagaccagcctaagagatatttagctataaggctgggtgggtgcagtgcctcacacctgtaatcccagcactttgggaggccgaggtgggaggattgcttgagcccaggagttcgagagcagcctcggcaacatggccaaaacctgtctcaaaaaaaggaaagaaagaaagagagagagacagagagaaagaaagaggaaggaaggaaggaaggaaggaagggaggaaggaaggaaaaattagcctggtgtggtggcatgcatctgtagtcccagctactcaggaggctaaggtggaagaatcacctgagcctggggtagacctctccaggctgcattaagccataattgcactactgcactccagcctgggtgacagagtgaaaccctgtcttaaattaaatatatatttagctgtctcctcctggagatgtagcaattactgttaatggaagagactcattttgctgaccgagtgacttccctgagaagtggacaggtatcagctggtttgggtttgtccccctcatagtgtaatttacagtggttagaccccttaaactcgatgccgtcccatgacaatttcccattgtctgggaatccttgtagacaccttacaagctcagacctgctgaggattacggtggctctgagttgtggtcaggcgaagtgcacagggcactgtttctttccaaaaggtcagccaatggtgtgaggcaggaatctacctcttggcttcccaagctgtagacaagtgccagtctcgagaaggggttgatatcgccttgaacgacattgcgacattcctgggcacagtcaaggagtacccgttgctcagccccaaggagttttacaacgagtttgagttgctgctcaccctcgatgcaaaggtaatgcttccgggttattttgatcctgtggttgggaaacggataggggagggagggactgtaccttcttcctgataaagtacacacagggtactgagcaggctgaattgagtgggctcactggttccgaagccctccggcggcctcttagactctcggcctgaacgtcctggcatactgagtcttcgtctgactcaaatcagtcatttctctattaatgcttatgagcattcctgatgtaccatgtgctgtgctgagtgctgaggataccatgatgattaaaaataggcatgcttccatccctcactgagcttacagtttgtgggagaggctgacattaacaaaataatcacacaaaaatgtgttacaagctgatataagtgctgtcaaggagggatgcagggtcaggcatgtgacagaggaacttgacctggactggggtcagagaaggctctcaggaagagtcacttgagcctggagaacgaatagacaagatgggagagcctttccagacaggaggaacagcatgtgcaaaggcttcagggctggagggagcctggcacagtgcagaccaaaaggtcagggtgctggaacctagagagcaatggaagtgtgttttgggtgaggttagagagaggcaggcaaggtaggctttgtgggccacatgagcgagtttggatttaagcagggagataacttgattggatttgcatttgagaagcatattcttccatgaagccagcagggttgtaggtagcacaccttcctctgagagccacatcatcaccttgtctgcacctctggtttaggagcttcttttaatcagcttccttgaaagagtccggaagaaagtgagttttaggcttttcttcttggaggcagaaacagagtgggaacgagggttctcagcagacttttcttagagagagagaaagctgcgtccgtttgccaatttgtttagtcatcctgtattctgggcagattaggacgtagccaccgctgtccataaatccctcctggttggaggaattgcatcaccatgttttctcaagttaggaaactgtatgaaatttcatactgtcctgatcagccacctaaaaaagtaaatagcaatttttaaaaatagattcacctgatttaacacccaggaggtctgtggaatcattnagtaatattaaaagggtttcattgtggtcctcttcaaaagtgaacatcagcc

SEQ ID NO: 409013 - DNA, 2678 bp, Homo sapiens
  misc_feature (1759)..(1759): n is a, c, g, or t
tatctttatgattttttattattctaaatgtggtacatattcactgtaaataatctaggaaaaaaataagacaaaaacttaagttgcctatcattttcccacttagaaagacaaccactttggcgtgttgcattttgatcttttttctctgtatagttactttatattgcttttcaggtcacatggtaaatggaaatgcagaggtattggcactggaaacttcttttcatataactcttcaggtagcataagggctccctgtctttctgttcaagtgtctcagtggagttcaaaagagcaaagaaaatgagtcttttttaaaaattgaataattagaactcatcacctatctaatgtcctcccagcatccagaaactcttgagtatcgctgtgctgagttacaaagctttgcattcttgcttccttacgaaagacaaacgccagtaaatgcaaatagggatcacctgggaatccaaagatgaaagttgtgtttttgttaaaagggacatgcccttctcccaggaaatgtaagggccaggtctaatgtcttattaatcaccctgtgttctggtaaccaattcggatgcaagaagagtggactagcaggtaaaccccaaaagccattgattacatttctctatggttagaccagcctaagagatatttagctataaggctgggtgggtgcagtgcctcacacctgtaatcccagcactttgggaggccgaggtgggaggattgcttgagcccaggagttcgagagcagcctcggcaacatggccaaaacctgtctcaaaaaaaggaaagaaagaaagagagagagacagagagaaagaaagaggaaggaaggaaggaaggaaggaagggaggaaggaaggaaaaattagcctggtgtggtggcatgcatctgtagtcccagctactcaggaggctaaggtggaagaatcacctgagcctggggtagacctctccaggctgcattaagccataattgcactactgcactccagcctgggtgacagagtgaaaccctgtcttaaattaaatatatatttagctgtctcctcctggagatgtagcaattactgttaatggaagagactcattttgctgaccgagtgacttccctgagaagtggacaggtatcagctggtttgggtttgtccccctcatagtgtaatttacagtggttagaccccttaaactcgatgccgtcccatgacaatttcccattgtctgggaatccttgtagacaccttacaagctcagacctgctgaggattacggtggctctgagttgtggtcaggcgaagtgcacagggcactgtttctttccaaaaggtcagccaatggtgtgaggcaggaatctacctcttggcttcccaagctgtagacaagtgccagtctcgagaaggggttgatatcgccttgaacgacattgcgacattcctgggcacagtcaaggagtacccgttgctcagccccaaggagttttacaacgagtttgagttgctgctcaccctcgatgcaaaggccaaagcccagaaagttttgcagaggctggatgatgtccaggaaatatttcacaagaggcaagtgagtctgatgaaactggcagccaaacagactcgtccagtgcaacctgtggccccacatcctgagtcttcaccaaaatgggtgtcatcaaaaaccagccagccctccacctcggtccctctagctcgtcctctgagaacgtctgaggaaccttatacggagncagagttgaactcccggggaaaggaagatgatgagactaaatttgaagtcaagagtgaagaaatctttgaaagccatcatgaaagggggaaccctgagctggagcagcaggccaggctcggagacctttccccccgcaggcgcattatacgtgacttgcttgagactgaagagatttacataaaagagattaaaagcataattgatggatatatcactccaatggattttatttggctaaagcatctaattccagatgttcttcagaataacaaggactttctctttgggaatattagagaactttacgaatttcacaacaggacttttctaaaagagttggaaaagtgtgctgagaaccctgaacttctggcacattgctttctcaagagaaaagaagatcttcagatatattttaaataccataagaatctgccccgagctagggcaatctggcaagagtgtcaagactgcgcctactttggggtaatgttgagaagacaaacttcttcctggaaaatgtttctatgcatcaagttgttaaagaaatcaaaagtgggactagggagaggaacttggcattgcgatttatgtttatttaaagtgtcccatactttgaaattacacatgaaaagttgtaatgggataggcctgtgaggagcacctatatctggtgagaaaaccagtgtcttcttctaagatgggttttaaaaatgaaactaagtaaaaaatgtcacactttgggctccctggaatgatgtctacaaaccgtctgtatccttcaggctccaaaaggcctgaatagactctggcagcccccaacttgaagataggtggcctctttttcagaaggacttgaaatgccccactgtcttctagtgaacttgctttctaaaagaaataaatggttctgcttccct

SEQ ID NO: 409014 - DNA, 1714 bp, Homo sapiens
  misc_feature (1662)..(1662): n is a, c, g, or t
agacagagtctcattctgttgcccaggctggagtgcagtggcacaatctcagcttactgcaacctccgcctcccaggttcaagctattctcctgcctcagcctcccgagtactggtttgggtttgtccccctcatagtgtaatttacagtggttagaccccttaaactcgatgccgtcccatgacaatttcccattgtctgggaatccttgtagacaccttacaagctcagacctgctgaggattacggtggctctgagttgtggtcaggcgaagtgcacagggcactgtttctttccaaaaggtcagccaatggtgtgaggcaggaatctacctcttggcttcccaagctgtagacaagtgccagtctcgagaaggggttgatatcgccttgaacgacattgcgacattcctgggcacagtcaaggagtacccgttgctcagccccaaggagttttacaacgagtttgagttgctgctcaccctcgatgcaaaggtaatgcttccgggttattttgatcctgtggttgggaaacggataggggagggagggactgtaccttcttcctgataaagtacacacagggtactgagcaggctgaattgagtgggctcactggttccgaagccctccggcggcctcttagactctcggcctgaacgtcctggcatactgagtcttcgtctgactcaaatcagtcatttctctattaatgcttatgagcattcctgatgtaccatgtgctgtgctgagtgctgaggataccatgatgattaaaaataggcatgcttccatccctcactgagcttacagtttgtgggagaggctgacattaacaaaataatcacacaaaaatgtgttacaagctgatataagtgctgtcaaggagggatgcagggtcaggcatgtgacagaggaacttgacctggactggggtcagagaaggctctcaggaagagtcacttgagcctggagaacgaatagacaagatgggagagcctttccagacaggaggaacagcatgtgcaaaggcttcagggctggagggagcctggcacagtgcagaccaaaaggtcagggtgctggaacctagagagcaatggaagtgtgttttgggtgaggttagagagaggcaggcaaggtaggctttgtgggccacatgagcgagtttggatttaagcagggagataacttgattggatttgcatttgagaagcatattcttccatgaagccagcagggttgtaggtagcacaccttcctctgagagccacatcatcaccttgtctgcacctctggtttaggagcttcttttaatcagcttccttgaaagagtccggaagaaagtgagttttaggcttttcttcttggaggcagaaacagagtgggaacgagggttctcagcagacttttcttagagagagagaaagctgcgtccgtttgccaatttgtttagtcatcctgtattctgggcagattaggacgtagccaccgctgtccataaatccctcctggttggaggaattgcatcaccatgttttctcaagttaggaaactgtatgaaatttcatactgtcctgatcagccacctaaaaaagtaaatagcaatttttaaaaatagattcacctgatttaacacccaggaggtctgtggaatcattnagtaatattaaaagggtttcattgtggtcctcttcaaaagtgaacatcagcc

SEQ ID NO: 409015 - DNA, 2317 bp, Homo sapiens
  misc_feature (1398)..(1398): n is a, c, g, or t
tttttcgtgtgactcaatcactttattttatagataaataaactgacgttcagtgtaaagaggtgacttatccaaagtcatttggtcaactagtggcagcattgagactaaaaccagcctctttttaatctccctatcagaatcaggtcctctataccatttccaaggtgaggtgattattcactaattttatcaactaaatctgttgtctttccatcaagacagcatgttggtgaatgttaatctctccatattgttacaattgtctgaccttccaggccatcgaaaactttgccttgaccttgaagaccactgcccagatgctgcagacgtttgggtcctgcctggccacagcagagctgcccagaagcatgctatccacggaagaccttctcatgtcccacacaaggcagcgggacaagctgcaggatgagctgaaattacttggaaagcaggggaccacattgctgtcatgcatccaagaaccagcaaccaaatgtcccaacagcaaactcaatctcaaccaacttgagaatgtaactaccatggaaaggttattagttcaactggatgaaacagaaaaagcctttagtcacttttggtctgagcatcatctgaagcttaaccagtgcctacaactacagcattttgagcacgatttttgtaaggctaagcttgccctggataatttgctggaagagcaagcagagtttacaggcattggagacagcgtgatgcacgtggagcagattcttaaggaacacaaaaaactggaggaaaaaagccaggagcccctggaaaaggcccagctgctggcactggttggggaccagctcatccaaagccaccattatgcagcagatgccatcaggccccggtgtgtggagctcaggcacctctgtgacgatttcatcaatggaaacaagaaaaaatgggacattttaggaaagtccttagagtttcatagacagctggacaaggtcagccaatggtgtgaggcaggaatctacctcttggcttcccaagctgtagacaagtgccagtctcgagaaggggttgatatcgccttgaacgacattgcgacattcctgggcacagtcaaggagtacccgttgctcagccccaaggagttttacaacgagtttgagttgctgctcaccctcgatgcaaaggccaaagcccagaaagttttgcagaggctggatgatgtccaggaaatatttcacaagaggcaagtgagtctgatgaaactggcagccaaacagactcgtccagtgcaacctgtggccccacatcctgagtcttcaccaaaatgggtgtcatcaaaaaccagccagccctccacctcggtccctctagctcgtcctctgagaacgtctgaggaaccttatacggagncagagttgaactcccggggaaaggaagatgatgagactaaatttgaagtcaagagtgaagaaatctttgaaagccatcatgaaagggggaaccctgagctggagcagcaggccaggctcggagacctttccccccgcaggcgcattatacgtgacttgcttgagactgaagagatttacataaaagagattaaaagcataattgatggatatatcactccaatggattttatttggctaaagcatctaattccagatgttcttcagaataacaaggactttctctttgggaatattagagaactttacgaatttcacaacaggacttttctaaaagagttggaaaagtgtgctgagaaccctgaacttctggcacattgctttctcaagagaaaagaagatcttcagatatattttaaataccataagaatctgccccgagctagggcaatctggcaagagtgtcaagactgcgcctactttggggtaatgttgagaagacaaacttcttcctggaaaatgtttctatgcatcaagttgttaaagaaatcaaaagtgggactagggagaggaacttggcattgcgatttatgtttatttaaagtgtcccatactttgaaattacacatgaaaagttgtaatgggataggcctgtgaggagcacctatatctggtgagaaaaccagtgtcttcttctaagatgggttttaaaaatgaaactaagtaaaaaatgtcacactttgggctccctggaatgatgtctacaaaccgtctgtatccttcaggctccaaaaggcctgaatagactctggcagcccccaacttgaagataggtggcctctttttcagaaggacttgaaatgccccactgtcttctagtgaacttgctttctaaaagaaataaatggttctgcttccct

SEQ ID NO: 409016 - DNA, 449 bp, Homo sapiens
caaaggcagtggagcaggatccggaccatggattaaaaatatggaaagagctaccactagcaaggaagacccggcctccagcacaggagggattaaaggtagggagggtcccatgggagagtggagcacagaagcagtggggtgatgccagctgcttagatgctaaggaagacatcacctagggcccagcccttctttagttaaatgagggagaaaaaagaaagcattttaccaccatgtggtttaaaatcaatttcctgctattcatttgtgtagaactaatggggcagaattaacatgaagggcaaatgtctcacattgagaagtacaggagcacccccttatccactgtttcactttccaggttttagttactcttagtcaactgctgtccaaatatcaaatggaaaaattacagaaataaacaatcgatgagttttaaatgatat

SEQ ID NO: 409017 - DNA, 492 bp, Homo sapiens
tttttcgtgtgactcaatcactttattttatagataaataaactgacgttcagtgtaaagaggtgacttatccaaagtcatttggtcaactagtggcagcattgagactaaaaccagcctctttttaatctccctatcagaatcaggtcctctataccatttccaaggtgaggtgattattcactaattttatcaactaaatctgttgtctttccatcaagacagcatgttggtgaatgttaatctctccatattgttacaattgtctgaccttccaggccatcgaaaactttgccttgaccttgaagaccactgcccagatgctgcagacgtttgggtcctgcctggccacagcagagctgcccagaagcatgctatccacggaagaccttctcatgtcccacacaaggcagcgggacaagctgcaggtgagcggtcagtgacctctcagaggccagtgtctgtgccagcaggtatgcctgcctctcggag

SEQ ID NO: 409018 - DNA, 1837 bp, Homo sapiens
  misc_feature (918)..(918): n is a, c, g, or t
agccataggcctatatggatgcctgtggaaatgaatgctaacctaacatcactttctcattctttcttgaaaggttattagttcaactggatgaaacagaaaaagcctttagtcacttttggtctgagcatcatctgaagcttaaccagtgcctacaactacagcattttgagcacgatttttgtaaggctaagcttgccctggataatttgctggaagagcaagcagagtttacaggcattggagacagcgtgatgcacgtggagcagattcttaaggaacacaaaaaactggaggaaaaaagccaggagcccctggaaaaggcccagctgctggcactggttggggaccagctcatccaaagccaccattatgcagcagatgccatcaggccccggtgtgtggagctcaggcacctctgtgacgatttcatcaatggaaacaagaaaaaatgggacattttaggaaagtccttagagtttcatagacagctggacaaggtcagccaatggtgtgaggcaggaatctacctcttggcttcccaagctgtagacaagtgccagtctcgagaaggggttgatatcgccttgaacgacattgcgacattcctgggcacagtcaaggagtacccgttgctcagccccaaggagttttacaacgagtttgagttgctgctcaccctcgatgcaaaggccaaagcccagaaagttttgcagaggctggatgatgtccaggaaatatttcacaagaggcaagtgagtctgatgaaactggcagccaaacagactcgtccagtgcaacctgtggccccacatcctgagtcttcaccaaaatgggtgtcatcaaaaaccagccagccctccacctcggtccctctagctcgtcctctgagaacgtctgaggaaccttatacggagncagagttgaactcccggggaaaggaagatgatgagactaaatttgaagtcaagagtgaagaaatctttgaaagccatcatgaaagggggaaccctgagctggagcagcaggccaggctcggagacctttccccccgcaggcgcattatacgtgacttgcttgagactgaagagatttacataaaagagattaaaagcataattgatggatatatcactccaatggattttatttggctaaagcatctaattccagatgttcttcagaataacaaggactttctctttgggaatattagagaactttacgaatttcacaacaggacttttctaaaagagttggaaaagtgtgctgagaaccctgaacttctggcacattgctttctcaagagaaaagaagatcttcagatatattttaaataccataagaatctgccccgagctagggcaatctggcaagagtgtcaagactgcgcctactttggggtaatgttgagaagacaaacttcttcctggaaaatgtttctatgcatcaagttgttaaagaaatcaaaagtgggactagggagaggaacttggcattgcgatttatgtttatttaaagtgtcccatactttgaaattacacatgaaaagttgtaatgggataggcctgtgaggagcacctatatctggtgagaaaaccagtgtcttcttctaagatgggttttaaaaatgaaactaagtaaaaaatgtcacactttgggctccctggaatgatgtctacaaaccgtctgtatccttcaggctccaaaaggcctgaatagactctggcagcccccaacttgaagataggtggcctctttttcagaaggacttgaaatgccccactgtcttctagtgaacttgctttctaaaagaaataaatggttctgcttccct

SEQ ID NO: 409019 - DNA, 1152 bp, Homo sapiens
ttcatccttcgtccatctcgctttatccagaggacattcactgacattggcattaaatactatcgaaatgagtttaaaatgaaagtgccgatcatcatggtaaactctgtctctgaccttcacggctacatcgacaaaagccaactgacccgggaattaggggggactttggaatatcgccacggtcagtgggtaaatcaccgcactgccatcgaaaactttgccttgaccttgaagaccactgcccagatgctgcagacgtttgggtcctgcctggccacagcagagctgcccagaagcatgctatccacggaagaccttctcatgtcccacacaaggcagcgggacaagctgcaggatgagctgaaattacttggaaagcaggggaccacattgctgtcatgcatccaagaaccagcaaccaaatgtcccaacagcaaactcaatctcaaccaacttgagaatgtaactaccatggaaaggttattagttcaactggatgaaacagaaaaagcctttagtcacttttggtctgagcatcatctgaagcttaaccagtgcctacaactacagcattttgagcacgatttttgtaaggctaagcttgccctggataatttgctggaagagcaagcagagtttacaggcattggagacagcgtgatgcacgtggagcagattcttaaggaacacaaaaaactggaggaaaaaagccaggagcccctggaaaaggcccagctgctggcactggttggggaccagctcatccaaagccaccattatgcagcagatgccatcaggccccggtgtgtggagctcaggcacctctgtgacgatttcatcaatggaaacaagaaaaaatgggacattttaggaaagtccttagagtttcatagacagctggacaaggtgagcaaaacacagccaagaacatgatgtctgcaagattttctgtgaagaagcttccatcatactcgtcctcccttccttgtgtgattgctgagaggcttgagtgctttatgtgaaaagatgttcgagaggcattaaaaactgtgcagatcctggggtgtagaagtatacctggcacgaaggtaaaaagtgctctggccatcccaccacatcccattaaagttaactgaagcccatttctat

SEQ ID NO: 409020 - DNA, 3266 bp, Homo sapiens
cagtatggccctcgccggccgccatccccgaaacttggcgagtgtcgcgtctgcagtgtgtggggttcgcggggcggcgggtagagttgagcatttttgtcatctgcaaataattttagccaggtggcaagtgtatggactgtggagtaagaagtacctgcctctgcctctgacttgggttctggcctataggaacaagacattttcagtaatggaagaaggagcttccaggctggggaagatcatcatttccagtggtagcttgacctgagatgatacctgaccaccacttctgggaaggcccagaatagacagaagagagagaacatactagagttgctagcccctaagagttgaacgaaatgggcaaggcccagctgaaataacaggaaacacatgaaaaatgccacgattgtaatgtctgtgaggagagagcaaggcagttcttcaggggaggggtcattgtcattcgaagatgtggctgtgggcttcaccagggaggagtggcagtttttggaccagtctcagaaggtcttgtacaaggaagtaatgttggagaactacatcaacctagtatcaatagggtatcgaggcaccaagccagattcgctcttcaagttggagcaaggagaacccccagggatagcagaaggagcagcccacagtcaaatctgtccagggttttgttatccagagtagaagatatgcaggaaaagattctgatgcatttggtggatatgggagatcatgcctccatatcaagtgtgacaaaactcttactggagttaaataccatagatgtgttaaacccagcagccctaaatcacagctcaatgacctacaaaaaatttgtgcaggagggaaaccacatgaatgcagtgtgtgcgggagagccttctccaggaaagcacagcttattcaacatcagagaactgaaagaggagagaaaccccatggatgtggtgaatgtgggaaaacattcatgaggaagattcagctcactgagcatcagagaactcacacaggagagaagccccatgaatgtagtgaatgtggaaaagccttctccagaaagtcacagctcatggtccatcagagaacccatacaggagagaaaccctacagatgcagcgaatgcggaaaagccttcagccggaagtgccggctcaatagacatcagcgatcacatactggagagaaactctatgggtgcagtgtgtgtgggaaagccttttctcagaaggcatacctcactgcacaccagagacttcacacaggagataagccttataaatgcagtgattgtggaagaaccttctattttaagtcagacctgaccagacatcagaggattcatacgggagagaaaccttatgaatgtagtgagtgtgaaaaagcctttagaagcaagtcgaagctcattcagcatcagcgtactcacactggagagagaccatattcatgcagagaatgtggcaaagcctttgcccacatgtcagtcctcattaaacatgagaaaactcacataagagagacagccataaattcactgacggtggagaaaccttcctcaaggagtcatacctccttatacatgagcgaactcatacaagagcaaaagactgtgaacacagtacctatagaaatgccttcctcaggaaccccgccattgttaaacaagagtgagcgcctagtgggcagaaatgtagtgattgtggaacaaccttttccaagaaatcaagcctttgtagttaatcaggaatttgaacagagaataagcctcacaaatgaagtgaatgtggccccatcagtaataaattatatcttgtatcttacagatattgtatcagaataaatcttctgataccagaaaggtgggaaaatctttagtaggaatcctccagccattatatcccagagagctcatttagggctgaaacactgtggaggcagtggttgtggaggacatttctgtgagaagtcaaacctgttaaacaccattgaaatcatgttgggtagaaatgcagctgttatgaggaagtctttacctggagatgatatctcaattggtatcaaaagaattcttacaggaatatttatgaaagattgtgatggtgcttttagcgctaaattgtgcctcgtgtgccaaagaaacatagacaactgtagaggcaatggatatggaaaacatttttcgtaaaatatgggagaatttgtagaaaagaaaaactcttgaaagtaagaaatgatggcaactcaccaaattaactcatgtatcatacttttatgtcttgagagtcttggagggacgtgtttaatgaaatcttgaaccccaggaatagtattatgtaatgaaaacctatgaatataacaaatatggaagtaaaattgtgttagtttcttatgagtgttgcaccaaactaacacaaatttaatggcttaaaacaacacaaaatcattatcttacagttctggaggactgaagtccaaatgcatctcacggggctacatcaagctgttgacagggctgcttttctttttggaggctctaggggagcgtctttctttgcccttccagcttctagaagctgcccaaattctgtggtttggggcctcctttcaaaaccagcaatggccaatcagtcttacatcactcaaacacttgagtgttctgtctccctcttccatgtttgaggacccttgtgattacactgtgaaaacccagataagccaggataatctccctatcttattatgaggcaagtatgttaagattttattctataatcagagaatcttatgctatgattgttatatgtgagcattatagatgctcttgaaatgttaaaatcacatcagcactggaaaataactcctaaatgtccaaaaagaacatgagatttatggtgcttgaaatgttgctaaacgtaaatttgtatctattctgaaattatataaattaacctacctggccaggcacagtggctcacacctgtaatctcagcactttgggaggccaaggcaggaagatcacttgagcccgcaagtttgagaccaccctgggcaacatagcgagactacctctacaaaaaaaaaaaaaaataataatagctggacatggtggtgtgtgcctatagtcccagctacttgggaggctgaggcaagatgattgcttgagtccaggagttctaggctgcagtgactgcagtgagctatgatcatgccactgcactacagcgtgggtgacagaataagactctgactct

SEQ ID NO: 409021 - DNA, 816 bp, Homo sapiens
cagtatggccctcgccggccgccatccccgaaacttggcgagtgtcgcgtctgcagtgtgtggggttcgcggggcggcgggtagaggcgagtgtttagagacttcgggtccctgactcgcctccagcagtggagacaggtcatcggtctggtctgcgtgggcttctgggaatgtttcaggggcagggagagcgcgcttttttttttctgttgttcgctagcgcgtgaggtccgtgttgcggggagctctcggggagtcctcgctcggagttcgtttcgcagtcgtgttggagttcccagagtctgggagcccatggtctccgcattggaaccagtgcttgggaggtcttcgttgcacagtagcgctagggcgtcgtggtggggaagcgaatcgtgtcagtgttggagactgctctgggcagttcgtgttcattgcttatcacatgcgtacttaaaaaggggtctgctggtccccttgcttccctgctgctgtatattctgtagaaaatgggttttcaggttcattgcgacccaagtaataacatccccatcattttaaatactcctccagaaaataactctggtttagtgtatttcatgtttaatgttgggatcaggtgtctaggtattggtataattttattcgtctttaataacatcttgtcaacttcgtattcccatattacatgctctttgagagttttttaaattgctgcagtttcatcaagtggttgctttaattctgggtagaattgatgtagatctagatacaacactttcaggaacatgtgatggatttctattaacccaatatttt

SEQ ID NO: 409022 - DNA, 460 bp, Homo sapiens
  misc_feature (15)..(15): n is a, c, g, or t
gcttctgtgtggganctatgtgtaactacatcaacctagtatcaatagggtatcgaggcaccaagccagattcgctcttcaagttggagcaaggagaacccccagggatagcagaaggagcagcccacagtcaaatctgtccagggagggaaaccacatgaatgcagtgtgtgcgggagagccttctccaggaaagcacagcttattcaacatcagagaactgaaagaggagagaaaccccatggatgtggtgaatgtgggaaaacattcatgaggaagattcagctcactgagcatcagagaactcacacaggagagaagccccatgaatgtagtgaatgtggaaaagccttctccagaaagtcacagctcatggtccatcagagaaccacacggccagcacaagaacccagaaagaaccacacgccagcaaagaaccacacgggttaccgagctcgaa

SEQ ID NO: 409023 - DNA, 809 bp, Homo sapiens
cagtatggccctcgccggccgccatccccgaaacttggcgagtgtcgcgtctgcagtgtgtggggttcgcggggcggcgggtagagttgagcatttttgtcatctgcaaataattttagccaggtggcaagtgtatggactgtggagtaagaagtacctgcctctgcctctgacttgggttctggcctataggaacaagacattttcagtaatggaagaaggagcttccaggctggggaagatcatcatttccagtggtagcttgacctgagatgatacctgaccaccacttctgggaaggcccagaatagacagaagagagagaacatactagagttgctagcccctaagagttgaacgaaatgggcaaggcccagctgaaataacaggaaacacatgaaaaatgccacgattgtaatgtctgtgaggagagagcaaggcagttcttcaggggaggggtcattgtcattcgaagatgtggctgtgggcttcaccagggaggagtggcagtttttggaccagtctcagaaggtcttgtacaaggaagtaatgttggagaactacatcaacctagtatcaatagggtatcgaggcaccaagccagattcgctcttcaagttggagcaaggagaacccccagggatagcagaaggagcagcccacagtcaaatctgtccagggtattcattcaggagaaggaccctacagatggagggaatgcaggaaagctaagaagaatcacacctcattgcagatctgcattaccgttggaaaacagcagccagaaccacaaatatcgggggatcctc

SEQ ID NO: 409024 - DNA, 1354 bp, Homo sapiens
cagtatggccctcgccggccgccatccccgaaacttggcgagtgtcgcgtctgcagtgtgtggggttcgcggggcggcgggtagagttgagcatttttgtcatctgcaaataattttagccaggtggcaagtgtatggactgtggagtaagaagtacctgcctctgcctctgacttgggttctggcctataggaacaagacattttcagtaatggaagaaggagcttccaggctggggaagatcatcatttccagtggtagcttgacctgagatgatacctgaccaccacttctgggaaggcccagaatagacagaagagagagaacatactagagttgctagcccctaagagttgaacgaaatgggcaaggcccagctgaaataacaggaaacacatgaaaaatgccacgattgtaatgtctgtgaggagagagcaaggcagttcttcaggggaggggtcattgtcattcgaagatgtggctgtgggcttcaccagggaggagtggcagtttttggaccagtctcagaaggtcttgtacaaggaagtaatgttggagaactacatcaacctagtatcaatagggtatcgaggcaccaagccagattcgctcttcaagttggagcaaggagaacccccagggatagcagaaggagcagcccacagtcaaatctgtccagggttttgttatccagagtagaagatatgcaggaaaagattctgatgcatttggtggatatgggagatcatgcctccatatcaagtgtgacaaaactcttactggagttaaataccatagatgtgttaaacccagcagccctaaatcacagctcaatgacctacaaaaaatttgtgcaggagggaaaccacatgaatgcagtgtgtgcgggagagccttctccaggaaagcacagcttattcaacatcagagaactgaaagaggagagaaaccccatggatgtggtgaatgtgggaaaacattcatgaggaagattcagctcactgagcatcagagaactcacacaggagagaagccccatgaatgtagtgaatgtggaaaagccttctccagaaagtcacagctcatggtccatcagagaacccatacaggagagaaaccctacagatgcagcgaatgcggaaaagccttcagccggaagtgccggctcaatagacatcagcgatcacatactggagagaaactctatgggtgcagtgtgtgtgggaaagccttttctcagaaggcatacctcactgcacaccagagacttcacacaggagataagccttataaatgcagtgattgtggaagaaccttctatggttgtccattctatggtggtgcggatcctgta

SEQ ID NO: 409025 - DNA, 2934 bp, Homo sapiens
ctcgctctagagtatccccatgccaataacctccacagagtgtgaggtacattactctgagactgagatcttataaaagccagccaaaaccatggcatttttgcaccttctgccacctccacaaaaaattatcatggatgttcatattgtgctttttcctaggagaaatttggggggtttaccatatgcagtggtacccagaaaaccaaaatgagcttaaacattttgaaagatgtcaacaaagttatgcccttggaaataagtttggtttatgtaagagcattgttcctttaatgtaaagacacaataagtttggctcgcattgtaaaagtttgaaatctcatttaggttttgttatccagagtagaagatatgcaggaaaagattctgatgcatttggtggatatgggagatcatgcctccatatcaagtgtgacaaaactcttactggagttaaataccatagatgtgttaaacccagcagccctaaatcacagctcaatgacctacaaaaaatttgtgcaggagggaaaccacatgaatgcagtgtgtgcgggagagccttctccaggaaagcacagcttattcaacatcagagaactgaaagaggagagaaaccccatggatgtggtgaatgtgggaaaacattcatgaggaagattcagctcactgagcatcagagaactcacacaggagagaagccccatgaatgtagtgaatgtggaaaagccttctccagaaagtcacagctcatggtccatcagagaacccatacaggagagaaaccctacagatgcagcgaatgcggaaaagccttcagccggaagtgccggctcaatagacatcagcgatcacatactggagagaaactctatgggtgcagtgtgtgtgggaaagccttttctcagaaggcatacctcactgcacaccagagacttcacacaggagataagccttataaatgcagtgattgtggaagaaccttctattttaagtcagacctgaccagacatcagaggattcatacgggagagaaaccttatgaatgtagtgagtgtgaaaaagcctttagaagcaagtcgaagctcattcagcatcagcgtactcacactggagagagaccatattcatgcagagaatgtggcaaagcctttgcccacatgtcagtcctcattaaacatgagaaaactcacataagagagacagccataaattcactgacggtggagaaaccttcctcaaggagtcatacctccttatacatgagcgaactcatacaagagcaaaagactgtgaacacagtacctatagaaatgccttcctcaggaaccccgccattgttaaacaagagtgagcgcctagtgggcagaaatgtagtgattgtggaacaaccttttccaagaaatcaagcctttgtagttaatcaggaatttgaacagagaataagcctcacaaatgaagtgaatgtggccccatcagtaataaattatatcttgtatcttacagatattgtatcagaataaatcttctgataccagaaaggtgggaaaatctttagtaggaatcctccagccattatatcccagagagctcatttagggctgaaacactgtggaggcagtggttgtggaggacatttctgtgagaagtcaaacctgttaaacaccattgaaatcatgttgggtagaaatgcagctgttatgaggaagtctttacctggagatgatatctcaattggtatcaaaagaattcttacaggaatatttatgaaagattgtgatggtgcttttagcgctaaattgtgcctcgtgtgccaaagaaacatagacaactgtagaggcaatggatatggaaaacatttttcgtaaaatatgggagaatttgtagaaaagaaaaactcttgaaagtaagaaatgatggcaactcaccaaattaactcatgtatcatacttttatgtcttgagagtcttggagggacgtgtttaatgaaatcttgaaccccaggaatagtattatgtaatgaaaacctatgaatataacaaatatggaagtaaaattgtgttagtttcttatgagtgttgcaccaaactaacacaaatttaatggcttaaaacaacacaaaatcattatcttacagttctggaggactgaagtccaaatgcatctcacggggctacatcaagctgttgacagggctgcttttctttttggaggctctaggggagcgtctttctttgcccttccagcttctagaagctgcccaaattctgtggtttggggcctcctttcaaaaccagcaatggccaatcagtcttacatcactcaaacacttgagtgttctgtctccctcttccatgtttgaggacccttgtgattacactgtgaaaacccagataagccaggataatctccctatcttattatgaggcaagtatgttaagattttattctataatcagagaatcttatgctatgattgttatatgtgagcattatagatgctcttgaaatgttaaaatcacatcagcactggaaaataactcctaaatgtccaaaaagaacatgagatttatggtgcttgaaatgttgctaaacgtaaatttgtatctattctgaaattatataaattaacctacctggccaggcacagtggctcacacctgtaatctcagcactttgggaggccaaggcaggaagatcacttgagcccgcaagtttgagaccaccctgggcaacatagcgagactacctctacaaaaaaaaaaaaaaataataatagctggacatggtggtgtgtgcctatagtcccagctacttgggaggctgaggcaagatgattgcttgagtccaggagttctaggctgcagtgactgcagtgagctatgatcatgccactgcactacagcgtgggtgacagaataagactctgactct

SEQ ID NO: 409026 - DNA, 3491 bp, Homo sapiens
cgatatttgtggttctggcccctctgctgcactgtgattatcaaggaggtccctccaccccctgccgaggagagtgaggaagaagatgatgatggtctgcctaagaaaaagtggccaacggtagacgcctcttattatggtgggagaggcgttggaggcattaaaagaatggaggttcgttggggagaaaagggctccacagaagaaggtgctaagttggaaaaggcaaagaatgcaagagtcaagatgccggagcaggaatatgaattccctgagccgcgaaatctcaacaacaatatgcgtcggccttcttccccccggaagtggtactctccaatcaagggaaaactcgatgccttgtgggtcctactgaggaaaggatatgatcgtgtgtctgtgatgcgtccacagccaggagacacggggcgccgcatcaacttcaccagggtcaagaacaaccagccagccaagtacccactcaacaacgccagaacctacaaatatctgaccaccacttctgggaaggcccagaatagacagaagagagagaacatactagagttgctagcccctaagagttgaacgaaatgggcaaggcccagctgaaataacaggaaacacatgaaaaatgccacgattgtaatgtctgtgaggagagagcaaggcagttcttcaggggaggggtcattgtcattcgaagatgtggctgtgggcttcaccagggaggagtggcagtttttggaccagtctcagaaggtcttgtacaaggaagtaatgttggagaactacatcaacctagtatcaatagggtatcgaggcaccaagccagattcgctcttcaagttggagcaaggagaacccccagggatagcagaaggagcagcccacagtcaaatctgtccagggttttgttatccagagtagaagatatgcaggaaaagattctgatgcatttggtggatatgggagatcatgcctccatatcaagtgtgacaaaactcttactggagttaaataccatagatgtgttaaacccagcagccctaaatcacagctcaatgacctacaaaaaatttgtgcaggagggaaaccacatgaatgcagtgtgtgcgggagagccttctccaggaaagcacagcttattcaacatcagagaactgaaagaggagagaaaccccatggatgtggtgaatgtgggaaaacattcatgaggaagattcagctcactgagcatcagagaactcacacaggagagaagccccatgaatgtagtgaatgtggaaaagccttctccagaaagtcacagctcatggtccatcagagaacccatacaggagagaaaccctacagatgcagcgaatgcggaaaagccttcagccggaagtgccggctcaatagacatcagcgatcacatactggagagaaactctatgggtgcagtgtgtgtgggaaagccttttctcagaaggcatacctcactgcacaccagagacttcacacaggagataagccttataaatgcagtgattgtggaagaaccttctattttaagtcagacctgaccagacatcagaggattcatacgggagagaaaccttatgaatgtagtgagtgtgaaaaagcctttagaagcaagtcgaagctcattcagcatcagcgtactcacactggagagagaccatattcatgcagagaatgtggcaaagcctttgcccacatgtcagtcctcattaaacatgagaaaactcacataagagagacagccataaattcactgacggtggagaaaccttcctcaaggagtcatacctccttatacatgagcgaactcatacaagagcaaaagactgtgaacacagtacctatagaaatgccttcctcaggaaccccgccattgttaaacaagagtgagcgcctagtgggcagaaatgtagtgattgtggaacaaccttttccaagaaatcaagcctttgtagttaatcaggaatttgaacagagaataagcctcacaaatgaagtgaatgtggccccatcagtaataaattatatcttgtatcttacagatattgtatcagaataaatcttctgataccagaaaggtgggaaaatctttagtaggaatcctccagccattatatcccagagagctcatttagggctgaaacactgtggaggcagtggttgtggaggacatttctgtgagaagtcaaacctgttaaacaccattgaaatcatgttgggtagaaatgcagctgttatgaggaagtctttacctggagatgatatctcaattggtatcaaaagaattcttacaggaatatttatgaaagattgtgatggtgcttttagcgctaaattgtgcctcgtgtgccaaagaaacatagacaactgtagaggcaatggatatggaaaacatttttcgtaaaatatgggagaatttgtagaaaagaaaaactcttgaaagtaagaaatgatggcaactcaccaaattaactcatgtatcatacttttatgtcttgagagtcttggagggacgtgtttaatgaaatcttgaaccccaggaatagtattatgtaatgaaaacctatgaatataacaaatatggaagtaaaattgtgttagtttcttatgagtgttgcaccaaactaacacaaatttaatggcttaaaacaacacaaaatcattatcttacagttctggaggactgaagtccaaatgcatctcacggggctacatcaagctgttgacagggctgcttttctttttggaggctctaggggagcgtctttctttgcccttccagcttctagaagctgcccaaattctgtggtttggggcctcctttcaaaaccagcaatggccaatcagtcttacatcactcaaacacttgagtgttctgtctccctcttccatgtttgaggacccttgtgattacactgtgaaaacccagataagccaggataatctccctatcttattatgaggcaagtatgttaagattttattctataatcagagaatcttatgctatgattgttatatgtgagcattatagatgctcttgaaatgttaaaatcacatcagcactggaaaataactcctaaatgtccaaaaagaacatgagatttatggtgcttgaaatgttgctaaacgtaaatttgtatctattctgaaattatataaattaacctacctggccaggcacagtggctcacacctgtaatctcagcactttgggaggccaaggcaggaagatcacttgagcccgcaagtttgagaccaccctgggcaacatagcgagactacctctacaaaaaaaaaaaaaaataataatagctggacatggtggtgtgtgcctatagtcccagctacttgggaggctgaggcaagatgattgcttgagtccaggagttctaggctgcagtgactgcagtgagctatgatcatgccactgcactacagcgtgggtgacagaataagactctgactct

SEQ ID NO: 409027 - DNA, 588 bp, Homo sapiens
  misc_feature (575)..(575): n is a, c, g, or t
atttgtaatttaaaaatttaaggaaaactaaacagagtgagactctgtctcaaaaaaaaaaaaaaaaaaaaaaaagagagagtcaattatgagtgcagtgattgtcaaaaaagtttattagaaaactagaagctttccatttagtaggcagcaccagtggatgtaatgaaaatgataaatcattctcaaattatatttgttacacattagggtattcattcaggagaaggaccctacagatggagggaatgcaggaaagctaagaagaatcacacctcattgcagatctgcattaccgttggaaaacagcagcctcagaaccacagtagccatgaagaccatcagccttcaaccaccacccttgtatcagaggagacaaataagcttggaaatcctcaaaaagcctcatcctcagagcaatgtcattatatatcttgtcttacagctccataaactcagcaagctatgctgcgccggattgagctacttggcattcgccttaaggagcgatacatcattgccggttacacgcggatggaaccctgcgtacactatcgctgagacatcctcgcagntggatacgaagcc

SEQ ID NO: 409028 - DNA, 655 bp, Homo sapiens
  misc_feature (642)..(642): n is a, c, g, or t
cttccttacaaagacaatgctcattgtacatcacagaactcacacgggagagagaccctatggctgtgatgagtgttctggcctataggaacaagacattttcagtaatggaagaaggagcttccaggctggggaagatcatcatttccagtggtagcttgacctgagatgatacctgaccaccacttctgggaaggcccagaatagacagaagagagagaacatactagagttgctagcccctaagagttgaacgaaatgggcaaggcccagctgaaataacaggaaacacatgaaaaatgccacgattgtaatgtctgtgaggagagagcaaggcagttcttcaggggagatctgcattaccgttggaaaacagcagcctcagaaccacagtagccatgaagaccatcagccttcaaccaccacccttgtatcagaggagacaaataagcttggaaatcctcaaaaagcctcatcctcagagcaatgtcattatatatcttgtcttacagctccataaactcagcaagctatgctgcgccggattgagctacttggcattcgccttaaggagcgatacatcattgccggttacacgcggatggaaccctgcgtacactatcgctgagacatcctcgcagntggatacgaagcc

SEQ ID NO: 409029 - DNA, 594 bp, Homo sapiens
gtttcactgtgttagccaggatagtcttaatctcccgactttgtgatctgcccacctcggcctcccaaagtactgagattacaggtgtgagccaccacgcccagccgtattattacatttttaaaatatgtcttagatcatatattatttgggagcttaattttttgcatttaagagactgccttggagatcattgataatcatgtgggtatgtatacatctacctcattgattttaacatttttgcagtatattatagcatggaggtgctgtaatttaaccctgtctgcttttgatagacatttagattattggtaagtttttcattatgagaaacaaaggaataatgaacagtcttattacatgttgtttcatatctatgctagtactgccttcgtgcttttagggtaggcagaattggtggaattccatggtcctttggtatgtgaaatagccatggtgtgcatacgttgtcatggagaaaaggatcaagacatgtccccgtccctcttctccgcatcatctattgttatccacctcagattgcattggaattgttattataggggtcattgtcattcgaagatgtggctg

SEQ ID NO: 409030 - DNA, 378 bp, Homo sapiens
gtcacttcattgtactcatgtcattacatataacttataaattgacgtcttttttctagttgagcatttttgtcatctgcaaataattttagccaggtggcaagtgtatggactgtggagtaagaagtacctgcctctgcctctgacttgggtacgttaatctctgagtcagtttccttatttgtggaaaaaagctgtcatagtttctttttcatggaatcattatgaagattaagtgagcaaatgttctttaagtatgttcaaagtgtagtactaggtacgtagtatggtctgaataaataattactgtgatttatcaagtttttatttctctttcctaagggcttttgaccattacaattattttcatttattttt

SEQ ID NO: 409031 - DNA, 779 bp, Homo sapiens
  misc_feature (766)..(766): n is a, c, g, or t
cagtatggccctcgccggccgccatccccgaaacttggcgagtgtcgcgtctgcagtgtgtggggttcgcggggcggcgggtagagttgagcatttttgtcatctgcaaataattttagccaggtggcaagtgtatggactgtggagtaagaagtacctgcctctgcctctgacttgggggtcattgtcattcgaagatgtggctgtgggcttcaccagggaggagtggcagtttttggaccagtctcagaaggtcttgtacaaggaagtaatgttggagaactacatcaacctagtatcaatagggtatcgaggcaccaagccagattcgctcttcaagttggagcaaggagaacccccagggatagcagaaggagcagcccacagtcaaatctgtccagggtattcattcaggagaaggaccctacagatggagggaatgcaggaaagctaagaagaatcacacctcattgcagatctgcattaccgttggaaaacagcagcctcagaaccacagtagccatgaagaccatcagccttcaaccaccacccttgtatcagaggagacaaataagcttggaaatcctcaaaaagcctcatcctcagagcaatgtcattatatatcttgtcttacagctccataaactcagcaagctatgctgcgccggattgagctacttggcattcgccttaaggagcgatacatcattgccggttacacgcggatggaaccctgcgtacactatcgctgagacatcctcgcagntggatacgaagcc

SEQ ID NO: 409032 - DNA, 3162 bp, Homo sapiens
cttccttacaaagacaatgctcattgtacatcacagaactcacacgggagagagaccctatggctgtgatgagtgttctggcctataggaacaagacattttcagtaatggaagaaggagcttccaggctggggaagatcatcatttccagtggtagcttgacctgagatgatacctgaccaccacttctgggaaggcccagaatagacagaagagagagaacatactagagttgctagcccctaagagttgaacgaaatgggcaaggcccagctgaaataacaggaaacacatgaaaaatgccacgattgtaatgtctgtgaggagagagcaaggcagttcttcaggggaggggtcattgtcattcgaagatgtggctgtgggcttcaccagggaggagtggcagtttttggaccagtctcagaaggtcttgtacaaggaagtaatgttggagaactacatcaacctagtatcaatagggtatcgaggcaccaagccagattcgctcttcaagttggagcaaggagaacccccagggatagcagaaggagcagcccacagtcaaatctgtccagggttttgttatccagagtagaagatatgcaggaaaagattctgatgcatttggtggatatgggagatcatgcctccatatcaagtgtgacaaaactcttactggagttaaataccatagatgtgttaaacccagcagccctaaatcacagctcaatgacctacaaaaaatttgtgcaggagggaaaccacatgaatgcagtgtgtgcgggagagccttctccaggaaagcacagcttattcaacatcagagaactgaaagaggagagaaaccccatggatgtggtgaatgtgggaaaacattcatgaggaagattcagctcactgagcatcagagaactcacacaggagagaagccccatgaatgtagtgaatgtggaaaagccttctccagaaagtcacagctcatggtccatcagagaacccatacaggagagaaaccctacagatgcagcgaatgcggaaaagccttcagccggaagtgccggctcaatagacatcagcgatcacatactggagagaaactctatgggtgcagtgtgtgtgggaaagccttttctcagaaggcatacctcactgcacaccagagacttcacacaggagataagccttataaatgcagtgattgtggaagaaccttctattttaagtcagacctgaccagacatcagaggattcatacgggagagaaaccttatgaatgtagtgagtgtgaaaaagcctttagaagcaagtcgaagctcattcagcatcagcgtactcacactggagagagaccatattcatgcagagaatgtggcaaagcctttgcccacatgtcagtcctcattaaacatgagaaaactcacataagagagacagccataaattcactgacggtggagaaaccttcctcaaggagtcatacctccttatacatgagcgaactcatacaagagcaaaagactgtgaacacagtacctatagaaatgccttcctcaggaaccccgccattgttaaacaagagtgagcgcctagtgggcagaaatgtagtgattgtggaacaaccttttccaagaaatcaagcctttgtagttaatcaggaatttgaacagagaataagcctcacaaatgaagtgaatgtggccccatcagtaataaattatatcttgtatcttacagatattgtatcagaataaatcttctgataccagaaaggtgggaaaatctttagtaggaatcctccagccattatatcccagagagctcatttagggctgaaacactgtggaggcagtggttgtggaggacatttctgtgagaagtcaaacctgttaaacaccattgaaatcatgttgggtagaaatgcagctgttatgaggaagtctttacctggagatgatatctcaattggtatcaaaagaattcttacaggaatatttatgaaagattgtgatggtgcttttagcgctaaattgtgcctcgtgtgccaaagaaacatagacaactgtagaggcaatggatatggaaaacatttttcgtaaaatatgggagaatttgtagaaaagaaaaactcttgaaagtaagaaatgatggcaactcaccaaattaactcatgtatcatacttttatgtcttgagagtcttggagggacgtgtttaatgaaatcttgaaccccaggaatagtattatgtaatgaaaacctatgaatataacaaatatggaagtaaaattgtgttagtttcttatgagtgttgcaccaaactaacacaaatttaatggcttaaaacaacacaaaatcattatcttacagttctggaggactgaagtccaaatgcatctcacggggctacatcaagctgttgacagggctgcttttctttttggaggctctaggggagcgtctttctttgcccttccagcttctagaagctgcccaaattctgtggtttggggcctcctttcaaaaccagcaatggccaatcagtcttacatcactcaaacacttgagtgttctgtctccctcttccatgtttgaggacccttgtgattacactgtgaaaacccagataagccaggataatctccctatcttattatgaggcaagtatgttaagattttattctataatcagagaatcttatgctatgattgttatatgtgagcattatagatgctcttgaaatgttaaaatcacatcagcactggaaaataactcctaaatgtccaaaaagaacatgagatttatggtgcttgaaatgttgctaaacgtaaatttgtatctattctgaaattatataaattaacctacctggccaggcacagtggctcacacctgtaatctcagcactttgggaggccaaggcaggaagatcacttgagcccgcaagtttgagaccaccctgggcaacatagcgagactacctctacaaaaaaaaaaaaaaataataatagctggacatggtggtgtgtgcctatagtcccagctacttgggaggctgaggcaagatgattgcttgagtccaggagttctaggctgcagtgactgcagtgagctatgatcatgccactgcactacagcgtgggtgacagaataagactctgactct

SEQ ID NO: 409033 - DNA, 1057 bp, Homo sapiens
  misc_feature (1044)..(1044): n is a, c, g, or t
cagtatggccctcgccggccgccatccccgaaacttggcgagtgtcgcgtctgcagtgtgtggggttcgcggggcggcgggtagagttgagcatttttgtcatctgcaaataattttagccaggtggcaagtgtatggactgtggagtaagaagtacctgcctctgcctctgacttgggttctggcctataggaacaagacattttcagtaatggaagaaggagcttccaggctggggaagatcatcatttccagtggtagcttgacctgagatgatacctgaccaccacttctgggaaggcccagaatagacagaagagagagaacatactagagttgctagcccctaagagttgaacgaaatgggcaaggcccagctgaaataacaggaaacacatgaaaaatgccacgattgtaatgtctgtgaggagagagcaaggcagttcttcaggggaggggtcattgtcattcgaagatgtggctgtgggcttcaccagggaggagtggcagtttttggaccagtctcagaaggtcttgtacaaggaagtaatgttggagaactacatcaacctagtatcaatagggtatcgaggcaccaagccagattcgctcttcaagttggagcaaggagaacccccagggatagcagaaggagcagcccacagtcaaatctgtccagggtattcattcaggagaaggaccctacagatggagggaatgcaggaaagctaagaagaatcacacctcattgcagatctgcattaccgttggaaaacagcagcctcagaaccacagtagccatgaagaccatcagccttcaaccaccacccttgtatcagaggagacaaataagcttggaaatcctcaaaaagcctcatcctcagagcaatgtcattatatatcttgtcttacagctccataaactcagcaagctatgctgcgccggattgagctacttggcattcgccttaaggagcgatacatcattgccggttacacgcggatggaaccctgcgtacactatcgctgagacatcctcgcagntggatacgaagcc

SEQ ID NO: 409034 - DNA, 400 bp, Homo sapiens
atctgcattaccgttggaaaacagcagcctcagaaccacagtagccatgaagaccatcagccttcaaccaccacccttgtatcagaggagacaaataagcttggaaatcctcaaaaagcctcatcctcagagcaatgtcattatatatcttgtcttacagctccatgatgtggttccattctttgtcctaactcattctctcacctgactcaaagctcactttgaaggaaaagtgcgatactagggcactggtcaaaaacgatcagcttcaattgtttaactttgtagtagcctaagcctgcagtaccgttagggagcaaacaagagctctgaaaaattgttaaacggacatctgaagaacaagatgttaatagggaactcttaaatactctgacatatt

SEQ ID NO: 409035 - DNA, 321 bp, Homo sapiens
ctgagtagctgggactacagttgcgcaccaccatgcccagctaatttttgtatttttagtagagacagggtttcaccatgttggccagggtggtctcaaaatccttacatcaggtggtctacccgcctcagcctccaaggtgctgggattacaggtgtgagccaccacaccagcttaaataattcttaaaattagtaatttttggtaaaattttttaatatattttgtataagtttatatctaggtattttatcatataaacatttaaatatatgaatatatatttatattttaaaatcacatatatatgactaaagcaga

SEQ ID NO: 409036 - DNA, 308 bp, Homo sapiens
aaggacattagtagaaaaactgatgtaatctaattaaaggctgtagtttatcacattgtacctatgtttaatttcttctgacaaatgtactgtggtcatgcaagattaacatcagaagtagctgggttaagcgcatacaggaactcttcatataatctttatgtgcttctatggatctaaaattttttcaaaattaaaagttttttaaaagtcaatctggccaggtgcagtggctcacacctataatcccagcactttgggaggccaaggcaggagaatcgcttgaacccaggaggcagaggttgcag

SEQ ID NO: 409037 - DNA, 369 bp, Homo sapiens
  misc_feature (276)..(276): n is a, c, g, or t
aaaagagaggtttgaccctactcagtttcaagactgtattattcaaggcttaactgaaaccggtactgatttggaagcagtatttctgtctggactagaggcactctgacatcaatttggaaattggaattaagaaaatacgtttttaaaatcgtaatacttatcagatttcactaatatttaaacagtggggatagcggcgccgcacatctcggatcagccccccaaaggccgccccgtccgccgaaggggatcatcttcagctgcccctgccgnctctaccatctgcaggagcgccttatcttgggcagatttgggctccagccaagcccctgtaggtagcagccggccctgttcctttggtttctt

SEQ ID NO: 409038 - DNA, 2070 bp, Homo sapiens
cggcgatgccccagacgcggctgcagttttcaaaccgcgactgcaagcttcggtagtcctctccgctgctgtcgccaggagtcacttcacgagaagccaggtcacaaccgtcggcccttgtctggaaaagtaaaagtggatcctgccacgttcggagctccctggcgcctcgcccggctggagctagagaactcgtcctgtggcggcccccggcgtggggcgggacagcggccccctggagggggcagtcccgggagaacctgcggcggccggagcggtaaaaataagtgactaaagaagcagacctgggaatcacctaacatgtcgaggaggagatttgattgccgaagtatttcaggcctactaactacaactcctcaaattccaataaaaatggaaaactttaataatttctatatacttacatctaaagagctagggagaggaaaatttgctgtggttagacaatgtatatcaaaatctactggccaagaatatgctgcaaaatttctaaaaaagagaagaagaggacaggattgtcgggcagaaattttacacgagattgctgtgcttgaattggcaaagtcttgtccccgtgttattaatcttcatgaggtctatgaaaatacaagtgaaatcattttgatattggaatatgctgcaggtggagaaattttcagcctgtgtttacctgagttggctgaaatggtttctgaaaatgatgttatcagactcattaaacaaatacttgaaggagtttattatctacatcagaataacattgtacaccttgatttaaagccacagaatatattactgagcagcatataccctctcggggacattaaaatagtagattttggaatgtctcgaaaaatagggcatgcgtgtgaacttcgggaaatcatgggaacaccagaatatttagctccagaaatcctgaactatgatcccattaccacagcaacagatatgtggaatattggtataatagcatatatgttgttaactcacacatcaccatttgtgggagaagataatcaagaaacatacctcaatatctctcaagttaatgtagattattcggaagaaactttttcatcagtttcacagctggccacagactttattcagagccttttagtaaaaaatccagagaaaagaccaacagcagagatatgcctttctcattcttggctacagcagtgggactttgaaaacttgtttcaccctgaagaaacttccagttcctctcaaactcaggatcattctgtaaggtcctctgaagacaagacttctaaatcctcctgtaatggaacctgtggtgatagagaagacaaagagaatatcccagaggatagcagcatggtttccaaaagatttcgtttcgatgactcattacccaatccccatgaacttgtttcagatttgctctgttagcacttttttctttgactcatttggactgaatttgaaattttatatccactccagtgagattatgatttgtagcttcatatatgacatgtttatattgtaaatgcacttttccatggaataatttagggaagtgttttaatgttaaattactagttgctagcatgttatgatttcatatcctgagatagctctgcagataagaaaatatttaaatatatgacaaaaagtaaaattgtacatgtgagtttacatgttaatgaaataattcaacttcaaatgaacttaccagaatgttttgcatatcaacaaaaaaagtggcttgagttttattatagttggtgtaaactgaacacagtgaagacattggaatttaataggttctctctctaaggtgactcttataccatgcctctatcaacataatttgtttaggaaagcagtatgaagtttaagccaaaataatttctactttatagatgctcaagagacattttacaattgaaaatgtctttcaattacaaatattttgaaacttcgtaagattttcattctctgtggtctgttatatgagagagatcctttaactagagcaaagagggagttagaaacctgatcagggatattctttac

SEQ ID NO: 409039 - DNA, 1783 bp, Homo sapiens
cggcgatgccccagacgcggctgcagttttcaaaccgcgactgcaagcttcggtagtcctctccgctgctgtcgccaggagtcacttcacgagaagccaggtcacaaccgtcggcccttgtctggaaaagtaaaagtggatcctgccacgttcggagctccctggcgcctcgcccggctggagctagagaactcgtcctgtggcggcccccggcgtggggcgggacagcggccccctggagggggcagtcccgggagaacctgcggcggccggagcggtaaaaataagtgactaaagaagcagacctgggaatcacctaacatgtcgaggaggagatttgattgccgaagtatttcaggcctactaactacaactcctcaaattccaataaaaatggaaaactttaataatttctatatacttacatctaaagagctagggagaggaaaatttgctgtggttagacaatgtatatcaaaatctactggccaagaatatgctgcaaaatttctaaaaaagagaagaagaggacaggattgtcgggcagaaattttacacgagattgctgtgcttgaattggcaaagtcttgtccccgtgttattaatcttcatgaggtctatgaaaatacaagtgaaatcattttgatattggaatatgctgcaggtggagaaattttcagcctgtgtttacctgagttggctgaaatggtttctgaaaatgatgttatcagactcattaaacaaatacttgaaggagtttattatctacatcagaataacattgtacaccttgatttaaagccacagaatatattactgagcagcatataccctctcggggacattaaaatagtagattttggaatgtctcgaaaaatagggcatgcgtgtgaacttcgggaaatcatgggaacaccagaatatttagctccagaaatcctgaactatgatcccattaccacagcaacagatatgtggaatattggtataatagcatatatgttgttaactcacacatcaccatttgtgggagaagataatcaagaaacatacctcaatatctctcaagttaatgtagattattcggaagaaactttttcatcagtttcacagctggccacagactttattcagagccttttagtaaaaaatccagagaaaagaccaacagcagagatatgcctttctcattcttggctacagcagtgggactttgaaaacttgtttcaccctgaagaaacttccagttcctctcaaactcaggatcattctgtaaggtcctctgaagacaagacttctaaatcctcctgtaatggaacctgtggtgatagagaagacaaagagaatatcccagaggatagcagcatggtttccaaaagatttcgtttcgatgactcattacccaatccccatgaacttgtttcagatttgctctgttagcacttttttctttgactcatttggactgaatttgaaattttatatccactccagtgagattatgatttgtagcttcatatatgacatgtttatattgtaaatgcacttttccatggaataatttagggaagtgttttaatgttaaattactagttgctagcatgttatgatttcatatcctgagatagctctgcagataagaaaatatttaaatatatgacaaaaagtaaaattgtacatgtgagtttacatgttaatgaaataattcaacttcaaatgaacttaccagaatgttttgcatatcaacaaaaaaaatggcctccttggcctcagaggggggact

SEQ ID NO: 409040 - DNA, 1677 bp, Homo sapiens
cggcgatgccccagacgcggctgcagttttcaaaccgcgactgcaagcttcggtagtcctctccgctgctgtcgccaggagtcacttcacgagaagccaggtcacaaccgtcggcccttgtctggaaaagtaaaagtggatcctgccacgttcggagctccctggcgcctcgcccggctggagctagagaactcgtcctgtggcggcccccggcgtggggcgggacagcggccccctggagggggcagtcccgggagaacctgcggcggccggagcggtaaaaataagtgactaaagaagcagacctgggaatcacctaacatgtcgaggaggagatttgattgccgaagtatttcaggcctactaactacaactcctcaaattccaataaaaatggaaaactttaataatttctatatacttacatctaaagagctagggagaggaaaatttgctgtggttagacaatgtatatcaaaatctactggccaagaatatgctgcaaaatttctaaaaaagagaagaagaggacaggattgtcgggcagaaattttacacgagattgctgtgcttgaattggcaaagtcttgtccccgtgttattaatcttcatgaggtctatgaaaatacaagtgaaatcattttgatattggaatatgctgcaggtggagaaattttcagcctgtgtttacctgagttggctgaaatggtttctgaaaatgatgttatcagactcattaaacaaatacttgaaggagtttattatctacatcagaataacattgtacaccttgatttaaagccacagaatatattactgagcagcatataccctctcggggacattaaaatagtagattttggaatgtctcgaaaaatagggcatgcgtgtgaacttcgggaaatcatgggaacaccagaatatttagctccagaaatcctgaactatgatcccattaccacagcaacagatatgtggaatattggtataatagcatatatgttgttaactcacacatcaccatttgtgggagaagataatcaagaaacatacctcaatatctctcaagttaatgtagattattcggaagaaactttttcatcagtttcacagctggccacagactttattcagagccttttagtaaaaaatccagagaaaagaccaacagcagagatatgcctttctcattcttggctacagcagtgggactttgaaaacttgtttcaccctgaagaaacttccagttcctctcaaactcaggatcattctgtaaggtcctctgaagacaagacttctaaatcctcctgtaatggaacctgtggtgatagagaagacaaagagaatatcccagaggatagcagcatggtttccaaaagatttcgtttcgatgactcattacccaatccccatgaacttgtttcagatttgctctgttagcacttttttctttgactcatttggactgaatttgaaattttatatccactccagtgagattatgatttgtagcttcatatatgacatgtttatattgtaaatgcacttttccatggaataatttagggaagtgttttaatgttaaattactagttgctagcatgttatgatttcatatcctgagatagctctgcagataagaaaatatttaaatatatgacaaaaagtaaaattgta

SEQ ID NO: 409041 - DNA, 1276 bp, Homo sapiens
ggacccggattagagaatatctggcagcataacctccgggacataaaagagggagattgtgggaagttccccgaaaaaataggggcatgcgtgtgaacttccggggaaatcagggggaacaccagaatatttagctccagaaatcctgaactatgatcccattaccacagcaacagatatgtggaatattggtataatagcatatatgttgttaactcacacatcaccatttgtgggagaagataatcaagaaacatacctcaatatctctcaagttaatgtagattattcggaagaaactttttcatcagtttcacagctggccacagactttattcagagccttttagtaaaaaatccagagaaaagaccaacagcagagatatgcctttctcattcttggctacagcagtgggactttgaaaacttgtttcaccctgaagaaacttccagttcctctcaaactcaggatcattctgtaaggtcctctgaagacaagacttctaaatcctcctgtaatggaacctgtggtgatagagaagacaaagagaatatcccagaggatagcagcatggtttccaaaagatttcgtttcgatgactcattacccaatccccatgaacttgtttcagatttgctctgttagcacttttttctttgactcatttggactgaatttgaaattttatatccactccagtgagattatgatttgtagcttcatatatgacatgtttatattgtaaatgcacttttccatggaataatttagggaagtgttttaatgttaaattactagttgctagcatgttatgatttcatatcctgagatagctctgcagataagaaaatatttaaatatatgacaaaaagtaaaattgtacatgtgagtttacatgttaatgaaataattcaacttcaaatgaacttaccagaatgttttgcatatcaacaaaaaaagtggcttgagttttattatagttggtgtaaactgaacacagtgaagacattggaatttaataggttctctctctaaggtgactcttataccatgcctctatcaacataatttgtttaggaaagcagtatgaagtttaagccaaaataatttctactttatagatgctcaagagacattttacaattgaaaatgtctttcaattacaaatattttgaaacttcgtaagattttcattctctgtggtctgttatatgagagagatcctttaactagagcaaagagggagttagaaacctgatcagggatattctttac

SEQ ID NO: 409042 - DNA, 954 bp, Homo sapiens
actacagtaggtgacgattggccggccaaaagacagaggctgaaaagaccaacagcagagatatgcctttctcattcttggctacagcagtgggactttgaaaacttgtttcaccctgaagaaacttccagttcctctcaaactcaggatcattctgtaaggtcctctgaagacaagacttctaaatcctcctgtaatggaacctgtggtgatagagaagacaaagagaatatcccagaggatagcagcatggtttccaaaagatttcgtttcgatgactcattacccaatccccatgaacttgtttcagatttgctctgttagcacttttttctttgactcatttggactgaatttgaaattttatatccactccagtgagattatgatttgtagcttcatatatgacatgtttatattgtaaatgcacttttccatggaataatttagggaagtgttttaatgttaaattactagttgctagcatgttatgatttcatatcctgagatagctctgcagataagaaaatatttaaatatatgacaaaaagtaaaattgtacatgtgagtttacatgttaatgaaataattcaacttcaaatgaacttaccagaatgttttgcatatcaacaaaaaaagtggcttgagttttattatagttggtgtaaactgaacacagtgaagacattggaatttaataggttctctctctaaggtgactcttataccatgcctctatcaacataatttgtttaggaaagcagtatgaagtttaagccaaaataatttctactttatagatgctcaagagacattttacaattgaaaatgtctttcaattacaaatattttgaaacttcgtaagattttcattctctgtggtctgttatatgagagagatcctttaactagagcaaagagggagttagaaacctgatcagggatattctttac

SEQ ID NO: 409043 - DNA, 1414 bp, Homo sapiens
ttccccgagttgaaggttgcctgcaagcttcggtagtcctctccgctgctgtcgccaggagtcacttcacgagaagccaggtcacaaccgtcggcccttgtctggaaaagtaaaagtggatcctgccacgttcggagccccttcgcggcgggcccgcgcgggtcccttccacagcaaggccacgcggtccccctagcctctcccgagtcccagctgcggcgtgggcgcgttcccatcgggactcgtggacgcgtcctgctcccagctgcctttcgtctagagaaagttcgtgttcatcttgtgggacgttttcagttactgcttgggaacagtgttttaaaaccagcgagagatcaagacgggctacagctgtttccgtgattttcagcgatctgatttttgctttgatgccttgtgacccacttagtgtgcacgactcatcctcaaactataccactactggatgccaacgatttttgacatttacccaggctctttgttttattgtagggaaaagcgtttcatttgaatttcctccgagggagaagtagagacaaagttgaaagaggctttatagcagctggtagctggcattagtttctgtctggactagaggcactctgacatcaatttggaaattggaattaagaaaatacgtttttaaaatcgtaatacttatcagatttcactaatatttaaacacatgaggactgtgtatcacattcaccgattgttttgtcgacgtaatgtttacatctgtggtgctaatgataagcagaaccttgccagggacgtttgacgtggtgtggccactttacgttttcaagtctatgagaatgtctgcgcggagacagcatagctctgtagaaatgagtggcagcgtatgtaacctggcattttgaacccaggagcacaattttattaaaggaaaataaacctaaagaaacaaaaaaacaaataaaaataaacaaaaaaaaaaaaaaaaagatacaaataaaaaccgacaacgcaacaaaataacataaaaaaacagacaagactaacaacataacaaataaacacacacacactcacagacacaccacagacacaatacaaagataaaacacaaagagagcaacaacaacattctaatataatcatattctaatcacatcaaatccatagtctgcgtcctcactttatctactctctaccatcaccgagcgggagagcgcaacacacataaagcgtgacgccggcagcgcgagcagcgccgatggcagttattatagaagagagacgagagccgcagcaagagaagagcatgcaaacagtagcagagaaatagatcaagcgagggctaagcggaggtgggaggacagatacaagtctaagaaatacatagcgagtgcagttccggcgacgcacactc

SEQ ID NO: 409044 - DNA, 428 bp, Homo sapiens
tattaacatttatatagttgtatgtcttttacttaacaggtacacaatatttaaaagtgtttaggtgaatgaattttcaagtctctgttctttgaattttattttagtgctgcaggtggagaaattttcagcctgtgtttacctgagttggctgaaatggtttctgaaaatgatgttatcagactcattaaacaaatacttgaaggagtttattatctacatcagaataacattgtacaccttgatttaaaggtaacgtaacgtgatttaaagtaatgcaacatctgtgttcttcttctgctcttagtatgcacagttgcaaactggtattaacaggaaacaatggttggttcctggtcttctagactgcactggtgtgctctttgcttacgtgtgcctatgtggccttaattttatattggcagaaa

SEQ ID NO: 409045 - DNA, 473 bp, Homo sapiens
gcgatgccccagacgcggctgcagttttcaaaccgcgactgcaagcttcggtagtcctctccgctgctgtcgccaggagtcacttcacgagaagccaggtcacaaccgtcggcccttgtctggaaaagtaaaagtggatcctgccacgttcggagctccctggcgcctcgcccggctggagctagagaactcgtcctgtggcggcccccggcgtggggcgggacagcggccccctggagggggcagtcccgggagaacctgcggcggccggagcggttagtgtcctgcgggattggcgggttggctcggggctgcgatggaaccagccgcctcggtacagagacctcatacgtgaggaaggaggacccgaggagggtttaggcggtacggtccggctgagaggggcttggactccgccgcccctgaggtggctgattgctgctggcgcctctccgctttgcggctggagtccg

SEQ ID NO: 409046 - DNA, 2050 bp, Homo sapiens
ttccccgagttgaaggttgcctgcaagcttcggtagtcctctccgctgctgtcgccaggagtcacttcacgagaagccaggtcacaaccgtcggcccttgtctggaaaagtaaaagtggatcctgccacgttcggagctccctggcgcctcgcccggctggagctagagaactcgtcctgtggcggcccccggcgtggggcgggacagcggccccctggagggggcagtcccgggagaacctgcggcggccggagcggtaaaaataagtgactaaagaagcagacctgggaatcacctaacatgtcgaggaggagatttgattgccgaagtatttcaggcctactaactacaactcctcaaattccaataaaaatggaaaactttaataatttctatatacttacatctaaagagctagggagaggaaaatttgctgtggttagacaatgtatatcaaaatctactggccaagaatatgctgcaaaatttctaaaaaagagaagaagaggacaggattgtcgggcagaaattttacacgagattgctgtgcttgaattggcaaagtcttgtccccgtgttattaatcttcatgaggtctatgaaaatacaagtgaaatcattttgatattggaatatgctgcaggtggagaaattttcagcctgtgtttacctgagttggctgaaatggtttctgaaaatgatgttatcagactcattaaacaaatacttgaaggagtttattatctacatcagaataacattgtacaccttgatttaaagccacagaatatattactgagcagcatataccctctcggggacattaaaatagtagattttggaatgtctcgaaaaatagggcatgcgtgtgaacttcgggaaatcatgggaacaccagaatatttagctccagaaatcctgaactatgatcccattaccacagcaacagatatgtggaatattggtataatagcatatatgttgttaactcacacatcaccatttgtgggagaagataatcaagaaacatacctcaatatctctcaagttaatgtagattattcggaagaaactttttcatcagtttcacagctggccacagactttattcagagccttttagtaaaaaatccagagaaaagaccaacagcagagatatgcctttctcattcttggctacagcagtgggactttgaaaacttgtttcaccctgaagaaacttccagttcctctcaaactcaggatcattctgtaaggtcctctgaagacaagacttctaaatcctcctgtaatggaacctgtggtgatagagaagacaaagagaatatcccagaggatagcagcatggtttccaaaagatttcgtttcgatgactcattacccaatccccatgaacttgtttcagatttgctctgttagcacttttttctttgactcatttggactgaatttgaaattttatatccactccagtgagattatgatttgtagcttcatatatgacatgtttatattgtaaatgcacttttccatggaataatttagggaagtgttttaatgttaaattactagttgctagcatgttatgatttcatatcctgagatagctctgcagataagaaaatatttaaatatatgacaaaaagtaaaattgtacatgtgagtttacatgttaatgaaataattcaacttcaaatgaacttaccagaatgttttgcatatcaacaaaaaaagtggcttgagttttattatagttggtgtaaactgaacacagtgaagacattggaatttaataggttctctctctaaggtgactcttataccatgcctctatcaacataatttgtttaggaaagcagtatgaagtttaagccaaaataatttctactttatagatgctcaagagacattttacaattgaaaatgtctttcaattacaaatattttgaaacttcgtaagattttcattctctgtggtctgttatatgagagagatcctttaactagagcaaagagggagttagaaacctgatcagggatattctttac

SEQ ID NO: 409047 - DNA, 1673 bp, Homo sapiens
cggcgatgccccagacgcggctgcagttttcaaaccgcgactgcaagcttcggtagtcctctccgctgctgtcgccaggagtcacttcacgagaagccaggtcacaaccgtcggcccttgtctggaaaagtaaaagtggatcctgccacgttcggagctccctggcgcctcgcccggctggagctagagaactcgtcctgtggcggcccccggcgtggggcgggacagcggccccctggagggggcagtcccgggagaacctgcggcggccggagcggtaaaaataagtgactaaagaagcagacctgggaatcacctaacatgtcgaggaggagatttgattgccgaagtatttcaggcctactaactacaactcctcaaattccaataaaaatggaaaactttaataatttctatatacttacatctaaagagctagggagaggaaaatttgctgtggttagacaatgtatatcaaaatctactggccaagaatatgctgcaaaatttctaaaaaagagaagaagaggacaggattgtcgggcagaaattttacacgagattgctgtgcttgaattggcaaagtcttgtccccgtgttattaatcttcatgaggtctatgaaaatacaagtgaaatcattttgatattggaatatgctgcaggtggagaaattttcagcctgtgtttacctgagttggctgaaatggtttctgaaaatgatgttatcagactcattaaacaaatacttgaaggagtttattatctacatcagaataacattgtacaccttgatttaaagccacagaatatattactgagcagcatataccctctcggggacattaaaatagtagattttggaatgtctcgaaaaatagggcatgcgtgtgaacttcgggaaatcatgggaacaccagaatatttagctccagaaatcctgaactatgatcccattaccacagcaacagatatgtggaatattggtataatagcatatatgttgttaactcacacatcaccatttgtgggagaagataatcaagaaacatacctcaatatctctcaagttaatgtagattattcggaagaaactttttcatcagtttcacagctggccacagactttattcagagccttttagtaaaaaatccagagaaaagaccaacagcagagatatgcctttctcattcttggctacagcagtgggactttgaaaacttgtttcaccctgaagaaacttccagttcctctcaaactcaggatcattctgtaaggtcctctgaagacaagacttctaaatcctcctgtaatggaacctgtggtgatagagaagacaaagagaatatcccagaggatagcagcatggtttccaaaagatttcgtttcgatgactcattacccaatccccatgaacttgtttcagatttgctctgttagcacttttttctttgactcatttggactgaatttgaaattttatatccactccagtgagattatgatttgtagcttcatatatgacatgtttatattgtaaatgcacttttccatggaataatttagggaagtgttttaatgttaaattactagttgctagcatgttatgatttcatatcctgagaccatgccactgcactccagcctgagagacagagcaaaactccatctca

SEQ ID NO: 409048 - DNA, 1241 bp, Homo sapiens
cggcgatgccccagacgcggctgcagttttcaaaccgcgactgcaagcttcggtagtcctctccgctgctgtcgccaggagtcacttcacgagaagccaggtcacaaccgtcggcccttgtctggaaaagtaaaagtggatcctgccacgttcggagctccctggcgcctcgcccggctggagctagagaactcgtcctgtggcggcccccggcgtggggcgggacagcggccccctggagggggcagtcccgggagaacctgcggcggccggagcggtaaaaataagtgactaaagaagcagacctgggaatcacctaacatgtcgaggaggagatttgattgccgaagtatttcaggcctactaactacaactcctcaaattccaataaaaatggaaaactttaataatttctatatacttacatctaaagagctagggagaggaaaatttgctgtggttagacaatgtatatcaaaatctactggccaagaatatgctgcaaaatttctaaaaaagagaagaagaggacaggattgtcgggcagaaattttacacgagattgctgtgcttgaattggcaaagtcttgtccccgtgttattaatcttcatgaggtctatgaaaatacaagtgaaatcattttgatattggaatatgctgcaggtggagaaattttcagcctgtgtttacctgagttggctgaaatggtttctgaaaatgatgttatcagactcattaaacaaatacttgaaggagtttattatctacatcagaataacattgtacaccttgatttaaagccacagaatatattactgagcagcatataccctctcggggacattaaaatagtagattttggaatgtctcgaaaaatagggcatgcgtgtgaacttcgggaaatcatgggaacaccagaatatttaggtaagaatttccttttattttctataccattttgaaatttattaagtaaatgatacctctgtagaactatattttagagcatgtaattcgattcagttaaaaggatttgattggttcaagtattttgatacattaaaacttggttaggttaagacacatttaaatgaaatgtattgaataaaagtatgaaacatttacagcaattcaggggacactgaatatgtaagtgtacaagttgaatgtttgtgtataaaggatttgtacataaggaaaaaagaaatgggtaagagggaagttagggaaaaagagaaaa

SEQ ID NO: 409049 - DNA, 1054 bp, Homo sapiens
ttccccgagttgaaggttgcctgcaagcttcggtagtcctctccgctgctgtcgccaggagtcacttcacgagaagccaggtcacaaccgtcggcccttgtctggaaaagtaaaagtggatcctgccacgttcggagctccctggcgcctcgcccggctggagctagagaactcgtcctgtggcggcccccggcgtggggcgggacagcggccccctggagggggcagtcccgggagaacctgcggcggccggagcggtaaaaataagtgactaaagaagcagacctgggaatcacctaacatgtcgaggaggagatttgattgccgaagtatttcaggcctactaactacaactcctcaaattccaataaaaatggaaaactttaataatttctatatacttacatctaaagagctagggagaggaaaatttgctgtggttagacaatgtatatcaaaatctactggccaagaatatgctgcaaaatttctaaaaaagagaagaagaggacaggattgtcgggcagaaattttacacgagattgctgtgcttgaattggcaaagtcttgtccccgtgttattaatcttcatgaggtctatgaaaatacaagtgaaatcattttgatattggaatagtaagtatatactaaatagtacctattttagttggtatgaaaagatgattaaaatgtcaagaataagaatgataaaggtgtgacaagaacttgtaaagattcctgttaataaaatgtaaaagggacctaatttatattcagatattttcataagactaaatgtatagcctcgggcacatacacaaaaactaacagcacagaataagcaaatgacaaatacaacatttgaggaatgtggagaaatgaatatacattattttcttaatggctaattgattgaatttttctggaacacaatctgatgggcagatagaattgaagtaatttgtatattttcttcatctatttgaaaaataccttcaagaaaataagaatagaaaggagaattgaagtaatttgtatattttcttcatctatt

SEQ ID NO: 409050 - DNA, 545 bp, Homo sapiens
ccacttaatcctcataacaaagcttcgatccaggtatcactgtccccagtttacaggccaagaaacaggctcagagggtgaaaccatgaactccaggtgaaactatagaactggccttgccaggttggcttgactccaaagacacagctctctggcgctcccatgggatgtcgccctctagtgagaaggtgctgaaatccaatctgggcacagaccactctatctggtccacgcttggccaagcttatggccagtgtgtatggagggcaacccatgagcgggtgcttcagcttaaactccagaggacactgtcctgggtggggagcctggaattgtgctgaagcctgagctgccctgagaaggagttctcagctgaaggttttctgttcatctgtttggcaaatgagtggtggagcctagttttgaacctagaaccagaaataacatttgacccagcaatcccattaccgggtatatatccaaaggaatataaatcattctattacaaagatacatgtgtgcatatgttcactgtagcaatagca

SEQ ID NO: 409051 - DNA, 979 bp, Homo sapiens
cacagacgtcgactccagcaaaaatgtcctgactgacttcaggagagaggaattattgctacgtgcctctttcccagtgaagaaaatctctgttggctgcgagcagagaagcggcggaaggattcccgactccgggaagccaggtgtcggaaggaggaagtacgcttgaagggggtccggctggccgactctgcactcgtccgttcgtggcccaccgtggtggtcaccaaattgagggcttcctggaaggacctcctcacggtgcccatccactgggtcatgtgggtctgggccactgtgagtttatctcccagctgtctctccctccctctctggaaggcaacactgatccaggatctcactctgttgcccaggctggactgcagtggcatgatcacagctcactgcagccttggcctcccaggctcaagcgatcctcccacctcagcctcctcggtagctaggactacaggtggagcaacaccgtcagtcagaaggcagcggatggcacagggcttccgcgtaaggcctgcatcgcctgagtcatggttttctcatcttgtatgaggcccacccccttcaaaaggttgtgacaaaaaaaacaactgagataatttgtgccgctggcacatagttaacactcaataaggccgggcgcagtggcttacacctctaatcccagcactttgggaggctgaggcaggtggatcacttgaggccaggagttcgataccagcctgaccaacatggtgaaaccccatctcaactaaaaatacaaaaattagccaggcatggtggtgtgcacctgtagtcccagctacttgggagcctgaggcaggagcatctcttgaacccgggaggtggaggttgcagtgagcggagatggcaccactgcactccagcctgggcgacagaacaagactctgtctcaaaacaacaacaacaacaaaataataaatggtgaccacaagggatgatc

SEQ ID NO: 409052 - DNA, 476 bp, Homo sapiens
ctcccccaagtcccaactcgctcacggtccctcggggctgatggcaacttcacgtgcctgccagcctacccacccctgtgccctcacagcaagcgcaccaggaaatgcggctgcacgtgtgtgcatgtgtgtgcactctgtgtgtgtgtgcgtgtatgtcggcgatctggcagccccgggaaggttagcactgctgggaaacggcttctgcctctaaggttacaggcagcgtcttgggacctctggtcggctgtcagtctgtctccctctcgtggtctgtttctctgttgatttctcagcctcgctctcctccctctccctgtgtctcaacttccacttgcttgtctctaagcttctctcctctctctctccttttcagctgtctctccctccctctctggaaggcaacactgatccaggtgagacagcctctgaggtcccccaggaaggactggggagggctgtatttcagtaca

SEQ ID NO: 409053 - DNA, 754 bp, Homo sapiens
tttttttgttttttttttttgagacggagtctcgctctgtcacccaggctggagtgcagtggcgcgatctcggctcactgcaagctccacttcccgggttcacgccattctcctgcctcagcctcctgagtagctgggactacaggcacccgccaccacgcctggctatttttgtatttttagtagagacggggtttcaccgtgttagccaggatggtctccatctcctgacctcgtgatccgcttgcctcagcctcccaaagtgctgggattataggcgttgagccaccacgcccggcccctccaaagtatgttttttaaactgcctgcagatcactaatcagtcaggagagaatgagagactgaagttatgctaataggcagcaacagtgcatgtttcagaggaagtctgacatcgcagctgtgtaaccagcagggatttccttctcttccttggggagaaaatcatcagaaaatactgggccagggctctggaattaaactgacacttgtaaaagagagagaaaaaaaaaacaatctaaagataggtctgatgctgctgccttgttttcatttttgcaataggacctggagggagaatggcaagcagctgattcatctccattgcctgtgaaacactgctactccacgtgtcacttctcactcaggggtcccctcctcactcctccctactcaagggtaacctccatcctgaattttgtgcttatcattccctttttttttctttatagtg

SEQ ID NO: 409054 - DNA, 274 bp, Homo sapiens
acaagctgtaatcaatcagctgggtataagatggggttttcaccctttccaagctgcatgagctccagccacccctaggaggagacaacatatcacgcatctcaagacctggagggagaatggcaagcagctgattcatctccattgcctgtgaaacactgctactccacgtgtcacttctcactcaggggtcccctcctcactcctccctactcaagggtaacctccatcctgaattttgtgcttatcattccctttttttttctttatagtg

SEQ ID NO: 409055 - DNA, 717 bp, Homo sapiens
cctttgtccccatggcttaggtgaggccaagctcaccacctcctggagggaaggagtaggtgtcggaccctggcctggccaaagtgttgcaactcccgcccaccgtgactggttttatggatggcaagtgaccctactgggtcagctggaaacaatcctaggacttgtgttaaaggagaagctctttctttggtgatgtcccttaaaggtacttgaaactgctgtcatcacgagagaatggtgccaacaagcagagaggtggtgagagagtcccagatcctgatgacagtttcaaacccccagatccagctctgcttgaagctagccctaccctgggcttttagtgatataagtcaatacacttccccttttgcttaacccggtttacatggatttctttcccttgcaactcaaatgagcctgaatgaaggaacaggtcactggttcagccttatagaaacccacaggcatcatttttaacctgagaaactttaaatccccaaggccaagaaatacccaaggctcactcctcccaaacccacatgccaacaacatacatgtcacacaagacagacgagatcactgtttctcacatgcaacaggcacgggtggtcccagagcagggaggctcatgcaggtgcagggacctgggtccaaacaccaaacggggaagaaaactccgaggtaggcaccttgacgccagctgatggcatacaa

SEQ ID NO: 409056 - DNA, 232 bp, Homo sapiens
cacccctcctttatacatttaaacaaaaaccaaaaccttgtcccatgtaaattggcttagaaaattatgacacagcactttgggaggccaaggcaggtggatcacctgaggtcaggagtttgagactagcctagccaacatggtgaaaccctgtctctgctaaaaatacaaaaattagccaggcatggtggcgcgcacctgtagtcccagctacttgggaggctgaggcagg

SEQ ID NO: 409057 - DNA, 232 bp, Homo sapiens
aaattgcatggtgccaccagaagcttttgcttgtacactttctcatatttgtacttttctcatatactatgaccaacaacattatcatcatttcccccattttgcagatgaggaagcggagtctcaaaacagctaggtgatttgcccaagatcacttggctatgaagtgacaatattaaaatcttctaaaatataactttgcttttgacacttcagagaaaacttccaaccg

SEQ ID NO: 409058 - DNA, 303 bp, Homo sapiens
cttaatccttcagaatttactgggtcttaagaatcctacagattctctccattccagaaaaattatacacacacagatacctatctaatgcttatcattaggcctctccttaggggaattaaccccacattaataaattttcacttaaaagaatgactattttcttcctgatggtcactcaaggagtataaggcatggctaaattttcatttgtttcattttaatggttccaaactaaatacttaaaatgtttctgatactttgagtcactctaagacatcaaatcattcatgagcattggat

SEQ ID NO: 409059 - DNA, 309 bp, Homo sapiens
ctactgcactccagcctggggaacagagtgagaccctgtctccaaaaaataaaaataaaatataaagtattctgaactcttggtccccgcaaattaccagctcagttatccacatactctcagtcttctcagcactcttcactcagagaatggggaattcttgttcatccaggatctaattttccctctctaggactcatcccaggccccactgaaccagcagtaagcacttataaacatacagacaagtgctagaattaataagaggtgaatacgggatcttaattgcaggggacactactatccagt

SEQ ID NO: 409060 - DNA, 309 bp, Homo sapiens
ggtgagcccagattgcgtcatagcactccagcctcggcaacaagagcaaaactccatctcaaaataaataaataaataaattaattaatttaaaaaagataatctggtaatcgctgctgaatttggggaggcactttcaaaggtaaaccaaggaaaggtgggactattgccagagtttcagtggccgcagttccttgtaacagataaatgatttagctatttcataattatatgtaagacaggttaacaggattgaacatgcgataataacatcttttagaaaagctctcaatttcttattttttattt

SEQ ID NO: 409061 - DNA, 751 bp, Homo sapiens
cgcgtacacacacacacacacacacacacacacacacacacacacacacacattcctgttcaagatttaggtcagttggtttgcattaaatgagattttggagaagaactgaatttcaaatcctaaaaattcgattcaaactccaattttgccagctcttacaaactatgtgaacttgggtgggtagcaatcaagttctctcatctacaaaatggagcaaataatctctccctgactgttatgcaggattgtgatggtttaaaatagaaaggccccgtgaccatgattactaaacaatagtgacatatgaaaataagtgaatgctaaaaaatgatccaataacaacttctctctgcatttatcaagtaaacttgtcactctaagaaagccgttttaaaagcctgtcaccttaagtttccactgaacctcagtgcacctcagtttcttcacttgtcatgtgaaaataatctccatccatttcatggaatttttgagattctcaaagcattcaactatattgtatgtcaactattattattggtgactacacagaagtatgtaaaatcctgtctctcacaatcccagccagttaaattcctactccccaaagagctcctatatacttatggagccttatcttgtcaaaacacaataatgaacacattgtgatgacttaatacatatgcctccttatcagttacagaacaatggcatagtaagaaaggccatactcatgatcctagctactttg

SEQ ID NO: 409062 - DNA, 271 bp, Homo sapiens
ctaaaaattaactaatatttttgatgaattaactgcctgatacacctgtattgtacattattttctacattttgactgcatattccttaatcttttataatattttctatacggaaaacagaaagataattcagccttttttctagcgcaaatgatggaaatttgttaaaaatccatagtttaggaagtttctttccactttacaacctgttattgacaatgacaggtgcattattaggattgccaaatttacaaaaatctctatcgaatt

SEQ ID NO: 409063 - DNA, 300 bp, Homo sapiens
cactgtgcctatggctcatctagcctgcttccctcatttttgtgacctgcctggttcccatggggaactgagtttgcaatccggggagcaatactggctgaattcatgttcatattgagagcattctgagtagctggcagggccacacagaccttagcgggaagacagggacaccactttccaggatgatccctgtgaaaactgccatgtttgcactgccctcctctgtgagacatggtttagctcaagtccttgctctggtaactttccaacatgtgactttgggcacatgtgaccttc

SEQ ID NO: 409064 - DNA, 299 bp, Homo sapiens
ggagaatccactccatgtttctttcttagtttctgggggttgcaagcaattcttagtgttccttgccttatagatatatcactccaatctctattactgtcttcacattgccttctcatctatgtctatgtctccaatctccctctgtttttcttataaggacacactgatcattagatctaggatccaccttaaatccaggatgatcttatctcaagatctttaatttaattatatctgcaaagaccctcttccaaataagttcacattcagagcttccagggtttaggagttggaca

SEQ ID NO: 409065 - DNA, 241 bp, Homo sapiens
ggagcccattcctttggccttggcttctcaaacagcgttataactgtccttcaagtgagcttgctaggcagaggaaaacttgttcttttctttttaacccttgccttgcctctttatttatttttaaatttctgcctcagggccatcatcacagcaaatgtgaggtttctcttctgcttctcctcttggtgttccctctccctgagttccgactcccatagctaccccaagctccctccct

SEQ ID NO: 409066 - DNA, 298 bp, Homo sapiens
ggaaaaacaaaacattagaaagatatgtttgaaaaaagcagatatatcctaaaagcaaaatttagttgtttgggattctgttttacattatccacacaactacttctttctatagatactgttaatacaatgatatatgactaaaccagaatattaaactatcagtgatgttcacaggtttcatcaaaataaggaaaacttccttgatatatttgttttctgaactatcattttgtcccctcataactaataaccctcaggaattatatctccctttgccaagagaaaaaacctgtct

SEQ ID NO: 409067 - DNA, 267 bp, Homo sapiens
tgtggagctggattttaagcagcaagaagacaaactccagccggttctaagaaaactccaccctattgaggaaactcaggtcataccttcgccttactctcaggagacttactcctcaactcccaagcaaaaatccaaaactgaatctaaaaagcacggaagatggaaactctggttcctttaacactcacggtgtctggagtctcgaggccgtctttagaacccactggagtttaagtcaatacttttccaaaatgaataggatcg

SEQ ID NO: 409068 - DNA, 3086 bp, Homo sapiens
  misc_feature (1412)..(1412): n is a, c, g, or t
  misc_feature (2250)..(2250): n is a, c, g, or t
  misc_feature (2311)..(2311): n is a, c, g, or t
  misc_feature (2881)..(2881): n is a, c, g, or t
tcgctcaggatgtcactctctttgatgagattgtcggcaaaatctgccaagccggggtgtgggtatttcccgggagaagtgctcttggagtcctgcctgccctcagccgtggggcagccgctgctctgggtgccgctgctcaagctgccctcgtcagagtccagcaaggttcccttgccagtctcaccggtccactcgttgctggaggaattcttcaggacttttaaagacctggatgaagctacagtgagaaaaacacatttcgctgtgatacagaaacaggttacacaatgtgtaatgtttgcctcaaagcttgtgtaagatttaacattaagattttattttatgatatgacttcagttagcaactatcctggtaattaggcaaaaatgtagctactgaaaacatggacatttttgacttaggtttacagttgtaagttaggcaattcagcatttttagattaccagagctcaattatgtagatagaactagacactagaaactactacatgggctaagattcttattttgccaaggagtaagttgaaaagttaattggtaataataaatctaggctcctttctttcactaaggtgctttgtaatttgatcatgaagatcacaccatattcctatgcatcttctcaccttgtggatttcccttgctgctcaattaaaagtagaaaatgcccctcccccccccctttttttttaaagacagtgtcttgctctgccacccaggctggagtgcagtggtgtgatctctgctcactgcaacctccgcctcctgggctcaagtgatcctcccatctcagcctcctgagtagttgggactataggtgcgcatgatccctggctaatttttatattttttttgtagagatggggttttgccatgttgcccaggttggtctcaaactcctgttctcaagagctcaagggatccacctgccttggcctcccaaagtgctgggattacaggcatgagccaccatgcccagcctagaaaatgctctttatctctcatatgagaactgtctctgctggaatttcaaaacaactttctgaaattttatgttataggtgtgtgtgtgtgtgtgtgtagttctgttctcttggattgaaagaaggaagggagttctcagttttggtgtttctacaaagtaataacagcatgttattttgatggccagtttattttgacaatggagaaaatagtaaatatgtggtagatctgaagaggtcacactgatttgacatgaaaaagcgaagttttacattttctaagcctaaaaacaagaaagataataacaaaatagttaatgtagaaataaggttctgaaaacttaagctgaaattttagaaacaagcagaaagaacaacgtgatttgaaatgcttacttggtgccntatcgattaagaacgagtataagaggccccttaacttagatggcattacatcccaatcaacccattgttaagttgataatatggaaagtcgagaatgcatttaatgtacctactaaccactgcggcttagcctagcctgccttcagtgtgctcagaacacttacattagcctatggttgggcagaacacaaggcctgttttataattaagtgttgagtatctcatgaaatgtattgaatgctgcactagaagcaaaaaacagaatggttgtctgggtactcgaagtacgatttctactgaatgtgtgtcactttcacaccacggtaaagtcgaaaaattgtaggttgaaccatcagaaggtggagaccctctgtgtaaggttcttgatcttcattcagcattgaccttcaggatgcctggcactgttctgagcactgggaatacagcagtgaggaaaacaaagtccctggacccatgcacatcttagtggaagaaacaaaatcgtacatttggactatgtcagcgggtaggaagacaagggactgggggttgggggtggctgtattttacagtagaacgtctgggagcaagaggcatgtttaggtttcttaaaaggagataaaggtacctcgatgacttacaaagtgaaaagtcacagctatgttacaagagcatatatccttttcagaagctcataatattttgttgaataaacacaaggctagcaaaattctcacctaatttggccgaaacaggaactcggttcttaagaggtaccaggcgatccttacacgttttctccagtggtaattcacactttatgtgacgcctgaagttntccctcagaatagaacgaatcaccttaacaatgttggttttgctttcactgtcactgggtngggggggagagaaaacagcagaagtgtccacagtgttcatcgtgcttccattccacgcccgcctgtgttcctgtgccttgcacctgctggaccaggctgccagccagccacccaacagcagtgccatgtggcctcccgtacagaaggagattttcctccatctgaactgccttcaccctctctctggagcccctctctggggaagaggagattcagtggatcctattcttcaacctcctttgcagttttgccctttccttggaaggaacaggagctggggtacttgaggtaaaagaggcctgccccaaatgtggtcattttctcgaaaacataagcacttctgacaaaagttaaacagaagcccagcaggtcactgcatgactcagcctgctggcctcttctgtcaccagatacctgtcaccaaaacaaggttactctggaaggatctctgaacattttccagagtcaaagatttttttctttttatatcacctacagtactacctaaccttaaggaattttctgctatattctaaatttgtaaaaacataaatttgtggatctttgttnttctaacacattttagggtatcaaggcagaaaggaaaatgttgaaaactattgatagggaaaataaggaaacaatgaaaggcatttggcaaagaaaaagctatccaccagcatttagtttctcccagaagtctgctaaggaacatcaaaacaacctctcttgtcctcattttccttgtctataaaataaaaggcaccaaaaatta

SEQ ID NO: 409069 - DNA, 877 bp, Homo sapiens
tcgctcaggatgtcactctctttgatgagattgtcggcaaaatctgccaagccggggtgtgggtatttcccgggagaagtgctcttggagtcctgcctgccctcagccgtggggcagccgctgctctgggtgccgctgctcaagctgccctcgtcagagtccagcaaggttcccttgccagtctcaccggtccactcgttgctggaggaattcttcaggacttttaaagacctggatgaagctacagtgagaaaaacacatttcgctgtgatacagaaacaggttacacaatgtgtaatgtttgcctcaaagcttgtgtaagatttaacattaagattttattttatgatatgacttcagttagcaactatcctggtaattaggcaaaaatgtagctactgaaaacatggacatttttgacttaggtttacagttgtaagttaggcaattcagcatttttagattaccagagctcaattatgtagatagaactagacactagaaactactacatgggctaagattcttattttgccaaggagtaagttgaaaagttaattggtaataataaatctaggctcctttctttcactaaggtgctttgtaatttgatcatgaagatcacaccatattcctatgcatcttctcaccttgtggatttcccttgctgctcaattaaaagtagaaaatgcccctcccccccccctttttttttaaagacagtgtcttgcactgcactccagcctaggcaacaaagtgagactccatctcaaaaaaaacaacatcaaaaaagccattaagcaatgttatccagaccctacaccatacccacaaaaatttcataaaggaaaataaaccagtgtttttcccactggcc

SEQ ID NO: 409070 - DNA, 289 bp, Homo sapiens
ccatgcctggccttgaatctgaaatttttatgtgcaaaatggaactgaaaaaagtcacaagaaattactgttttcaaatatgtaccatataccttctaaaatgatgcagcttgtacctgcctcttaattatgaatatcagatattagtaatattttttaaaataatgagtttattggagaagctttattcagttaaatcttctcaattcagaattttgttacctaacctgttttgcatttgccattaattttgattcaatgctctgtacttaatgatccccaaattcct

SEQ ID NO: 409071 - DNA, 299 bp, Homo sapiens
gttccattcgcctttcctcttctttcctggcccacgccgctccgaggcctcgcgaccgccgagcctgcagcctgccccgcggccaacatgagcttcttgtttggtagtcgctcatctaaaacttttaaaccaaagaagaacattccagagggttctcaccagtatgagctcttaaaacacgcagaagccacacttggcagtggcaaccttcggatggctgtcatgcttcctgaaggggaagatctcaatgaatgggttgcagttaacactgtggattttcttcaatcagatcaaccatg

SEQ ID NO: 409072 - DNA, 609 bp, Homo sapiens
tccatattaagagagaaactagaaaaaaaattttaaaagagaaaactatttgaagtaacagtttataggatggggtgtgtgtaataaatagaccatggaattaaaacccagcaagttgcataaactgtataaactagtgtgccaaatgtatatagcaaatcaaagtgctcactgtgggaatagtgagcatgtgagaagatgaaggatgattgatattataataaggtttgaaaaattgtatctaatttattactcgaaatacagtctagtgtccttgtttttaaaaagccagttacatttttttttcttttttcaagagacagggttggccgggtgtggtagctcacacctgtaatcctagcactttgggaggccgaggtggatggatcacttggtcaggagttggagaccagcctggccaacatgaagaaaccccatctctactaaaaatacaaaaattagctgggcgtggtggcacatccctgtggtcccagctattcaggaggctgaggcaggagaattgctgtaactcgggaggtggaggttgcagtgagtcgagatcatggcactgcactccagcctgcgcgatagagcaaggctccatctcaa

SEQ ID NO: 409073 - DNA, 298 bp, Homo sapiens
cagtgagccgagatcacgctattcattgcactccagcttgggcgaaagagcaaaactccgtctcaaaaacaaaacaaaagaatgccctatcctcgaatgggtttcatttaacctatattagtagcattttctcctgcaacaaacaaataaacaaaacacatgatggaaaagtagcccagtggggccctacgtcattggcagtctagaggttagcctgttcagttgtttgaaggaacaccttggcagatgattagttgttttctagggtagccaagactggtagcttccagtctgcctt

SEQ ID NO: 409074 - DNA, 315 bp, Homo sapiens
gtactgtgtatgaagatatgtgcagggcacgggcaaccttaagagatggcattgtaactctgtgctttgagtgcagtttctaggggagtaaatactctgatgctattctcctctcttcctccaatctcctgcagaggtgcttatttagcaaattcaaccttaaacctgagtgcatggaaactattgatgcagtgtccaaggtggagaaaggtcagagtggatccagaggagccaagagaagacgtccagcatggtgacctgggctcaagtcaaggtccttatttctctggtaagagcaaggatactaaaacatgt

SEQ ID NO: 409075 - DNA, 1484 bp, Homo sapiens
ggacccccttttaggaggcttgtgggcccctccatgcatggaaataaagggaaatcttgagttccttcaagggaattctaggcacctagctagcccaaagaagttaatgagcaacctgataagcaagaagtagctgaacacaatagccaaggaagtcagagtgagatgttttgttccctatagaaactaagggtaacatacatgtccccaacttttcagaaacctgaactctcaccagctttaaacctcagataaggggaaactgagaactgaactctgaccactgttcattgttctaagttgcttcctgaggggcctggaggaagtcatgtccaccggccagagctaacattcttttctgtggatcccaagtttagacagcttcaccgccttaatcataaatcaaaaaatctttgaaaccacctatgacctttgagtccacccccatcccagctttgagatgtcccacctttttaggtcaaaccaatgtatagcctctatgtattgatttatgactttgcctgtaacctctctttccctgcctttaaaaacccgtagctttaagccatctgggagttcgggtcttaagcatgatctgtgcaattctccttgcatggtgccctgcaataaaatgcctcactttctcttgctactagcctgatgtcaatggctttgtggcactgggtgagcagaccccagtttaattcagtaacaattttctgtctaccctgctagaaagtttccttccgtattctttgctagttctttcccatcttcccaaccttgcagtataccaaatctcatttctcacacttctttcctctttacactcatttaatgaacttgcccagttttggggggcaagaatgccgagaaaagatctattcctaaggcccacacagggcctgctgaggactgaggctgaattgaattagaacaacagagaacccctttacttctaccccgctaccagcctaccaagcagctagtaacaagcatccatttctaggggatgggcaaaggcctagaaagttagtcaccactgtgcaggtaggcaggacagctgtaagctgaggatgaagcatgaacacttgagttcttcagccccaacctacagtatagaataatgctagagtaggtgaaatctgtggtacattgaaagcaaccatagcaataaaacccaagcccaggtcaggtgcggtggctcaagcctgtaatctcagcactttgggaggctgaggcaggtggatcacctgaggtcaggagtttgagaccagcctgaccaacatggagaaaccccatgtctactaaaaatataaaattagtcgggtgtggtgttgcatgcctgtaatcccagctactcaggaggctgaagctggagaatcgcttgaacccaggagctggaggttgtggtgagccaagatcgcactattgcactccagtgtaggcaacaaaagcaaaactccatctcaaaaacaaaaaca

SEQ ID NO: 409076 - DNA, 774 bp, Homo sapiens
gggtcattgcttctaaagatatcctttacaatatacacagtggtctgactccaccagtggccactcatcaccttcatctgtaccttcataactgttccttccctcctcttacttagatgaattattcatactcttcctgttggaacccagccccacctcttaacactgaagctcatcctcttacctattcacagatagcatcggcagctccctccttcccttttccattagcatgtgatttctctcatcttaaaaaagaaattggcctcactctcctcttcagctgccactccatttctccactccctgtacagcaaaactcctctaactctgactgggcatgatcgctcacacctgtaatcccagcgctttaggaggccgaggtgagaggatcatttgaggccaggagtttgagacaagactggaaaacctaacaagaccttgtctctgtttaagtaaaagttttttaaaaaacaaaaatggccaggtgcggtggctcacacctgtaatcccagcactttgggaggctgaggcgggcagatcacgaggtcaggagtttgagaccagcctgaccaacatggagaaaccccatgtctactaaaaatataaaattagtcgggtgtggtgttgcatgcctgtaatcccagctactcaggaggctgaagctggagaatcgcttgaacccaggagctggaggttgtggtgagccaagatcgcactattgcactccagtgtaggcaacaaaagcaaaactccatctcaaaaacaaaaaca

SEQ ID NO: 409077 - DNA, 936 bp, Homo sapiens
  misc_feature (917)..(917): n is a, c, g, or t
tcccaaggacccagactgattatgagaacagcctcaccatgaagatgttcttattccagtttgtcaactactactcttcatgcttctacatagcattctttaagggcaaatttgtaggctatccaggagacccagtttattggttgggaaaatacagaaatgaagagtgtgacccaggtggctgtcttcttgaactgacaactcagctgacaataatcatgggaggaaaagcaatctggaataacatacaagaagtattattgccctggatcatgaatctaattgggcgatttcacagagtttctggatcagaaaagataaccccacgatgggaacaggactaccatctgcagcctatgggcaaactgggattattttatgaatatcttgaaatgattattcagtttgggttcgtcaccttatttgtggcctcttttccactggcccctctgttggctctcgtgaacaatatattggaaataagagtggacgcatggaaactgaccacccagtttagacgcctggtaccagagaaagcccaagacattggagcatggcagcccatcatgcaaggaatagcaattctggctgtggtgaccaatgccatgatcatagctttcacgtcggacatgatcccccgcctagtgtactactggtccttctccgtccctccctacggggaccacacttcctacaccatggaagggtacatcaacaacactctctccatcttcaaagtcgcagacttcaaaaacaaaagcaagggaaacccgtactctgacctgggtaaccataccacatgcaggtatcgtgatttccgatacccacctggacacccccaggagtataaacacaacatctactattggcatgtgattgcagccaagctggcttttatcattgtcatggagcacgtnatctaagatcctgtagagt

SEQ ID NO: 409078 - DNA, 249 bp, Homo sapiens
agaagtagcagagaagaaataaaagaaatcccctctcactctccaattctgttgttgcctccatgcgccaatccaaaccgaaagccagaaggaagaagagtgaggagtttgctacatcccagctccacatcactggaaatgggatttgaggcaaaactacctggtgtgtctggaagtgtctgtttctggaattccactcacaggggaaaattagcctgaaccagatggcttgaaacagtcctcatgggt

SEQ ID NO: 409079 - DNA, 204 bp, Homo sapiens
cagggtttcgccatgctggacaggctggtctcaaactcttggattcaagtgacccacctgcctcagcctcccaaagtgctgggattataggagtgagccaccatgcccagccaagcccgtttattttttaatgagagctgcacattgtatatagacagtttaatgtgatttgaggcctaaggatatctttctctaaagactttt

SEQ ID NO: 409080 - DNA, 562 bp, Homo sapiens
tgatcagtgacaaggtattgggatagtcattcagggagagagagtcagtgagggtgttagaggtagctgaaggagtggaagggagttagctagttgaaggaacactggaggactgtcggggatttgggggattaagtaaaaggtttataaggagagggtggaaagagtggttgatggctgatattctgatcatttatactagctactcagtctctactttttctagaagtccccagtaaccaaagcccaacacatttggtatcgttgattccttccattgtttgctttgctttgggttgcctaaggctgtggttatctctgagccacctaaattctcaccctcagctgaaatcactactgtctcttcatggctctcagtatatttcaatccttcttcaggaactggagcttttgagaataaggcaactttaggattgaccctaggacagaagctctgctctcaggatccttgtatgctcctgaatatgaattccatagtatgatatttggagctccccagatccttgtaggcatatgtgtgtgtgtgtatttgaggccaaaa

SEQ ID NO: 409081 - DNA, 305 bp, Homo sapiens
cttttggttgctagctcacatttacatactgtatgtcgaatctgaaaggaagctatgttcgaatagaaatggctctgctgagaagtgaatggtacagtatattttgtatagaaaaagcaattttcttgggaattaaaaggcctgttacgcagtccctgcccaaaaggctcaaaacaatcaccttttgtcattctgttttacacaagccaaattattcagctggcaaagtaaaaggggagggagataaaatacacggatgagggagattgtcatcccccaagaaacttggtagaacgcaaaggtct

SEQ ID NO: 409082 - DNA, 271 bp, Homo sapiens
ctcagctctgcatcaagtttgttgtttctatcttgtgctcacaagttctgttctgggaggcttttggggttagaccatcacaggtaaagacagaaggggaaatctacttttgcaccatttctaagatcaatttctaggcttgttttcagaacatttgccatccccctctgttctggtttgaataattgtcccctccaaaattcatgaagtttgattgtcattgtgatgatcttgagaggtggaacctttgagaggcgatgcagccacgagg

SEQ ID NO: 409083 - DNA, 210 bp, Homo sapiens
accaaataataataaggatggattactaccattgagagcaacaaaaattctgaaatttttaaagcaatgagagaataactttagtaagtataaatattccttgtaaaaaaaaacaagcttatatgaatatttaaatttttaagtttataaaaaagatctcttgatagtcatacttcatatgtttgccatctaagtggtttttcattataa

SEQ ID NO: 409084 - DNA, 624 bp, Homo sapiens
attgtctctagttgccaagccgtattttatacatacaagattatctatcagtcatactttcctagtttccttagcaggactttggtgtttccagatcttctcagtcatttttcactgtagtgactcgttgatttaatttattcacttaaaaattttgtttaatacattacagtttattctgtaatagatatttgtaataaattttctcaaccctaatattcattgttccatgagcattgtcaggttttggatggaagcaggatggccagcctgggtttgagaatcaaaagtgacccagcttctctgtccataaatctatacgtggctctgctggagcctctctgaacctatcctggttaagaggctgctcaatttgctaattgttctttgctcagtttcttaaaaaagttgactagcttcatttctgttaattcttccaagagtaccgtagagtacttgattttgtaatacactaagaactattattgtaaaaccctgagagatagtttatattggaaactaagccatttacacctaagtcactgaaatcaggttagaatgtttttctgacagaaaaaaaaaaaagtcgacgcggccgcgaatttagtagtagtgggcggccgc

SEQ ID NO: 409085 - DNA, 653 bp, Homo sapiens
attgtctctagttgccaagccgtattttatacatacaagattatctatcagtcatactttcctagtttccttagcaggactttggtgtttccagatcttctcagtcatttttcactgtagtgactcgttgatttaatttattcacttaaaaattttgtttaatacattacagtttattctgtaatagatatttgtaataaattttctcaaccctaatattcattgttccatgagcattgtcaggttttggatggaagcaggatggccagcctgggtttgagaatcaaaagtgacccagcttctctgtccataaatctatacgtggctctgctggagcctctctgaacctatcctggttaagaggctgctcaatttgctaattgttctttgctcagtttcttaaaaaagttgactagcttcatttctgttaattcttccaagagtaccgtagagtacttgattttgtaatacactaagaactattattgtaaaaccctgagagatagtttatattggaaactaagccatttacacctaagtcactgaaatcaggttagaatgtttttctgacagaaaaaaaaaaaaacaaaaacaaaaaaacacttttttatgtgtgtgtgagacagggtctcactctgtcacccaggctggag

SEQ ID NO: 409086 - DNA, 389 bp, Homo sapiens
gggattggtgcacttccagttgtacaaaggatagctgtattgtgttagatgtaattatgaccttattattggcttcagttgaagattatgtgtgatttcaggagatgtggatgggttcaagttgacaaagttgtgatggttaatattgagtgccaacttgattggattgaaggatgcaaagtattgttcctggatgtgtttgtgagggtgtttccaaaggagattaacatttgagtcagtggactgggagaggcagacccaccctcagcctgggtgggccctgtctaatcagctgccagtgtgaaaggaggcatggagagaacagacctgctgagtcttctggcctccatctttctcccatgctggaggcttcctgccctggaataaca

SEQ ID NO: 409087 - DNA, 382 bp, Homo sapiens
gggagagtccctggtaccccacatgattccgtatcaacccagtgaagcccacatttcaaagtcttggccttgtaggtgcctgactcccaaacgtcaatctctgaaacagatttttagttccatgtgagaaaaaaaactgaagtcagattgactcaggcacaaaaggggggagactgagttcacagaacttaaaacacccaagggtttcaggtatggcttgatctggggctccaaaggcatcttgggaaattgatcttccatccttggctctgctttaattagattctcccagttccaaatcccaccgtgcaatctcactggctagtttggcatcccagggcctccataaaccagttgctgtggcccagggaatggtggtctc

SEQ ID NO: 409088 - DNA, 328 bp, Homo sapiens
tgtgattgccgcccctgcactccagcctaggtgacagagttggaccctgtctcaaagaaaaagagaagaaaaagaaggtgacagctataagggatagagggtctaataaagtgggtgttttattttttggctgggacagaggctgatttataggcttagtttttttccctcctaagcatatgaagaaaaaccaatagaacgagtgatgtacatgtttgtggacgaataagttagaaacaggtttcctgtagaatgggccaggattaatacagttggaagtgtctaatttgcttctcctatctcagaatttcgaattaagaaatcatgg

SEQ ID NO: 409089 - DNA, 316 bp, Homo sapiens
gataaatgttcacaaaaactacacttggaagctttatttatttggcaaacattttttttctttgggaggctgaggtgggtgaatcacttgaggccaggagtttgagaactgcctggcaacatggcgaaaccctgtctctactaaaaatacaaaaattagtggggtgtggtggcacacgcctgtagtcccacctactcgggaggctgagccatgagagccgcttgaacctgggaggcggaggttgaagtgaatggagatcatgctactgcactccaacctgggggacagagcgagactgtgtctcagaaaaagacaa

SEQ ID NO: 409090 - DNA, 679 bp, Homo sapiens
agatcaagtaaccaccccgcacctgcagctgccaagctgggcacacagggcggcacccttctgggctgtccacctctacctcgaggctgatgctagtatgggtacagaagttgctatgtcttttctctcacacttgattttgtaagatggctagtagttacaaattaatttaaaaaatcattctgaaggcttcacaattatttgtcaaaaattgcttaagtataaaactcagaaaaaagctaggagttcaagaccagctgggcaacaaagtgagaccctgtctaggaagatagatagacagatgatagatagatagatagatagatagatagatagatagatagatagaaaaaaagatagatagatgatagaaagacaaagagagatgatagatagatgataggtagattagacagatagatgacagatagatagatagtggatagatgatagatgacagatcgatagatagatgataggtagatgataggtaggtagattagatagatgatgggtagatagatgacagacaatagatgatagatgataggtagatagatgatagatgacagatagatgatggatagattatataggtagatgataggtggatagatgatggatatatagattatatagattagatgattgatagatgataggtagatagatagatgat

SEQ ID NO: 409091 - DNA, 341 bp, Homo sapiens
ttccactcggagagcctacagctctctgccatctacccacctaagcttgggaatgtctttctctgcttgtgctctgtagccagctcacatgtcaccaggctgatgcacactcagctcagtggggctgcatttacctttcctagggattccccagcctgtggtgccctccccagtgtgggtagagaatagggtctgctgcctcctcttgcaggtatctcttctcggatgggaatgggcgcccccagctcccactggccacctttaagagatcagagggcaaccgggcactgtggctcatgcctgtaatctcagcactttgggaggccaaggtgggagaagcg

SEQ ID NO: 409092 - DNA, 307 bp, Homo sapiens
atccgaaagtcggggcctcgatgggtcattgcagaggagggcgggcatgcggttttctcctgctctggagatggagacccagcccccactgtctcctggatgaggcctcatggggcttggctgggcagggctgggagagtaagggtcctagaggatgggacactggagatccgctcagtgcagctacgggacagaggggcctatgtctgtgtggttagcaatgtcgctgggaatgactccctgaggacctggctggaagtcatccaggtggaaccaccaaacggcacactttctgaccccaacatca

SEQ ID NO: 409093 - DNA, 263 bp, Homo sapiens
ctcttttgatggtaaaaacacttaatagaagtacatctaaaaatcattcattgtctcagcatcctaagaaccagtcttcatttccccttgctgccttccagttcttatctatagcttttcctccatggcctgtgctgacctctgcacgtccctgttcctcctgccttgctgagtgttgttctttctgctcctcctgctaaggtttcccatctcccacagctgcagccttgtgtctcacccgccctgtgtctctcttcccaatt

SEQ ID NO: 409094 - DNA, 320 bp, Homo sapiens
gtccctatctgtaagatggaaatgaaaagagctgtcctgttgacctcacacaattcggcagcagggaggggtggctcagttggagggctttcaaatgatcagtgctctgcctgcacacagagggtttggtgcttcaagctgtaaccacatacccacatgtactatatgtccccaacttcatcaccaaagggggttgttcaccccttttacttgcatccatgtagagcaggtgaaaagatgacaagccaggtcccactatggaggaggagaagccccctgatggatgagtcatggaagggctgggatgtgaaatgaaggcc

SEQ ID NO: 409095 - DNA, 318 bp, Homo sapiens
ctcaaactcctgacctcaagtgatccacccaccttggcctcccaaagtgctaggattacaggtatgggccaccgcactcagcccaacatatgaatttgaggggaacataaacattcagtccacggcagtcagtgttcaaataggaagacccatgaccaatgtgatggattaggaagtctagagatggaaccgaatagatacaggaacttagatgtaaaggtggaatcttttattagtatgggaaaagatggactgatttaaaaaatagtgttgggacaactggttaaccatctagataaaaatataaatgaatctagt

SEQ ID NO: 409096 - DNA, 297 bp, Homo sapiens
ctggtgttggactgctgagtcatgctctgttgtcaggacagcaacagactttcccctgggtctgggctggcaagactggtgcttatgatgctgtcttatatttgcaataggcttttacagttttcaaagcccttttcatctgttgttccacagtcactacatgaggtcagctgggaagatatgaatgtatctttaaaagcatactgaagttcaaagaggttagaagactttcctgaaattatgtatctagtaaatggcagtactctgtactagtcagctattatggcaataatgctg

SEQ ID NO: 409097 - DNA, 288 bp, Homo sapiens
tgcatttaatggttttattaaacatgctttttttggtaacagatttatttaaacataattcacataccttaaaagtcacccacttaaactgtgcacacaactcgatggtttttagtgtattcataaagttgtgcaactatcaccacaatcaattttagaacattttcatcaccacaaaaagaaatccataccctttagcaatcatccccctgcagccccatcttcctatccctctagtctgagacaaccattaatctacttttgtctgtatagatttgcctatttcag

SEQ ID NO: 409098 - DNA, 235 bp, Homo sapiens
cttatttcatctccctgcgaggctcaggtcccaaactaagtgtgtgatccaggtggccaatcagagcactccatcctgcagcgacagtgattggtttgggaatgatcatgtgacccagtgttctgcgtgccccccgctcaactggcgttccagtgcccggcagctgacagccctgccctaacaggaaattaaggggctgacctggtgtgccttatatggaatccttctttcacct

SEQ ID NO: 409099 - DNA, 697 bp, Homo sapiens
cctgtaagaaaaaaaaaaaaaaaggctggggaacaagtacccacagagcaccctcagatagataggtagcccagcacccttaccctcaggtggtcctaccccttttccccaaggtccctggcaggcttgcaccatagctgcccaccgtagttacctgctcattgacagaccccacaggacttcctccctccctttccatctcccatttccctgtgagtgtttcctgggacgcctgccaggtgaactgtctgcatcaagtcctagcatcagggtcggcttcggagagcccagcctaggccaagtgagttcttctagtccacatcctcagtgtggcctcctgactagcagcagcatcacttaaaactggttagaaatgccgattctcaggccccgcctgctaaatcagattctgggatgcggccccgcgatctgtggctaagacctccaagtgacggatgcaaatgcaggttgcagttggaaaacgattggactgaaatcttaggagaaaccccagggagaggcagccacctgggggaggagacagactgaggtcggaggctcgcccccgctaggggtcccgggggtgcgtgatcatgaaccccagagggctgggctttgatttgagtgccgatccgttaatgaggacgggaggataaggttgccgacgcagcggaaggtaggggggaagcgactcgag

SEQ ID NO: 409100 - DNA, 498 bp, Homo sapiens
cctggcatgtattaagtgccgtgtaagtgtttcctaggattttgtgcctcactctcctggtttgcaaatggataatggtcgcgtgtatctccgtgttgttagaagatcacaggagctaagttgcttgctgtgtgtcgcttagggcctggtctgcagtcaaggttcattaaacaacacctgttcgtagcggccgttacctctgtatgcttctgcagcaggtgtttgttgagtatctgctttgttccagtatgtgcgtgcaagtgctgggtgcaggacatatagtgaaaaggtgacacagaagcttccccttcgcggtagctggaattcgtaggtaacacagagcagggtttctcatccttggccctagtgacactgtggacacagtcattccttgtagtgggggccgtcctgggtattgtaggatgtttaacatcatccttggcctctactcactagatgccggtagccccctcccaaaggtgtgacaaccaaaaatgt

SEQ ID NO: 409101 - DNA, 674 bp, Homo sapiens
tgaacaaggctgagaacgcagctgcactctcaggcccggcagcatttgggctctcttggcacaggattggagcagggtgagcctggcagagtgacaccccctggcatggtgccctgagacactcgggaggctcggggctgctccctgcactgtcctccactgtggagtttttctgacttgattggcagccccgttggctctgggtccttgggggacagcctgggctgggagagatgatcacagtggaggtgtttgttccctactgcactgatggctgcttcacccctcccttagctgtccaggtccagccctctcttgcccttagtgtggcaccaggccatggtggggagcatggatgtggagccagcggcctgggtgtgagtcctgctctgccacttactagccctgcaccctggcattttagcattccagacctcagcttcctcttgtgtgaaatggagatgctgacagtcacggtactgtgaggattaagtgaatgaatgtgcaaagtatccccagagcataggatagcacataccctccataggtatgtgctgtgattatgattgtccagcagagcccacctttaaacaagatacaatccttacaaatgccaagactgaggaggggttttcccaaaggatccactttgctacagtattgtgtgtttgttt

SEQ ID NO: 409102 - DNA, 390 bp, Homo sapiens
cttccaatagcctggctcattgctattctacaccagcccctctctgccctcaattcagcccctccactgcagtgtcagaattgagcctcaaaatgcagcctgctacagcctctgcaggggtctccatgcttccaagcctgcttgaaactttctttatggcaggcatggggaggggggagggcaggccgtgtgtggctgtcaccagacctggctgccttgggcctggctgctttgggccgagcctttgcatccctagtgggtcctcacggctgcccataaacccagcagggtaaaattcttcgttttgtcatactgagcagccagcatgcttaaccagcaggcagggaagggtctggcaagcccacctcccctgctgtgtgtgggatggag

SEQ ID NO: 409103 - DNA, 372 bp, Homo sapiens
cagttgtgttttaatgtatattaatgttactaatgtgttttcagttttattgatagtcttttcagtattattgataatcttgttatttttagtatgattctgtaaaaatgaattaatactaatttttcagatgtatcatctcttaaaatactgtaattgcaatttaataattgtattgaatgccatcaagtttttttaaaaagcttatgcagcattagaggaatttattttaatgcacatttatattcaacatagacattaattcagatttttacttgggataaaacaaattctagttttccctttgttttgaaattacttttaaaatatgtctttacagataaatataaaatatattaagcattttgaaca

SEQ ID NO: 409104 - DNA, 690 bp, Homo sapiens
ttcaacctacctcagatcaaaagtattcagggaaaaaaatgggtggttgtatctgtactgaacatgtacaggctttgttttgtcattaaacaatagagtataacaagtatttacatagtatttacattgtattaggtattataagtaacctagagatgattaaaatatgtgggaggatatgcttaggttatatgcaagtactataccattttatgtaaaagacttgaatatccatggatatttgtttctatggggggaatcctaggactaatctcccaccaataacgtagggacacctagggacaactgcattgggattcaggttgaaatagtgactgattttggtagctgcctaagcaagtgcgttgctcaaaacaccttttcccacttggggctggtctgttacaagcatatttagttaactagttccatcttacctgcgtttgatctgggagccatttagagggcaagcataaacttgggagtccatctctttcacattgtgttgaattggcataaaaatgaacaagtttttagaggtttagtttgtcgtgtagttatgagaggtttcacaggaaggtcggttatgtcacagtgttaaccttgagtcagtttagtaccttgcttttagaaaagtacaaactggtttgttcaaagggctctcagtctagttagtcagagttgggcagg

SEQ ID NO: 409105 - DNA, 1738 bp, Homo sapiens
acgcgcgcctgggtctcggcggggctgcgggaccgcgagtgagtgtggtcgctcctggttctgccagctcccctgagagcctgaacccgggcttgagagcctcgccaccccgggtgacatccctgccgtgggcttgggggctctgggtgtgattccgccggtccgggtcccgcagcgaccacctacccagcgcagtcaggggtggggctgggacccagagcgggaccccggctgccgagtccaggtgtcccgcgggcctcgatttggggagcagaaaacgccaggtcttcaagggtgtctgccaccaccatgcctgacccatttggcagcagcctcgtgtgtggtggtctggtgtggacggtggaagcgtgattctgctgagtgtcagtgtgaccactcgtgctcagccgtatctcagcaggaggacaggtgccggagcagctcgtgcagctaagcagccaactgcagaaacgtcaggcctgttgcagtctccaaggcaccatgaatgccatcgtggctctctgccacttctgcgagctccacggcccccgcactctcttctgcacggaggtgctgcacgccccacttcctcaaggggatgggaatgaggacagtcctggccagggtgagcaggcggaagaagaggaaggtggcattcagatgaacagtcggatgcgtgcgcacagccccgcagagggggccagcgtcgagtccagcagcccggggcccaaaaagtcggacatgtgcgagggctgccggtcacttgctgcagggcacccgggatatatcagccatgataaagagacctccattaaatacgtcagccaccagcaccccagccacccccagctcttcagcattgtccgccaggcctgtgtccggagcctgagctgtgaggtctgccctggccgtgaaggccccatcttcttcggagatgagcagcacggctttgtgttcagccacaccttcttcatcaaggacagcctggccaggggcttccagcgctggtacagcatcatcaccatcatgatggaccggatctacctcatcaactcctggcccttcctgctggggaaggtccggggaatcatcgatgagctccagggcaaggcgctcaaggtgtttgaggcagagcagtttggatgcccacagcgtgctcagaggatgaacacagccttcacgccattcctacaccagaggaacggcaacgccgcccgctcgctgacatcgctgacaagtgatgacaacctgtgggcgtgcctgcacacctcctttgcctggctcctgaaggcgtgtggcagccggctgaccgagaagctcctggaaggtgctccgaccgaggataccttggtccagatggagaagctcgctggtgaggcaggggtgctgttgccggggccttggcccggatggccgtggggcggtaccagctgtctgctctcctggcaggaatcgctgagggagggaaacgcggctctgaatcagcccagaacgagccttcgggaagctcaccctccgatctcggtgtgattgttgtgattgttgtgatttcctgtctcgtttgccttgaccgccatgtgaaagaatctgttccccagctaggtggggaaaattcacaggtgggctgtctgtagagagaactggctgattaaaggcttctcgtcccgattttgtgatagccaagtgcttggcctggtcgacggtctttgctcctttacaaataaagtgttctgtttca

SEQ ID NO: 409106 - DNA, 1379 bp, Homo sapiens
acgcgcgcctgggtctcggcggggctgcgggaccgcgagtgagtgtggtcgctcctggttctgccagctcccctgagagcctgaacccgggcttgagagcctcgccaccccgggtgacatccctgccgtgggcttgggggctctgggtgtgattccgccggtccgggtcccgcagcgaccacctacccagcgcagtcaggggtggggctgggacccagagcgggaccccggctgccgagtccaggtgtcccgcgggcctcgatttggggagcaggcggaagaagaggaaggtggcattcagatgaacagtcggatgcgtgcgcacagccccgcagagggggccagcgtcgagtccagcagcccggggcccaaaaagtcggacatgtgcgagggctgccggtcacttgctgcagggcacccgggatatatcagccatgataaagagacctccattaaatacgtcagccaccagcaccccagccacccccagctcttcagcattgtccgccaggcctgtgtccggagcctgagctgtgaggtctgccctggccgtgaaggccccatcttcttcggagatgagcagcacggctttgtgttcagccacaccttcttcatcaaggacagcctggccaggggcttccagcgctggtacagcatcatcaccatcatgatggaccggatctacctcatcaactcctggcccttcctgctggggaaggtccggggaatcatcgatgagctccagggcaaggcgctcaaggtgtttgaggcagagcagtttggatgcccacagcgtgctcagaggatgaacacagccttcacgccattcctacaccagaggaacggcaacgccgcccgctcgctgacatcgctgacaagtgatgacaacctgtgggcgtgcctgcacacctcctttgcctggctcctgaaggcgtgtggcagccggctgaccgagaagctcctggaaggtgctccgaccgaggataccttggtccagatggagaagctcgctggtgaggcaggggtgctgttgccggggccttggcccggatggccgtggggcggtaccagctgtctgctctcctggcaggaatcgctgagggagggaaacgcggctctgaatcagcccagaacgagccttcgggaagctcaccctccgatctcggtgtgattgttgtgattgttgtgatttcctgtctcgtttgccttgaccgccatgtgaaagaatctgttccccagctaggtggggaaaattcacaggtgggctgtctgtagagagaactggctgattaaaggcttctcgtcccgattttgtgatagccaagtgcttggcctggtcgacggtctttgctcctttacaaataaagtgttctgtttca

SEQ ID NO: 409107 - DNA, 1649 bp, Homo sapiens
acgcgcgcctgggtctcggcggggctgcgggaccgcgagtgagtgtggtcgctcctggttctgccagctcccctgagagcctgaacccgggcttgagagcctcgccaccccgggtgacatccctgccgtgggcttgggggctctgggtgtgattccgccggtccgggtcccgcagcgaccacctacccagcgcagtcaggggtggggctgggacccagagcgggaccccggctgccgagtccaggtgtcccgcgggcctcgatttggggagcagaaaacgccaggtcttcaagggtgtctgccaccaccatgcctgacccatttggcagcagcctcgtgtgtggtggtctggtgtggacggtggaagcgtgattctgctgagtgtcaggcctgttgcagtctccaaggcaccatgaatgccatcgtggctctctgccacttctgcgagctccacggcccccgcactctcttctgcacggaggtgctgcacgccccacttcctcaaggggatgggaatgaggacagtcctggccagggtgagcaggcggaagaagaggaaggtggcattcagatgaacagtcggatgcgtgcgcacagccccgcagagggggccagcgtcgagtccagcagcccggggcccaaaaagtcggacatgtgcgagggctgccggtcacttgctgcagggcacccgggatatatcagccatgataaagagacctccattaaatacgtcagccaccagcaccccagccacccccagctcttcagcattgtccgccaggcctgtgtccggagcctgagctgtgaggtctgccctggccgtgaaggccccatcttcttcggagatgagcagcacggctttgtgttcagccacaccttcttcatcaaggacagcctggccaggggcttccagcgctggtacagcatcatcaccatcatgatggaccggatctacctcatcaactcctggcccttcctgctggggaaggtccggggaatcatcgatgagctccagggcaaggcgctcaaggtgtttgaggcagagcagtttggatgcccacagcgtgctcagaggatgaacacagccttcacgccattcctacaccagaggaacggcaacgccgcccgctcgctgacatcgctgacaagtgatgacaacctgtgggcgtgcctgcacacctcctttgcctggctcctgaaggcgtgtggcagccggctgaccgagaagctcctggaaggtgctccgaccgaggataccttggtccagatggagaagctcgctggtgaggcaggggtgctgttgccggggccttggcccggatggccgtggggcggtaccagctgtctgctctcctggcaggaatcgctgagggagggaaacgcggctctgaatcagcccagaacgagccttcgggaagctcaccctccgatctcggtgtgattgttgtgattgttgtgatttcctgtctcgtttgccttgaccgccatgtgaaagaatctgttccccagctaggtggggaaaattcacaggtgggctgtctgtagagagaactggctgattaaaggcttctcgtcccgattttgtgatagccaagtgcttggcctggtcgacggtctttgctcctttacaaataaagtgttctgtttca

SEQ ID NO: 409108 - DNA, 1291 bp, Homo sapiens
acgcgcgcctgggtctcggcggggctgcgggaccgcgagtgagtgtggtcgctcctggttctgccagctcccctgagagcctgaacccgggcttgagagcctcgccaccccgggtgacatccctgccgtgggcttgggggctctgggtgtgattccgccggtccgggtcccgcagcgaccacctacccagcgcagtcaggggtggggctgggacccagagcgggaccccggctgccgagtccaggtgtcccgcgggcctcgatttggggagcagaaaacgccaggtcttcaagggtgtctgccaccaccatgcctgacccatttggcagcagcctcgtgtgtggtggtctggtgtggacggtggaagcgtgattctgctgagtgtcagtgtgaccactcgtgctcagccgtatctcagcaggaggacaggtgccggagcagctcgtgcagctaagcagccaactgcagaaacgtcaggcctgttgcagtctccaaggcaccatgaatgccatcgtggctctctgccacttctgcgagctccacggcccccgcactctcttctgcacggaggtgctgcacgccccacttcctcaaggggatgggaatgaggacagtcctggccagggtgagcaggcggaagaagaggaaggtggcattcagatgaacagtcggatgcgtgcgcacagccccgcagagggggccagcgtcgagtccagcagcccggggcccaaaaagtcggacatgtgcgagggctgccggtcacttgctgcagggcacccgggatatatcagccatgataaagagacctccattaaatacgtcagccaccagcaccccagccacccccagctcttcagcattgtccgccaggcctgtgtccggagcctgagctgtgaggtgagccttgtggccacagagcctgtctctgtgggagcccacatgctcccaggtgctctgggtgggctcggagccagcattgcacagggaggcaggcactggtcctctctcagggcggacccgcagatcagcacagcacagggtacaggacgcctcccttgtccagaattgcgggaggagtcatgttggacttgctgagcattttctgattgagtgctagcttttgcactttaagcaccgaacttttattatttgtcctttctttattattattggtttcttttttccttcttttgtgtcagggtctcgctctgtcgtccagactggagtgcagtgggccaggatcacaccactgcattccagcctgggtgacaagagcgagactccatctcaa

SEQ ID NO: 409109 - DNA, 1158 bp, Homo sapiens
acgcgcgcctgggtctcggcggggctgcgggaccgcgagtgagtgtggtcgctcctggttctgccagctcccctgagagcctgaacccgggcttgagagcctcgccaccccgggtgacatccctgccgtgggcttgggggctctgggtgtgattccgccggtccgggtcccgcagcgaccacctacccagcgcagtcaggggtggggctgggacccagagcgggaccccggctgccgagtccaggtgtcccgcgggcctcgatttggggagcagaaaacgccaggtcttcaagggtgtctgccaccaccatgcctgacccatttggcagcagcctcgtgtgtggtggtctggtgtggacggtggaagcgtgattctgctgagtgtcagtgtgaccactcgtgctcagccgtatctcagcaggaggacaggtgccggagcagctcgtgcagctaagcagccaactgcagaaacgtcaggcctgttgcagtctccaaggcaccatgaatgccatcgtggctctctgccacttctgcgagctccacggcccccgcactctcttctgcacggaggtgctgcacgccccacttcctcaaggggatgggaatgaggacagtcctggccagggtgagcaggcggaagaagaggaaggtggcattcagatgaacagtcggatgcgtgcgcacagccccgcagagggggccagcgtcgagtccagcagcccggggcccaaaaagtcggacatgtgcgagggctgccggtcacttgctgcagggcacccgggatatatcagccatgataaagagacctccattaaatacgtcagccaccagcaccccagccacccccagctcttcagcattgtccgccaggcctgtgtccggagcctgagctgtgaggtctgccctggccgtgaaggccccatcttcttcggagatgagcagcacggctttgtgttcagccacaccttcttcatcaaggacagcctggccaggggcttccagcgctggtacagcatcatcaccatcatgatggaccggatctacctcatcaactcctggcccttcctgctggggaaggtccggggaatcatcgatgagctccagggcaaggcgctcaagatgattcccggacttcccagcagaagggcaggagttgat

SEQ ID NO: 409110 - DNA, 780 bp, Homo sapiens
ggaatgattggactggtggcactttgtgtgctctgcatggagagagtatagtgggactgatcctccaggagtcaggtcctggagttggctgtgaacgagtaggggtccgagctgctggcagctttggcttaaagaggccatcccttccctttgcatttcaggtgtttgaggcagagcagtttggatgcccacagcgtgctcagaggatgaacacagccttcacgccattcctacaccagaggaacggcaacgccgcccgctcgctgacatcgctgacaagtgatgacaacctgtgggcgtgcctgcacacctcctttgcctggctcctgaaggcgtgtggcagccggctgaccgagaagctcctggaaggtgctccgaccgaggataccttggtccagatggagaagctcgctggtgaggcaggggtgctgttgccggggccttggcccggatggccgtggggcggtaccagctgtctgctctcctggcaggaatcgctgagggagggaaacgcggctctgaatcagcccagaacgagccttcgggaagctcaccctccgatctcggtgtgattgttgtgattgttgtgatttcctgtctcgtttgccttgaccgccatgtgaaagaatctgttccccagctaggtggggaaaattcacaggtgggctgtctgtagagagaactggctgattaaaggcttctcgtcccgattttgtgatagccaagtgcttggcctggtcgacggtctttgctcctttacaaataaagtgttctgtttca

SEQ ID NO: 409111 - DNA, 1181 bp, Homo sapiens
acgcgcgcctgggtctcggcggggctgcgggaccgcgagtgagtgtggtcgctcctggttctgccagctcccctgagagcctgaacccgggcttgagagcctcgccaccccgggtgacatccctgccgtgggcttgggggctctgggtgtgattccgccggtccgggtcccgcagcgaccacctacccagcgcagtcaggggtggggctgggacccagagcgggaccccggctgccgagtccaggtgtcccgcgggcctcgatttggggagcagaaaacgccaggtcttcaagggtgtctgccaccaccatgcctgacccatttggcagcagcctcgtgtgtggtggtctggtgtggacggtggaagcgtgattctgctgagtgtcagtgtgaccactcgtgctcagccgtatctcagcaggaggacaggtgccggagcagctcgtgcagctaagcagccaactgcagaaacgtcaggcctgttgcagtctccaaggcaccatgaatgccatcgtggctctctgccacttctgcgagctccacggcccccgcactcttctcctggcaggaatcgctgagggagggaaacgcggctctgaatcagcccagaacgagccttcgggaagctcaccctccgatctcggtgtgattgttgtgattgttgtgatttcctgtctcgtttgccttgaccgccatgtgaaagaatctgttccccagctaggtggggaaaattcacaggtgggctgtctgtagagagaactggctgattaaaggcttctcgtcccgattttgtgatagccaagtgcttggcctggtcgacggtctttgctcctttacaaataaagtgttctgtttcaaaaaaaaaaaaaaaaaaaaaaaaaactccggggcttttttggggggggggacaaagagggttttgaaagggcagggtcatagagcgtttcccgaacccattttcttgttcccaggggggaatcgccggccccccaaggggaggcaataatagaaaacccggtacgtagcttccgtcaccgagaaacgcaaacgaaaacccgctctgaacaccgcacaacccattctacacacacgctcaggaaccgacacacaaccaaccaacgcacccacaacagcaaactaacaacgtcaccacacgaaacgcagcacgggcgcgccaccgc

SEQ ID NO: 409112 - DNA, 888 bp, Homo sapiens
  misc_feature (765)..(765): n is a, c, g, or t
  misc_feature (781)..(782): n is a, c, g, or t
  misc_feature (789)..(789): n is a, c, g, or t
  misc_feature (792)..(792): n is a, c, g, or t
  misc_feature (812)..(812): n is a, c, g, or t
  misc_feature (815)..(816): n is a, c, g, or t
  misc_feature (825)..(825): n is a, c, g, or t
acgcgcgcctgggtctcggcggggctgcgggaccgcgagtgagtgtggtcgctcctggttctgccagctcccctgagagcctgaacccgggcttgagagcctcgccaccccgggtgacatccctgccgtgggcttgggggctctgggtgtgattccgccggtccgggtcccgcagcgaccacctacccagcgcagtcaggggtggggctgggacccagagcgggaccccggctgccgagtccaggtgtcccgcgggcctcgatttggggagcaggcggaagaagaggaaggtggcattcagatgaacagtcggatgcgtgcgcacagccccgcagagggggccagcgtcgagtccagcagcccggggcccaaaaagtcggacatgtgcgagggctgccggtcacttgctgcagggcacccgggatatatcagccatgataaagagacctccattaaatacgtcagccaccagcaccccagccacccccagctcttcagcattgtccgccaggcctgtgtccggagcctgagctgtgaggtctgccctggccgtgaaggccccatcttcttcggagatgagcagcacggctttgtgttcagccacaccttcttcatcaaggacagcctggccaggggcttccagcgctggtacagcatcatcaccatcatgatggaccggatctacctcatcaactcctggcccttcctgctggggaaggtccggggaatcatcgatgagctccagggcaaggcgctcaaggttgnggaagagttggtgccnngggtcanggntgaaaaggttagcatctaancanngaaggaagngcgtgtgaatgtgcaggtgaactgggggtggccttgggtgtgaggggggggggaatgaggggg

SEQ ID NO: 409113 - DNA, 1715 bp, Homo sapiens
acgcgcgcctgggtctcggcggggctgcgggaccgcgagtgagtgtggtcgctcctggttctgccagctcccctgagagcctgaacccgggcttgagagcctcgccaccccgggtgacatccctgccgtgggcttgggggctctgggtgtgattccgccggtccgggtcccgcagcgaccacctacccagcgcagtcaggggtggggctgggacccagagcgggaccccggctgccgagtccaggtgtcccgcgggcctcgatttggggagcagaaaacgccaggtcttcaagggtgtctgccaccaccatgcctgacccatttggcagcagcctcgtgtgtggtggtctggtgtggacggtggaagcgtgattctgctgagtgtcagtgtgaccactcgtgctcagccgtatctcagcaggaggacaggtgccggagcagctcgtgcagctaagcagccaactgcagaaacgtcaggcctgttgcagtctccaaggcaccatgaatgccatcgtggctctctgccacttctgcgagctccacggcccccgcactctcttctgcacggaggtgctgcacgccccacttcctcaaggggatgggaatgaggacagtcctggccagggtgagcaggcggaagaagaggaaggtggcattcagatgaacagtcggatgcgtgcgcacagccccgcagagggggccagcgtcgagtccagcagcccggggcccaaaaagtcggacatgtgcgagggctgccggtcacttgctgcagggcacccgggatatatcagccatgataaagagacctccattaaatacgtcagccaccagcaccccagccacccccagctcttcagcattgtccgccaggcctgtgtccggagcctgagctgtgaggtctgccctggccgtgaaggccccatcttcttcggagatgagcagcacggctttgtgttcagccacaccttcttcatcaaggacagcctggccaggggcttccagcgctggtacagcatcatcaccatcatgatggaccggatctacctcatcaactcctggcccttcctgctggggaaggtccggggaatcatcgatgagctccagggcaaggcgctcaaggtgtttgaggcagagcagtttggatgcccacagcgtgctcagaggatgaacacagccttcacgccattcctacaccagaggaacggcaacgccgcccgctcgctgacatcgctgacaagtgatgacaacctgtgggcgtgcctgcacacctcctttgcctggctcctgaaggcgtgtggcagccggctgaccgagaagctcctggaaggtgctccgaccgaggataccttggtccagatggagaagctcgctggtgaggcaggggtgctgttgccggggccttggcccggatggccgtggggcggtaccagctgtctgctctcctggcaggaatcgctgagggagggaaacgcggctctgaatcagcccagaacgagccttcgggaagctcaccctccgatctcggtgtgattgttgtgattgttgtgatttcctgtctcgtttgccttgaccgccatgtgaaagaatctgttcccctcctgttgggagcccccgtcgcctctctgttacaagagaacggctgattagcggctccgttccccaaatcctagtaaacattagacttttcctagtcccttccactctcccattaatta

SEQ ID NO: 409114 - DNA, 1938 bp, Homo sapiens
acgcgcgcctgggtctcggcggggctgcgggaccgcgagtgagtgtggtcgctcctggttctgccagctcccctgagagcctgaacccgggcttgagagcctcgccaccccgggtgacatccctgccgtgggcttgggggctctgggtgtgattccgccggtccgggtcccgcagcgaccacctacccagcgcagtcaggggtggggctgggacccagagcgggaccccggctgccgagtccaggtgtcccgcgggcctcgatttggggagcagaaaacgccaggtcttcaagggtgtctgccaccaccatgcctgacccatttggcagcagcctcgtgtgtggtggtctggtgtggacggtggaagcgtgattctgctgagtgtcagtgtgaccactcgtgctcagccgtatctcagcaggaggacaggtgccggagcagctcgtgcagctaagcagccaactgcagaaacgtcaggcctgttgcagtctccaaggcaccatgaatgccatcgtggctctctgccacttctgcgagctccacggcccccgcactctcttctgcacggaggtgctgcacgccccacttcctcaaggggatgggaatgaggacagtcctggccagggtgagcaggcggaagaagaggaaggtggcattcagatgaacagtcggatgcgtgcgcacagccccgcagagggggccagcgtcgagtccagcagcccggggcccaaaaagtcggacatgtgcgagggctgccggtcacttgctgcagggcacccgggatatatcagccatgataaagagacctccattaaatacgtcagccaccagcaccccagccacccccagctcttcagcattgtccgccaggcctgtgtccggagcctgagctgtgaggtctgccctggccgtgaaggccccatcttcttcggagatgagcagcacggctttgtgttcagccacaccttcttcatcaaggacagcctggccaggggcttccagcgctggtacagcatcatcaccatcatgatggaccggatctacctcatcaactcctggcccttcctgctggggaaggtccggggaatcatcgatgagctccagggcaaggcgctcaaggtgaattcagagatgaggtgccggggcggcagggggccctgcactgcatgagccgctctgtgctgaggttgaggcctggagaccgcgtggcgtcttcccctctgcttacagccagtgcactgtgtgaattgtagtctcttggcttcagagctggaggtcgtgaggagcctcccaggccatcccgcctgctttgctggtctctcttgtgcccgttgtcctggttctcgctcagctctggtttctttgctgcagtcagacccctggtgtctttgtttcctctggccttcatctcagggatgtctgttaatcccattgagttgcaccaccgaatgtaggcctccagctgtggagatgcagctcaggccaggccaggccaggtcgtgctctggtaacagcctcggatctcagcaccttcaagccatagggcctgtttcttactcatgatgtgtgcattgcaggagagtggggctctgcttgctgtggtcgtcctggcaggcaggcagagcggcagccatatgaaaatgcttcccctaggctgggcgcagtggctcacgcctgtaatcccagcactttgggaggccaaggcgggcagatcacctgaggtcgggagtttgagaccagcttgaccaacatggagaaaccccgtctcttccagaaatacaaaattagctgggcatggtggtgcatgcctgtaatcccagctacttgggaggctgaggcaggagaaacgcttgaacccatgaggcagaggttgtagtgagccgagatcacaccattgcactccagcctgggcgacagagtgagactccatctcaaaaa

SEQ ID NO: 409115 - DNA, 1163 bp, Homo sapiens
acgcgcgcctgggtctcggcggggctgcgggaccgcgagtgagtgtggtcgctcctggttctgccagctcccctgagagcctgaacccgggcttgagagcctcgccaccccgggtgacatccctgccgtgggcttgggggctctgggtgtgattccgccggtccgggtcccgcagcgaccacctacccagcgcagtcaggggtggggctgggacccagagcgggaccccggctgccgagtccaggtgtcccgcgggcctcgatttggggagcagaaaacgccaggtcttcaagggtgtctgccaccaccatgcctgacccatttggcagcagcctcgtgtgtggtggtctggtgtggacggtggaagcgtgattctgctgagtgtcagtgtgaccactcgtgctcagccgtatctcagcaggaggacaggtgccggagcagctcgtgcagctaagcagccaactgcagaaacgtcaggcctgttgcagtctccaaggcaccatgaatgccatcgtggctctctgccacttctgcgagctccacggcccccgcactctcttctgcacggaggtgctgcacgccccacttcctcaaggggatgggaatgaggacagtcctggccagggtgagcaggcggaagaagaggaaggtggcattcagatgaacagtcggatgcgtgcgcacagccccgcagagggggccagcgtcgagtccagcagcccggggcccaaaaagtcggacatgtgcgagggctgccggtcacttgctgcagggcacccgggatatatcagccatgataaagagacctccattaaatacgtcagccaccagcaccccagccacccccagctcttcagcattgtccgccaggcctgtgtccggagcctgagctgtgaggtgagccttgtggccacagagcctgtctctgtgggagcccacatgctcccaggtgctctgggtgggctcggagccagcattgcacagggaggcaggcactggtcctctctcagggcggacccgcagatcagcacagcacagggtacaggacgcctcccttgtccagaattgcgggaggagtcatgttggacttgctgagcattttctgattgagtgctagcttttgcatccagcctgggcgacagagtgagactccatctcaaaaa

SEQ ID NO: 409116 - DNA, 359 bp, Homo sapiens
tgtgaccactcgtgctcagccgtatctcagcaggaggacaggtgccggagcagctcgtgcagctaagcagccaactgcagaaacgtcaggtgggtggtgcattcgcaggcatgctgaagaagcagttccaggcatgggccgccggcagagaggctggctgcagcaccccccaccaccatgcacatcgtgctttgcttcttcctagagttagcggctttggcaggccatgccttgtttgtgttcacagcctgcctgtcaggagcgaagacagaacgtctgacttttggatccgtaacaggggtgggggctccccagaagagaagaggctttgggtcctggccagtgtccactactcagtc

SEQ ID NO: 409117 - DNA, 342 bp, Homo sapiens
tccagaactgtgagagaatatgtcgtgttaagccactcagggtggggtactttgttatggcacccctgggaaactgatacaactgctatgctatgggggtctctcaacaacccaacccttagggagtttacactcttggaggggtggacaatcatcacgagcctcatgagattcacaaaagaccctttcagtgccacgcttgcagggtgcaagttttatgcatatggtggccaccttccctgctggaagggtcaggactcagaaaagcagcacctttagaagatctttactattggggttttattatagggatttggccttttgcagtcgtaagagctggtt

SEQ ID NO: 409118 - DNA, 270 bp, Homo sapiens
ctcttaggggaggtgggcagaaccggggcatttgagttggaccttgaagaaggagtacaaattggcagtggccgtaaatggcattctaggctgaggggatggttaaccaaaggttgggaggggtgaaatagaacaagtcttctaggaactatacccagcctgagagccaggaggagagggtgctggtggagaaggcagggtggatggaggaattggcagatatgagatgaacaaagtaggttggatgcaaaacaccctggagacccaagg

SEQ ID NO: 409119 - DNA, 513 bp, Homo sapiens
ggcctgcgggtccagacgctgatcaggcctgatctgggctgagtcactttgcctctctgggctctcctgtccccgctgtgaagtgtatgtagaccctcctcttcctcatagggttattgtgaagatcagagtgtctggaaaaccctggaagggcggctggaggtatcagtcccccctgcccgttctctgggcctccattgccacattcatgaaattagaaaagctcgacctgaaaactccttctggccgggcatgggggctcacacctgtaatcccagcactggcaggctgaggccagtggatcatttgaggtcaggagttcaagaccagcctggccaacatggtgaaaccccatctccactaaaaatacaaaaattagctgggtggtagtggcacgcgactgtaatcccagctactcaggaggctgagacaggagaatcgcttgagcctgggaggtggtggttgtggtgagccgagattgtaccactacactccagtctgggcgacagtctc

SEQ ID NO: 409120 - DNA, 357 bp, Homo sapiens
tcttcaagttcagagggatttttatcttttcatatcatagtaggagaattaataaaaatgtttcatttttaagcattttttaattattcaggcaacagaataagtgttctgcatatattgtttcatttaattctttagttccaggaggtaggtgaagacatctctatgttgtagttaataaactaagggtctgtaattttaagagatttacccagaaatcacataagtcttaggtgttggagttaaaatttgaacctgagtttgtttgattctaaaacttgtgctccatgaagaagttactggctttatctattctctctctctctcttgttcttggtcactgactatcagtattta

SEQ ID NO: 409121 - DNA, 294 bp, Homo sapiens
attttttgaaccttgaaaacaaattagaattcaatttcctccatgtcacttttgcaagaatattcaagtgttttttgagtcatgataatattgatcaattatgaacactttagaatgggagaaaattaacaattatgtgtctttctcagtgagacccatcatctgatattctcacgattttgacaatgatggactgttgtcaaactctcattcattaaccctactcctactttctgggacacacagtagtagactgaggttcttcaaatatttgaagtccgtatctccatttcc

SEQ ID NO: 409122 - DNA, 1980 bp, Homo sapiens
  misc_feature (1)..(1): n is a, c, g, or t
  misc_feature (3)..(4): n is a, c, g, or t
ncnngggggcatttctgcattcgaagaagaatctgagagaaacctgacgcagggagcatgggtatctggacctcaggcactgatatcttcctaagtctttgggagatttacgtgtctccaagaagccccggatggatggactttatccagcatttgggagtttgctgtttggttgctcttatttcagtgggcctcctgtctgtggccgcctgctggtttctgccatcaatcatagcggccgctgcctcctggattatcacgtgtgttctgctgtgttgctccaagcatgcacgatgttttattcttcttgtctttctctcttgtggcctgcgtgaaggcaggaatgctttgattgcagctggcacagggatcgtcatcttgggacacgtagaaaatatttttcacaactttaaaggtctcctagatggtatgacttgcaacctaagggcaaagagcttttccatacattttccacttttgaaaaaatatattgaggcaattcagtggatttatggccttgccactccactaagtgtatttgatgaccttgtttcttggaaccagaccctggcagtctctcttttcagtcccagccatgtcctggaggcacagctaaatgacagcaaaggggaagtcctgagcgtcttgtaccagatggcaacaaccacagaggtgttgtcctccctgggtcagaagctacttgcctttgcagggctttcgctcgtcctgcttggcactggcctcttcatgaagcgatttttgggcccttgtggttggaagtatgaaaacatctacatcaccagacaatttgttcagtttgatgaaagggagagacatcaacagaggccctgtgtgctcccgctgaataaggaggaaaggaggaagtatgtcatcatcccgactttctggccgactcctaaagaaaggaaaaacctggggctgtttttcctccccatacttatccatctctgcatctgggtgctgtttgcagctgtagattatctgctgtatcggctcattttctcagtgagcaagcagtttcaaagcttgccagggtttgaggttcacttgaaactgcacggagagaaacaaggaactcaagatattatccatgattcttcctttaatatatctgtgtttgaacccaactgtatcccaaaaccaaaattccttctatctgagacctgggttcctctcagtgttattcttttgatattagtgatgctgggactgttgtcctctatccttatgcaacttaaaatcctggtgtcagcatctttctaccccagcgtggagaggaagcgcatccaatatctgcatgcaaagctgcttaaaaaaagatcaaagcagccgctgggagaagtcaaaagacggctgagtctctatcttacaaagattcatttctggcttccagtcctgaaaatgattaggaagaagcaaatggacatggcaagtgcagacaagtcatgagagaccccgactactcctcagccacatcgcaccaacaattctcttcaggtctaggatggcagtcactattcatgccggataatagagaactatgtgacgcagtcctctcaggagtctgagtttacagagccaacttgcagcacctggttatgcctcctttcatctcaaagccaaagagctgccaggtaaatggttatgtggtctatgttccaaacaaaccacatgatcttgcctgtgtcacaatgtaacaagactctagctgggtcccctggtgatgagtttcagcatagaataatgttcaaggaaaagaaaacgaaaacagtttaaatctctaccacagcctcacaagcaaatgctaaggggaacatacatgtaaaaagccagcaaactatcttcaaactcttccgtccttaatgtcttccatggctattgcccccacaatggtctcttttctccctgctcccttattaaagaactctttctgaaaccctttttttttttttttttttt

SEQ ID NO: 409123 - DNA, 2123 bp, Homo sapiens
  misc_feature (3)..(3): n is a, c, g, or t
cgncacgaggcgaagaagaatctgagagaaacctgctgctttcacagaggaaggcatttgctggctttcccaaggcaagaacaatgaaaacaaagtcatgaggagttctctctacctcaaatgaaggccgcagctcctgctcaagctattttggcagtctgagagaacagtacattctgaaccacattgacgcagggagcatgggtatctggacctcaggcactgatatcttcctaagtctttgggagatttacgtgtctccaagaagccccggatggatggactttatccagcatttgggagtttgctgtttggttgctcttatttcagtgggcctcctgtctgtggccgcctgctggtttctgccatcaatcatagcggccgctgcctcctggattatcacgtgtgttctgctgtgttgctccaagcatgcacgatgttttattcttcttgtctttctctcttgtggcctgcgtgaaggcaggaatgctttgattgcagctggcacagggatcgtcatcttgggacacgtagaaaatatttttcacaactttaaaggtctcctagatggtatgacttgcaacctaagggcaaagagcttttccatacattttccacttttgaaaaaatatattgaggcaattcagtggatttatggccttgccactccactaagtgtatttgatgaccttgtttcttggaaccagaccctggcagtctctcttttcagtcccagccatgtcctggaggcacagctaaatgacagcaaaggggaagtcctgagcgtcttgtaccagatggcaacaaccacagaggtgttgtcctccctgggtcagaagctacttgcctttgcagggctttcgctcgtcctgcttggcactggcctcttcatgaagcgatttttgggcccttgtggttggaagtatgaaaacatctacatcaccagacaatttgttcagtttgatgaaagggagagacatcaacagaggccctgtgtgctcccgctgaataaggaggaaaggaggaagtatgtcatcatcccgactttctggccgactcctaaagaaaggaaaaacctggggctgtttttcctccccatacttatccatctctgcatctgggtgctgtttgcagctgtagattatctgctgtatcggctcattttctcagtgagcaagcagtttcaaagcttgccagggtttgaggttcacttgaaactgcacggagagaaacaaggaactcaagatattatccatgattcttcctttaatatatctgtgtttgaacccaactgtatcccaaaaccaaaattccttctatctgagacctgggttcctctcagtgttattcttttgatattagtgatgctgggactgttgtcctctatccttatgcaacttaaaatcctggtgtcagcatctttctaccccagcgtggagaggaagcgcatccaatatctgcatgcaaagctgcttaaaaaaagatcaaagcagccgctgggagaagtcaaaagacggctgagtctctatcttacaaagattcatttctggcttccagtcctgaaaatgattaggaagaagcaaatggacatggcaagtgcagacaagtcatgagagaccccgactactcctcagccacatcgcaccaacaattctcttcaggtctaggatggcagtcactattcatgccggataatagagaactatgtgacgcagtcctctcaggagtctgagtttacagagccaacttgcagcacctggttatgcctcctttcatctcaaagccaaagagctgccaggtaaatggttatgtggtctatgttccaaacaaaccacatgatcttgcctgtgtcacaatgtaacaagactctagctgggtcccctggtgatgagtttcagcatagaataatgttcaaggaaaagaaaacgaaaacagtttaaatctctaccacagcctcacaagcaaatgctaaggggaacatacatgtaaaaagccagcaaactatcttcaaactcttccgtccttaatgtcttccatggctattgcccccacaatggtctcttttctccctgctcccttattaaagaactctttctgaaaccctttttttttttttttttttt

SEQ ID NO: 409124 - DNA, 1960 bp, Homo sapiens
  misc_feature (1)..(1): n is a, c, g, or t
  misc_feature (3)..(4): n is a, c, g, or t
ncnngggggcatttctgcattcgaagaagaatctgagagaaacctgacgcagggagcatgggtatctggacctcaggcactgatatcttcctaagtctttgggagatttacgtgtctccaagaagccccggatggatggactttatccagcatttgggagtttgctgtttggttgctcttatttcagtgggcctcctgtctgtggccgcctgctggtttctgccatcaatcatagcggccgctgcctcctggattatcacgtgtgttctgctgtgttgctccaagcatgcacgatgttttattcttcttgtctttctctcttgtggcctgcgtgaaggcaggaatgctttgattgcagctggcacagggatcgtcatcttgggacacgtagaaaatatttttcacaactttaaaggtctcctagatggtatgacttgcaacctaagggcaaagagcttttccatacattttccacttttgaaaaaatatattgaggcaattcagtggatttatggccttgccactccactaagtgtatttgatgaccttgtttcttggaaccagaccctggcagtctctcttttcagtcccagccatgtcctggaggcacagctaaatgacagcaaaggggaagtcctgagcgtcttgtaccagatggcaacaaccacagaggtgttgtcctccctgggtcagaagctacttgcctttgcagggctttcgctcgtcctgcttggcactggcctcttcatgaagcgatttttgggcccttgtggttggaagtatgaaaacatctacatcaccagacaatttgttcagtttgatgaaagggagagacatcaacagaggccctgtgtgctcccgctgaataaggaggaaaggaggaagtatgtcatcatcccgactttctggccgactcctaaagaaaggaaaaacctggggctgtttttcctccccatacttatccatctctgcatctgggtgctgtttgcagctgtagattatctgctgtatcggctcattttctcagtgagcaagcagtttcaaagcttgccagggtttgaggttcacttgaaactgcacggagagaaacaaggaactcaagatattatccatgattcttcctttaatatatctgtgtttgaacccaactgtatcccaaaaccaaaattccttctatctgagacctgggttcctctcagtgttattcttttgatattagtgatgctgggactgttgtcctctatccttatgcaacttaaaatcctggtgtcagcatctttctaccccagcgtggagaggaagcgcatccaatatctgcatgcaaagctgcttaaaaaaagatcaaagcagccgctgggagaagtcaaaagacggctgagtctctatcttacaaagattcatttctggcttccagtcctgaaaatgattaggaagaagcaaatggacatggcaagtgcagacaagtcatgagagaccccgactactcctcagccacatcgcaccaacaattctcttcaggtctaggatggcagtcactattcatgccggataatagagaactatgtgacgcagtcctctcaggagtctgagtttacagagccaacttgcagcacctggttatgcctcctttcatctcaaagccaaagagctgccaggtaaatggttatgtggtctatgttccaaacaaaccacatgatcttgcctgtgtcacaatgtaacaagactctagctgggtcccctggtgatgagtttcagcatagaataatgttcaaggaaaagaaaacgaaaacagtttaaatctctaccacagcctcacaagcaaatgctaaggggaacatacatgtaaaaagccagcaaactatcttcaaactcttccgtccttaatgtcttccatggctattgcccccacaatggtctcttttctccctgctcccttattaaagaactctttctgaaaccc

SEQ ID NO: 409125 - DNA, 428 bp, Homo sapiens
acggggtttcaccatgttggccaggatggcctccatctcctgacctcatgatctgcccgccttggcctcccaaagtgctgggattacaggtgtgaaccactgtgcctggcctagtgcctatagttttacaacaaaaggacagaaatcagaatcagctaaagggagagatgcataacacaaggtctcggagtgtcccaggcactaaccttctgtcatcctcaggaagacattaccatcttggcatagcaatgtgtgatgataacaatatgcagagaattaccaagcagggaagctcacccaagcctttggtgtccagagttattatttcagacctgattatatactgcccatgcagctacctttggtcttcacttccacaaggttagaattgatatggtgtgttccaaagcctctgttataaatcacat

SEQ ID NO: 409126 - DNA, 323 bp, Homo sapiens
ctctgactccctggttcaagcaattctcctgtctcagcctcctgagtaactgggactacaggcatgtgccaccatgtccagctaatttttgtatttttagaagagacggggtttcaccatgttggccaggatggcctccatctcctgacctcatgatctgcccgccttggcctcccaaagtgctgggattacaggtgtgaaccactgtgcctggcctagtgcctatagttttacaacaaaaggacagaaatcagaatcagctaaagggagagatgcataacacaaggtctcggagtgtcccaggcactaaccttctgtcatcc

SEQ ID NO: 409127 - DNA, 304 bp, Homo sapiens
agaaaatctaaatatcagagtgaggttggggagtgttccacctcaggaagaaatgctgagtaattgatttacagcccttttgtcaccggccagaccactaaattgtccattacccaagataaccattgcaaccagatatgccgacttgcatgccttgcccatcatgtgctaccagctcagcctgcaaaccttacccctgatgtcaattcccacactttgtctaattaaaaaaaagcactcctactggcttttttcagagagtcagctggagcgtccttgtactggggcacaagccccgaaataa

SEQ ID NO: 409128 - DNA, 325 bp, Homo sapiens
tttgtccaatcatatttctacccggttgtccatgcttcagtcgtgacggtccagtgaagtcctggaccgggtacagagagcttccagatagctgaacacgtggagggtcctggagggtggtgcacccagggagggtatgagagctctgcaccccttcccacatgccttgttctgtgcacctcttcatctgcattctttgtgctattctttataataaaccagtacacgtgttttcctgagttctgggcacagctttagcaaattaatcaaacctaagaagggggtcatgggaacactgacttgaagctggttggccagaagttct

SEQ ID NO: 409129 - DNA, 299 bp, Homo sapiens
tataaatcggtgttctggttatataattatgatactattacagatacttcctagtgtctccaacatagttgtaaaactctccagatactattttctattcaaatcagaagcatttttagtttcctttttttcctgtgaaaacattccttctaaaagcctctgacctcctgctgtagtccctactgattgctctttgaacttactgtgcacagctgtcatcctttacttctctcttgtttggagtctttgttttcttgagtctgtcttccttccttcctttttttttttttttttttttt

SEQ ID NO: 409130 - DNA, 261 bp, Homo sapiens
ctttggatcttatgtgggaagtaggctgaactgagtccaattgaggtatctgaataatccaggcatgagggtcatgattaccaatggtcagtgatttaatcagtcatttagaacatggtgtagcagtgaggtagtgagaagttttcagattctgcatttatttcaaaggtagagttggcctagaattttttctcgtattgattatggactatgtgacagaatgagtagggggaagatgattagtatttagcctgattcagt

SEQ ID NO: 409131 - DNA, 308 bp, Homo sapiens
gggtgacaaagtgagaccctgtctcaaaaagaaaagaaaaaagaaaaagaaaaaagaaagaaagtgccaaatatttttcaaagcagttgtttaccaccagcaatggataagcattccagttgccccacatcttccccaccacttaccattatcagtctttataatgtcagacgttctaacgggtatgtagtaatatctcattatggttgtagttttaatttccctgatgactaaagatgttgaacattgcattgatttatgggctgtttgcataccttcttttgctcattttaaattggatcatttgt

SEQ ID NO: 409132 - DNA, 268 bp, Homo sapiens
cattgaggtaatgtgatagtttacagcagagaaagtgatggagagagtgggactatttgggatacaccacaaatgaccaaatataaggcaattcatttttctaataggaaaaaaagtaaagatgggggaaggcagatgtaaatttaaaacacatacttaagtattaatagttcaataatttgataacatttaaaataacatgaatgtaagtttaatttatagatgtttcattttctgcacccgtattctctgataccgttttattgaa

SEQ ID NO: 409133 - DNA, 4368 bp, Homo sapiens
  misc_feature (121)..(121): n is a, c, g, or t
  misc_feature (898)..(898): n is a, c, g, or t
  misc_feature (907)..(907): n is a, c, g, or t
  misc_feature (1061)..(1061): n is a, c, g, or t
gccttctccatgacaggatggctttctccagttctaggatgctctttgttccatgttctgccttttgcttctaactaaaatctcaagctgcctgtttcaggaattgcaggtatcatcatgntaactacttaactggtccataggcttttcataaagatccacctgaaagattttcttgtaacattatttttcactgctgtagtttgtcatgtgctgagttgctctgtgccagtgctggctgtgcacctctctggtcttccctttagggcatacatcttataggtctggtatagttgcacaactgggattcgaggatggctctggttgctttacagggtgcaaacagcaagatagtctcagaggaggcctggccctaatgagtgacaactaagggagggcaagacactagggctgtttctaatcacaccataaacctgtcctgagttctcagtgattgggtgctgattccataggacatatatcatttctctcttttttttcttttctacacatgttctgatttttatttcatccatgacttccagcccttagctgctaccaatttctggcctccatgtgtcacctgttcctttccagtgcaacttctagagtgttctctaacactgacccacatgtaatatgttgtcagatgtgcacatgtttttaaatagtccttccacacctagtattcagttcccatgggtgtctactgggcctggacaccaataatcttctgtgcagtgtaccgaagtcctctcttctcatcaggggaggaagtcctgataaaagcttttggcagaatagtgagtcagagaccctacctgttctctctgagttgtgccccatctttgtgtctttcatctcataaggcctcccttgttctgtgacttgtagaggnttttttccncaaatttccaccagctctcatatcctaaaaacattttcttagactcattctttgacacacatttttgatgtaacttctcacaccatagtaaatctgtgttttctcagcatttctcttctttcaggttgctggtgtggagcagtagatgaggggncgccttctgcagagagcgtttctgtggaagaactgtcacagggcaggactccaaaggcagatacatccactgataagagtcacccctgtgagatttgtaccccagtcctgagagacattttacaaatgattgagctccaagcctcaccctgtggacagaaattgtacttgggtggagcatcaagagatttctggatgagttcaaaccttcaccagctccagaagcttgataatggagagaagctctttaaagtggatggggaccaggcctcatttatgatgaactgcaggttccatgtgtcaggaaaacccttcacgtttggggaagtcgggagggacttttcagccacctcaggacttctccagcatcaggtgactcccaccattgagagaccacacagcaggattagacacttgagagttcccactggacgaaagcctctcaaatacactgaatccaggaaatcttttagagagaaatctgtattcattcaacaccaaagagctgactctggagaaaggccttacaagtgcagtgaatgtgggaaatcctttagtcaaagttctggctttcttcgacacaggaaagcacacggtagaacaaggactcatgaatgtagtgaatgtgggaaatcatttagtcgcaaaactcacctaactcaacaccaaagagttcacactggagaaaggccttatgactgcagtgaatgtggcaaatcctttcgccaggtatctgtcctcattcaacatcaacgagttcacactggagaaaggccttatgagtgcagtgaatgtgggaaatcttttagccacagcactaacctctatcgtcacaggagtgcccacactagcacaaggccttatgagtgcagtgaatgtggaaaatcctttagccatagcactaacctctttcgacactggagagttcacactggagtaaggccttatgagtgtagtgaatgtgggaaagcatttagttgcaatatctaccttattcaccaccaaagatttcacactggagaaagaccttatgtgtgcagtgaatgtgggaaatcatttggccagaaatctgtcctcattcaacaccaaagagttcacactggagaaaggccttatgagtgcagtgaatgtgggaaagtttttagccaaagctctggcctctttcgacacagaagagctcacactaaaacaaagccttatgagtgcagtgaatgtgaaaaatcatttagttgcaaaactgacctcattcgacaccagacagttcacactggagaaaggccttatgagtgcagtgtatgtgggaaatcttttatccgaaaaacccacctcattcgacaccagactgttcacactaatgaaaggccttatgagtgcgatgaatgtgggaaatcctatagccaaagctctgccctccttcagcataggagagttcacactggagaaaggccttatgagtgcagagaatgtgggaaatcttttacccgcaaaaatcacctcattcaacacaagacagttcacactggagaaaggccttatgaatgcagtgaatgtggaaaatcctttagccaaagctctggcctcttaagacacagaagagttcatgtgcagtgaatgtgggaaattattttgtcacttttttttttttttttgagatggaattttgctcgtcacccaggctggagtgcaattgtgcaatctcagctcactgcaacctccgcctcctgggatcaagtgattctcctgccacagcctcctgagtacctgagattacaggcacccaccaccatgcccagctaatttttgtatttttaatagaaacaaggtttcaccatgttggtcaggctggtgttgaactcctgacctcaggtaatccacctgcttcagcctaccaaagtgctgggattacaggcgtgagccaccatgtccggcttgtgttgtgacatttaacacaagatttcccaaagaagaaaggccttatatatgctgtgaatgtgtttttgcttgttagtttgttttaacttggtatgacggcactggaggctagcctttgagaagagccttctctgatgtgactcatgtatccaaacatccatggatttcccataaatttgaggtatgtgggaagcatgtgtagctatgttgtactctctaaacctgcccagggaccttaccagattcgtgtcactgccagtttctgcggctgaagccttttcatcactacccgctgggagacccacagagtgtgcatcagtcaccaccccaacatgctcagggaggcagagttcttccattagttggaggaaagcacgagtagtctaagctcttaggggggtttctcatttcctcctgtggctacatagtgcatataactaccccagtgttggccccaggacctgatctgagttctgctggcagcttccagaggattgccttttttgaggacattgttgatctcaggcgatgcttgtgatgaagcattttttagcttccaccacttaccaggaactgcctgttaactggcttgtgcaatgataaaggccttttgtttaagtacctttaatcttgtaagttgtattaattgttgagtagtttggaaacataataggactctgtcagcttaaaagggtatataacatttgtggggattcaaattttgtttgcctcagaggggacagtatgctcacagaatatagattttgctccatttttggcctatttcgcattgtttccaaggccttctaggagacactgcagggctttctggctctgatttttgcctgcatgtgggctcagaggtcattctgcagagggggcagttgtggcaacttccattgtttctggagacaacacaaagtttttcttgttgagtgaggatatcacataatgccctgcaatgtttagaatcccttaatgaggtcctgtgaaggagctgtgtcccttgaaacacagaattcagtgagctagtgtccctagctataaaaccatggggctggagcgaaacataattggtaaagaaacgctgggttgaataatagggaatggaggagactgcagcaaattagatggactgttcctcatataaagtttcatccggccgggcgcagtggctcacacctttaatcctagcactttgggaggctgaggtgggtggatcacaaggtcgggagttcaataacagcctggccaaggtggtgaaaccctggaaggctgaggcagataattgcttgaacttgggaggcagaggttgcagtgagctcagatcacaccactgcactccagcctgggtgacagagcgagactgcgtctca

SEQ ID NO: 409134 - DNA, 1523 bp, Homo sapiens
  misc_feature (121)..(121): n is a, c, g, or t
  misc_feature (898)..(898): n is a, c, g, or t
  misc_feature (907)..(907): n is a, c, g, or t
  misc_feature (1061)..(1061): n is a, c, g, or t
gccttctccatgacaggatggctttctccagttctaggatgctctttgttccatgttctgccttttgcttctaactaaaatctcaagctgcctgtttcaggaattgcaggtatcatcatgntaactacttaactggtccataggcttttcataaagatccacctgaaagattttcttgtaacattatttttcactgctgtagtttgtcatgtgctgagttgctctgtgccagtgctggctgtgcacctctctggtcttccctttagggcatacatcttataggtctggtatagttgcacaactgggattcgaggatggctctggttgctttacagggtgcaaacagcaagatagtctcagaggaggcctggccctaatgagtgacaactaagggagggcaagacactagggctgtttctaatcacaccataaacctgtcctgagttctcagtgattgggtgctgattccataggacatatatcatttctctcttttttttcttttctacacatgttctgatttttatttcatccatgacttccagcccttagctgctaccaatttctggcctccatgtgtcacctgttcctttccagtgcaacttctagagtgttctctaacactgacccacatgtaatatgttgtcagatgtgcacatgtttttaaatagtccttccacacctagtattcagttcccatgggtgtctactgggcctggacaccaataatcttctgtgcagtgtaccgaagtcctctcttctcatcaggggaggaagtcctgataaaagcttttggcagaatagtgagtcagagaccctacctgttctctctgagttgtgccccatctttgtgtctttcatctcataaggcctcccttgttctgtgacttgtagaggnttttttccncaaatttccaccagctctcatatcctaaaaacattttcttagactcattctttgacacacatttttgatgtaacttctcacaccatagtaaatctgtgttttctcagcatttctcttctttcaggttgctggtgtggagcagtagatgaggggncgccttctgcagagagcgtttctgtggaagaactgtcacagggcaggactccaaaggcagatacatccactgataagagtcacccctgtgagatttgtaccccagtcctgagagacattttacaaatgattgagctccaagcctcaccctgtggacagaaattgtacttgggtggagcatcaagagatttctggatgagttcaaaccttcaccagctccagaagcttgataatggagagaagctctttaaagtggatggggaccaggcctcatttatgatgaactgcaggttccatgtgtcaggaaaacccttcacgtttggggaagtcgggagggacttttcagccacctcaggacttctccagcatcaggtgactcccaccattgagagaccacacagcaggattagacacttgagagttcccactggacgaaagcctctcaaatacactgaatccagga

SEQ ID NO: 409135 - DNA, 1892 bp, Homo sapiens
cttatcgtcgaagacctctttgatggcatcaggctgatcgtggggtcgtaatcttgtgttgaatgaggtgattttagcgggtaaaagatttcccacattctctgcactcaaaggccttatgaatgcagtgaatgtggaaaatcctttagccaaagctctggcctcttaagacacagaagagttcatgtgcagtgaatgtgggaaattattttgtcacttttttttttttttttgagatggaattttgctcgtcacccaggctggagtgcaattgtgcaatctcagctcactgcaacctccgcctcctgggatcaagtgattctcctgccacagcctcctgagtacctgagattacaggcacccaccaccatgcccagctaatttttgtatttttaatagaaacaaggtttcaccatgttggtcaggctggtgttgaactcctgacctcaggtaatccacctgcttcagcctaccaaagtgctgggattacaggcgtgagccaccatgtccggcttgtgttgtgacatttaacacaagatttcccaaagaagaaaggccttatatatgctgtgaatgtgtttttgcttgttagtttgttttaacttggtatgacggcactggaggctagcctttgagaagagccttctctgatgtgactcatgtatccaaacatccatggatttcccataaatttgaggtatgtgggaagcatgtgtagctatgttgtactctctaaacctgcccagggaccttaccagattcgtgtcactgccagtttctgcggctgaagccttttcatcactacccgctgggagacccacagagtgtgcatcagtcaccaccccaacatgctcagggaggcagagttcttccattagttggaggaaagcacgagtagtctaagctcttaggggggtttctcatttcctcctgtggctacatagtgcatataactaccccagtgttggccccaggacctgatctgagttctgctggcagcttccagaggattgccttttttgaggacattgttgatctcaggcgatgcttgtgatgaagcattttttagcttccaccacttaccaggaactgcctgttaactggcttgtgcaatgataaaggccttttgtttaagtacctttaatcttgtaagttgtattaattgttgagtagtttggaaacataataggactctgtcagcttaaaagggtatataacatttgtggggattcaaattttgtttgcctcagaggggacagtatgctcacagaatatagattttgctccatttttggcctatttcgcattgtttccaaggccttctaggagacactgcagggctttctggctctgatttttgcctgcatgtgggctcagaggtcattctgcagagggggcagttgtggcaacttccattgtttctggagacaacacaaagtttttcttgttgagtgaggatatcacataatgccctgcaatgtttagaatcccttaatgaggtcctgtgaaggagctgtgtcccttgaaacacagaattcagtgagctagtgtccctagctataaaaccatggggctggagcgaaacataattggtaaagaaacgctgggttgaataatagggaatggaggagactgcagcaaattagatggactgttcctcatataaagtttcatccggccgggcgcagtggctcacacctttaatcctagcactttgggaggctgaggtgggtggatcacaaggtcgggagttcaataacagcctggccaaggtggtgaaaccctggaaggctgaggcagataattgcttgaacttgggaggcagaggttgcagtgagctcagatcacaccactgcactccagcctgggtgacagagcgagactgcgtctca

SEQ ID NO: 409136 - DNA, 1192 bp, Homo sapiens
cttatcgtcgaagacctctttgatggcatcaggctgatcgtggggtcgtaatcttgtgttgaatgaggtgattttagcgggtaaaagatttcccacattctctgcactcaaaggccttatgaatgcagtgaatgtggaaaatcctttagccaaagctctggcctcttaagacacagaagagttcatgtgcagtgaatgtgggaaattattttgtcacttttttttttttttttgagatggaattttgctcgtcacccaggctggagtgcaattgtgcaatctcagctcactgcaacctccgcctcctgggatcaagtgattctcctgccacagcctcctgagtacctgagattacaggcacccaccaccatgcccagctaatttttgtatttttaatagaaacaaggtttcaccatgttggtcaggctggtgttgaactcctgacctcaggtaatccacctgcttcagcactttaggaggccgaggtgggtggataacccaaggtcaggagttcgagaccagcctggtcaacatggcgaaaccctgtctctactaaaagtacaaaaattgtaaaagtaaaaagtaaaagtaaaagctgggtgtggtggcaggcaccagtaatcctagctactcaggagacaggcagaagaatctcttgaacctgggaggtgagccgagatcgcaccattgcacttcggcctgggcaacaacagcgaaactctgtctcaaaaaaaaagtatccacaaatgttccagtgactatgactgcaagatcactgtgtgcagaaatctctagaaatgtgtgtcttgtagctcaagttattactagagacaacaagggttttgtggattcctgtagcctctctggcctgtttacttcaaggccattgctgcacagacaaaaaaaaaaaaggatgaagtcaagagagattcggttgtccttggtgcggcttttgtgatccagtagcaatcctcttaacgctgatggaaatggccttcattgctcacctgtatttcctgccactgaagcaggtctgcctctacgtggcctggggagctagatggtagagtcaatagagacttagtaaaccagactttttgaagtgtcaatgaccaagattgttattgcatccattaaaaaaaaatcaagttataattgatgtggaataaattatatatatttaaagtgtaaa

SEQ ID NO: 409137 - DNA, 699 bp, Homo sapiens
gagatggagtcttgctctgttccccaggctggagggcagtggtgagatctcagctccgtgcaatctcagctcactgcaacctccgcctcctgggatcaagtgattctcctgccacagcctcctgagtacctgagattacaggcacccaccaccatgcccagctaatttttgtatttttaatagaaacaaggtttcaccatgttggtcaggctggtgttgaactcctgacctcaggtaatccacctgcttcagcctaccaaagtgctgggattacaggcgtgagccaccatgtccggcttgtgttgtgacatttaacacaagatttcccaaagaagaaaggccttatatatgctgtgaatgtgtttttgcttgttagtttgttttaacttggtatgacggcactggaggctagcctttgagaagagccttctctgatgtgactcatgtatccaaacatccatggatttcccataaatttgaggtattattgagtgttttcaagaatgaaaagaggcctggcatggtggctcacatctgtaatcccaactttttgggaggctgaggtgggaggatcccttgagcccaagagtttgaggctgcagcaagctatgatcgtgccactacactccagcctgtgcaacacagtgagatcctgtctccaaaattaaataaataaataaaattacattttggagacta

SEQ ID NO: 409138 - DNA, 2007 bp, Homo sapiens
  misc_feature (121)..(121): n is a, c, g, or t
  misc_feature (898)..(898): n is a, c, g, or t
  misc_feature (907)..(907): n is a, c, g, or t
  misc_feature (1061)..(1061): n is a, c, g, or t
gccttctccatgacaggatggctttctccagttctaggatgctctttgttccatgttctgccttttgcttctaactaaaatctcaagctgcctgtttcaggaattgcaggtatcatcatgntaactacttaactggtccataggcttttcataaagatccacctgaaagattttcttgtaacattatttttcactgctgtagtttgtcatgtgctgagttgctctgtgccagtgctggctgtgcacctctctggtcttccctttagggcatacatcttataggtctggtatagttgcacaactgggattcgaggatggctctggttgctttacagggtgcaaacagcaagatagtctcagaggaggcctggccctaatgagtgacaactaagggagggcaagacactagggctgtttctaatcacaccataaacctgtcctgagttctcagtgattgggtgctgattccataggacatatatcatttctctcttttttttcttttctacacatgttctgatttttatttcatccatgacttccagcccttagctgctaccaatttctggcctccatgtgtcacctgttcctttccagtgcaacttctagagtgttctctaacactgacccacatgtaatatgttgtcagatgtgcacatgtttttaaatagtccttccacacctagtattcagttcccatgggtgtctactgggcctggacaccaataatcttctgtgcagtgtaccgaagtcctctcttctcatcaggggaggaagtcctgataaaagcttttggcagaatagtgagtcagagaccctacctgttctctctgagttgtgccccatctttgtgtctttcatctcataaggcctcccttgttctgtgacttgtagaggnttttttccncaaatttccaccagctctcatatcctaaaaacattttcttagactcattctttgacacacatttttgatgtaacttctcacaccatagtaaatctgtgttttctcagcatttctcttctttcaggttgctggtgtggagcagtagatgaggggncgccttctgcagagagcgtttctgtggaagaactgtcacagggcaggactccaaaggcagatacatccactgataagagtcacccctgtgagatttgtaccccagtcctgagagacattttacaaatgattgagctccaagcctcaccctgtggacagaaattgtacttgggtggagcatcaagagatttctggatgagttcaaaccttcaccagctccagaagcttgataatggagagaagctctttaaagtggatggggaccaggcctcatttatgatgaactgcaggttccatgtgtcaggaaaacccttcacgtttggggaagtcgggagggacttttcagccacctcaggacttctccagcatcaggtgactcccaccattgagagaccacacagcaggattagacacttgagagttcccactggacgaaagcctctcaaatacactgaatccaggaaatcttttagagagaaatctgtattcattcaacaccaaagagctgactctggagaaaggccttacaagtgcagtgaatgtgggaaatcctttagtcaaagttctggctttcttcgacacaggaaagcacacggtagaacaaggactcatgaatgtagtgaatgtgggaaatcatttagtcgcaaaactcacctaactcaacaccaaagagttcacactggagaaaggccttatgactgcagtgaatgtggcaaatcctttcgccaggtattattgagtgttttcaagaatgaaaagaggcctggcatggtggctcacatctgtaatcccaactttttgggaggctgaggtgggaggatcccttgagcccaagagtttgaggctgcagcaagctatgatcgtgccactacactccagcctgtgcaacacagtgagatcctgtctccaaaattaaataaataaataaaattacattttggagacta

SEQ ID NO: 409139 - DNA, 470 bp, Homo sapiens
ggatcgtccaccgctcccggcccgctccgcccagagtccgatggcggcggcactgagggccccgacccagattgccactagtacttacaggtccgtaagaagcacttgaagaccctacaaggcaggtttttgtagcctttgaggatgtggccatttacttctcccaggaggagtgggagctccttgatgagatgcagaggctcctgtaccgcgatgtgatgctggagaactttgcagttatggcatccctaggtattattgagtgttttcaagaatgaaaagaggcctggcatggtggctcacatctgtaatcccaactttttgggaggctgaggtgggaggatcccttgagcccaagagtttgaggctgcagcaagctatgatcgtgccactacactccagcctgtgcaacacagtgagatcctgtctccaaaattaaataaataaataaaattacattttggagacta

SEQ ID NO: 409140 - DNA, 469 bp, Homo sapiens
aggcgtgagccacctcacccaaccctaagtctaaattctaataatcacctatactcctttctctcagcagcctttgccagatggaaacttctctgaggtacctgccccaggacttggagtctaggggagggatgatggcaatgaaaggtttcttttctcctgtcacatcttgctccagacgtcatcttgtctcctgttacacttggatctcaggcatctatcctggcttgatgttggagtcccccaggtgcctcatagtcccctggacactggcagggtcacctttcttttctgaaattgcagggcagcttgatgtacattgtaatgaacccaatttatgatgcctggcaatgcatttactaagtgccatttatctttttgtgtgtggaacgcattcagtcttctaagcaatgcctggatgttcattcatgtctggacttcaggttaggcatgagggtgaggtaaagtc

SEQ ID NO: 409141 - DNA, 291 bp, Homo sapiens
atccttagatttaattgaccatctttgccatatgagagaagctctattttcttttagtgttacttccaaagaagccgctgtagaatatgatatgatatgtgcttttcttgatctagattggatacattgcatgtcaaagcatttctgtttaaatatttcagtcaatataatactatgtaatggcacaaaaggtaggtgtaagctttttccctcaacactcttatagttgaatttgtcaggtcaggaaaagaaatgaagtagaactctatgttcagagttcataagccactg

SEQ ID NO: 409142 - DNA, 321 bp, Homo sapiens
cccggggggcatggagcctcacaatccccttcctaatgggaaggctatccctgcccaaagagttccagtgtcatctgaccccttccctgatctggtctagctggaggagatgtcataaacccattcctcctctgccctgatcttctatgcccctggatgccagaggaaggattcttgggtgtaaccttctatggcctctggtccctgaacttgggcaaggagtgcctggcacctctcaggatgctttaaagtcagagtgcttccctgcagaggagacagatgttgggtctgagtcacacagcttgggatccccttctgact

SEQ ID NO: 409143 - DNA, 1015 bp, Homo sapiens
cccgggtttgaagaaaggttttcagggagatgtatctacgttaactttcccctatggggtgatagttaactgttgctccaaagatgacctgtgagttcctatttttgaatattatcgtgaactcgtggattaaaacaaactgtgtttcaatttattgcagttgttatccttttgttttgagacggagttttgctcttgttgcccaagctggagtgcaatggcacgatctcagctcactgcaacctccacctcctgagttcaagtgattctcctgcgcagcctccagagtagctgggattacaggcgcccaccaccatacctggctaatttttttgtatttttagtagaaaccgggtttcaccgtgttagccaggctggtctcaaactcctgaactcaggtgatcctcctgtctcggcctcccaaagtgctgggattacaggagtgagccactgcgtccagcctgttatccttctcgatgtttaaattttctatctttgtccagtggaaacctattcaaggtgacctccgagtagttttgacacgactcttaactagtcactgataccctccttgctttttggtatgacaacatgttcccttcttatcttgaacattttatgctccagatttggaattagcccattttgctaaggaattatagttcctttagttggggcatagtatttagagaccacaatctgagcactgaggattcctattgctactaacttactcataccttttaggccttttcagtgaacagacttagacgcatgtctttttttttttctttttttaaaacataaattacatagtaattcatactgatacttggcaattcaagttcaggactacaaggtttttacttaatatcattcttatatctgtctgtatcttctttttcccatgcccaaactgctgatgctcaacataatttttttatttgctttatcccatgatataaatacagcactcttagaataacaacactgccatcaatattactagaaatgc

SEQ ID NO: 409144 - DNA, 661 bp, Homo sapiens
caagatttaaaaagtagagtgaagtctccatctcttgttgggaggagctatgaaatatggtggcccgtttttttccactgtatcacagtgataaagttgaaggttcaaattgtgactgtgctacttgttgtgtaaccttggatgagtcatttaacttctccaaacctcaggaaaatggagaaaacagaacctacctaaagggttgtatgcagattaattaatacatacaaagcacttagaatagtacttaacatgtagtaggcacttaatacattttacctgttgcttagataaattggtagaggtttttatgattaccagcaacagaaaccagcctgacttggtttaagcttctaaaaatttattcattagaaggatctggctgggagcggtggctcatacctgtaatcccagcactttgggaggctgaggtgggcagatcacaaggtcagcagttttgagaccagcctggccaacatggtgaaaccccatctctactaaaaatacaaaattagctcggcgtggtgccgtgcgcctgtaatcccagctgctcgggaggctgaggtgaaagaattgcttgaacccaggaggcggaggttgcaatgagccgagatcgtgccactgcactccagcctaggtgacagagtgagactctgtctcg

SEQ ID NO: 409145 - DNA, 2057 bp, Homo sapiens
  misc_feature (973)..(973): n is a, c, g, or t
  misc_feature (1046)..(1046): n is a, c, g, or t
  misc_feature (1049)..(1049): n is a, c, g, or t
aaaaaaaaaagaaaaaaaaaagctaaatatagaaagccacctgctttctaattgtactggctgccatcttgtcttctttctactgacaagaaagtatcaataagaggtagtgattggtttgagggggaaacagtttttctagcagtttagtccttaatctgtggcttcttaagacctctgagttccatgttagaatattttaatgtattagtttctaggaaataggagtagctgaaaggagaggaggagtgaacattcttaagcatggagttatgttctaggctgcgattgacatatgcagtctaccactatgcaaggacgaatgaggtcagtgttgtaggaacatctggtggagtaaaggcatcccatcatctgtgaagtggagtccgcctgcctacccagaggttgctgtgaggattaagaaattacatatggaaagcaactggcaaagtgttttgcttatagaaagctctaatatgctaattgccttccccgtttctttatataatttataaggaaactaaaaaccagcgattaaaaccttagctttggtttctatatgtgtaaaatatagttcttatgtttgtctctcattaacctgtaagtttcttcaaatctgggagcatgtctaattgctgtgtatatatcttcagtcctgaagatgatagtagaaaacagttcttctttgaaggtttgttacatggatggatggatgattaacttgtgccagaacacacaggagtcaacagtgaaactgggccaaggacccatgtctcttactcttaacacagtgtttctttctagtcctgtgtttttctgtactatgtacctactatggatcatgccctgtgttttgcaatgaagacctctaactttatttccattccaaggagagggaggtttcagcacactcctggaacaaccagctttcttttcccttccgcctagtgctgcccccacctgcttagggctntcttttttggcttcaccaattgttgctctttggcatgaagagatgctttgtgagccagatgggtctctgaacngangtctttgatggagagtttaccacttgcacagccaagaaagggaagtcactagaaggacttctgtgtgggctggcctggctgctcagcatttcagactcctgttgtttacaagtcttctccagaagccctggaagaatgaactgtaaggcctggactatggaatggtacctgtgcaccagcaattcctgagcaagcagcacagtgagtagatgattcctggaaacctgagttcaggtgaaaatgagagagagcagtctccttgtccctgcctatgggcttcctcatggccagttctacctctgttctaaatatattcttcactgatgaaatttcaacttcatttattcttctgtccttgaggaaaagtggggaagagtaaagaggtcttttctctgcctcaaatttttatttgttcttatttgttgatacttatttgctggagatagcttagtggtttttttctctttctttttgagacagggtcttgctctggtgcccaggcttggagtacagtggtgcagtcatggctcactatagccttggcctcctaggctaaagcgattctcctgcctcagcctcctgaagtgctgagactacaggcatgagctgctaggcttgggttgattatttcaattaccatttgctatgtaacgaggctccaaaacttacaacagaaaccagcctgacttggtttaagcttctaaaaatttattcattagaaggatctggctgggagcggtggctcatacctgtaatcccagcactttgggaggctgaggtgggcagatcacaaggtcagcagttttgagaccagcctggccaacatggtgaaaccccatctctactaaaaatacaaaattagctcggcgtggtgccgtgcgcctgtaatcccagctgctcgggaggctgaggtgaaagaattgcttgaacccaggaggcggaggttgcaatgagccgagatcgtgccactgcactccagcctaggtgacagagtgagactctgtctcg

SEQ ID NO: 409146 - DNA, 272 bp, Homo sapiens
gactatgcacttctggggcgtcgctataggaacctatttataaaagacaagatacatatttatgaaatctttatctctggcatttttaaatgcaagagatattaagtatgaattgaataatatacatttcctgctttttcagacagatacagatgattaccatgccatcatctgtcctaaatggcatcatttagtgttgacttcaataaaatcctctctctgctgtgtcatgaaaggaactggactcaccttaatagtgctgttctaacgcg

SEQ ID NO: 409147 - DNA, 244 bp, Homo sapiens
taagaagctctgagaaggtatcgtatctggtgttaccaacaggtaaagattagggtttggaactaaatgtaagacataggcttgcacaatcttagggttagagggaacctgagaggtgttctaattggaattttcctaatatggccctgtcaagtggttatctagtttttgcttagttaccacgagtgacaaggagcttgctacttaacagaggcaacctgttccatttgggacaggctggcag

SEQ ID NO: 409148 - DNA, 499 bp, Homo sapiens
gagaaccaccctcctcctactctttttccacttcctcctctttctttccccagctgaggaagaacctcctctgccccttctggagcccgagcctggcctgtcttcgttggggctgataaattgcctctcccagggcctgctgggtgagtcaccatccctgctggcctccagcatgtccagccagccgggcaggatttctctgcttctggctggcagccaggaactgagtatgacaatgttgtactaaagaaaggcccaaagtgacagaggcagcagagggatggtccaccgccccttggcttctgctggtgactcctcctggccactgcatcagaggacaaaaggatgtcagcaattgcttgggctgcttggctatgcaagcctcctgcctgctgatggccacttcagggacagcctgggcccaggcacccagggggatggcggcagcttcctgcacctttcagatttcttggtggcattaaagcattttcagaacaat

SEQ ID NO: 409149 - DNA, 1746 bp, Homo sapiens
gagacgggataacacacggctaagaagagagaggcaagggcaggagtgaaggagagagctgaagcctggggctccgagatggtcagaggatgggagacggggcagtgaaacaaggcttcttgtatcttcagcagcagcagacgtttggaaagaaatggcgccgcttcggcgcctcactgtatggagggtcggactgcgccttggcccggctggagctgcaggagggcccggagaagcctcgtcggtgtgaggctgcccggaaggtcatccgcctcagtgactgcctgcgggtggccgaggccggcggagaggccagcagcccccgggacaccagtgccttcttcctggagaccaaggagcgcctgtacctcctggcggcccctgcagcggagcgcggcgactgggtgcaggccatctgcctcctggccttccccgggcagaggaaggagctctcggggccagagggaaagcagagccggccctgcatggaggaaaatgaattgtacagcagcgcagtcacagtcggcccccacaaggaatttgctgtgaccatgagacctacagaagccagtgagaggtgccacctgcgggggtcctataccctccgggctggggagagtgccctggagctgtggggtgggcccgagccagggacccagctgtacgactggccctacaggtttctgcggcgctttgggcgggacaaggccgtcgctgcgtctctggagagggcaactttgagttcgaaacccggcaaggcaatgagatcttcttggccctggaagaggccatctctgcccagaagaatgctgcacccgctacaccccaaccgcagccagccacaatccccgcgtcgctgccccggcctgatagcccctactctcggccgcatgactcactgccgccgccttcacccaccacaccggtgcctgctccacggcctcggggccaggagggggagtatgccgtgcccttcgatgcggtggcccgttccttggggaagaacttcaggggcatcttggcagtccctcctcagctcctggccgaccctctgtacgacagcattgaggagaccctgccccctcgacctgaccacatatacgatgagcccgagggagtggctgccctgtccctctatgacagcccgcaggagccccggggtgaggcatggaggaggcaggcgacagctgacagggaccctgctggcctccagcatgtccagccagccgggcaggatttctctgcttctggctggcagccaggaactgagtatgacaatgttgtactaaagaaaggcccaaagtgacagaggcagcagagggatggtccaccgccccttggcttctgctggtgactcctcctggccactgcatcagaagaacctcctctgccccttctggagcccgaggcctggcctgtcttcgttggggctgataaattgcctctcccagggcctgctgggtgagtcaccatcccaaagcaggaagggtgccctggagagaaccaccctcctcctactctttttccacttcctcctctttctttccccagctgaggaggaacctggggcatttagggcagaggacaaaaggatgtcagcaattgcttgggctgcttggctatgcaagcctcctgcctgctgatggccacttcagggacagcctgggcccaggcacccagggggatggcggcagcttcctgcacctttcagatttcttggtggcattaaagcattttcagaacaat

SEQ ID NO: 409150 - DNA, 1585 bp, Homo sapiens
atctccccgtctctgggtggctccctcccgcccccgcctcccacgcctatggcacagaaatggcgccgcttcggcgcctcactgtatggagggtcggactgcgccttggcccggctggagctgcaggagggcccggagaagcctcgtcggtgtgaggctgcccggaaggtcatccgcctcagtgactgcctgcgggtggccgaggccggcggagaggccagcagcccccgggacaccagtgccttcttcctggagaccaaggagcgcctgtacctcctggcggcccctgcagcggagcgcggcgactgggtgcaggccatctgcctcctggccttcccctcggcccccacaaggaatttgctgtgaccatgagacctacagaagccagtgagaggtgccacctgcgggggtcctataccctccgggctggggagagtgccctggagctgtggggtgggcccgagccagggacccagctgtacgactggccctacaggtttctgcggcgctttgggcgggacaaggtaaccttttcctttgaggcaggccgtcgctgcgtctctggagagggcaactttgagttcgaaacccggcaaggcaatgagatcttcttggccctggaagaggccatctctgcccagaagaatgctgcacccgctacaccccaaccgcagccagccacaatccccgcgtcgctgccccggcctgatagcccctactctcggccgcatgactcactgccgccgccttcacccaccacaccggtgcctgctccacggcctcggggccaggagggggagtatgccgtgcccttcgatgcggtggcccgttccttggggaagaacttcaggggcatcttggcagtccctcctcagctcctggccgaccctctgtacgacagcattgaggagaccctgccccctcgacctgaccacatatacgatgagcccgagggagtggctgccctgtccctctatgacagcccgcaggagccccggggtgaggcatggaggaggcaggcgacagctgacagggaccctgctggcctccagcatgtccagccagccgggcaggatttctctgcttctggctggcagccaggaactgagtatgacaatgttgtactaaagaaaggcccaaagtgacagaggcagcagagggatggtccaccgccccttggcttctgctggtgactcctcctggccactgcatcagaagaacctcctctgccccttctggagcccgaggcctggcctgtcttcgttggggctgataaattgcctctcccagggcctgctgggtgagtcaccatcccaaagcaggaagggtgccctggagagaaccaccctcctcctactctttttccacttcctcctctttctttccccagctgaggaggaacctggggcatttagggcagaggacaaaaggatgtcagcaattgcttgggctgcttggctatgcaagcctcctgcctgctgatggccacttcagggacagcctgggcccaggcacccagggggatggcggcagcttcctgcacctttcagatttcttggtggcattaaagcattttcagaacaat

SEQ ID NO: 409151 - DNA, 1236 bp, Homo sapiens
gagacgggataacacacggctaagaagagagaggcaagggcaggagtgaaggagagagctgaagcctggggctccgagatggtcagaggatgggagacggggcagtgaaacaaggcttcttgtatcttcagcagcagcagacgtttggaaagaaatggcgccgcttcggcgcctcactgtatggagggtcggactgcgccttggcccggctggagctgcaggagggcccggagaagcctcgtcggtgtgaggctgcccggaaggtcatccgcctcagtgactgcctgcgggtggccgaggccggcggagaggccagcagcccccgggacaccagtgccttcttcctggagaccaaggagcgcctgtacctcctggcggcccctgcagcggagcgcggcgactgggtgcaggccatctgcctcctggccttccccgggcagaggaaggagctctcggggccagagggaaagcagagccggccctgcatggaggaaaatgaattgtacagcagcgcagtcacagtcggcccccacaaggaatttgctgtgaccatgagacctacagaagccagtgagaggtgccacctgcgggggtcctataccctccgggctggggagagtgccctggagctgtggggtgggcccgagccagggacccagctgtacgactggccctacaggtttctgcggcgctttgggcgggacaaggtaaccttttcctttgaggcaggccgtcgctgcgtctctggagagggcaactttgagttcgaaacccggcaaggcaatgagatcttcttggccctggaagaggccatctctgcccagaagaatgctgcacccgctacaccccaaccgcagccagccacaatccccgcgtcgctgccccggcctgatagcccctactctcggccgcatgactcactgccgccgccttcacccaccacaccggtgcctgctccacggcctcggggccaggagggggagtatgccgtgcccttcgatgcggtggcccgttccttggggaagaacttcaggagggcccggagaagcctcgtcggtgtgaggctgcccggaaggtcatccgcctcagtgactgcctgcggggttggccgaggccggcggagaggccagcagcccccgggacaccagtgccttcttcctggagaccaggagcgcctgtactcctggcggcccctgcagcggagcgccgggactggggtgccggccatctggcttc

SEQ ID NO: 409152 - DNA, 853 bp, Homo sapiens
gagacgggataacacacggctaagaagagagaggcaagggcaggagtgaaggagagagctgaagcctggggctccgagatggtcagaggatgggagacggggcagtgaaacaaggcttcttgtatcttcagcagcagcagacgtttggaaaggtaggagtgaggctgggctggggttgggcagggggcctgggaggctgctagaattcctgggttggagagggagtttcatattcaaaacccttataggtctgactgtgcacccaccaagttagacccagagctcaactttgggagggctcttttcctacccgacgctgtctcctgaaccaggccccaaccaggtcccaaactgtgctccttactgagggctgtttgccctgggtgggggtgggggatgtgctgctttcatctcttgcctcttttgctctcttgctctatgttgacttcttttcaccggacaccttggaagggaatggaaggggcagctggagggacagtttaggatgacaatagaggttccttcccaaccccagtggggtgcatgtggctggtgttcagcttgggctggggcctctgggggcctggaccccagccggctgtccatcctctttccccttccctggcctccttgaaccaggaagtcctcgtcccctaaccaacactggggggcacacctgtctctctctcatggcccaacctatcaaggaatgaggcagcaaggttcaggagggtggagagaagttctccttcaggatttcgcacagaaggagaatgaggtctccagcccgggtcacacgccgccctcctcactccctcctctgggcctcggccactgccccgctttcctcccc

SEQ ID NO: 409153 - DNA, 1768 bp, Homo sapiens
gagacgggataacacacggctaagaagagagaggcaagggcaggagtgaaggagagagctgaagcctggggctccgagatggtcagaggatgggagacggggcagtgaaacaaggcttcttgtatcttcagcagcagcagacgtttggaaagaaatggcgccgcttcggcgcctcactgtatggagggtcggactgcgccttggcccggctggagctgcaggagggcccggagaagcctcgtcggtgtgaggctgcccggaaggtcatccgcctcagtgactgcctgcgggtggccgaggccggcggagaggccagcagcccccgggacaccagtgccttcttcctggagaccaaggagcgcctgtacctcctggcggcccctgcagcggagcgcggcgactgggtgcaggccatctgcctcctggccttccccgggcagaggaaggagctctcggggccagagggaaagcagagccggccctgcatggaggaaaatgaattgtacagcagcgcagtcacagtcggcccccacaaggaatttgctgtgaccatgagacctacagaagccagtgagaggtgccacctgcgggggtcctataccctccgggctggggagagtgccctggagctgtggggtgggcccgagccagggacccagctgtacgactggccctacaggtttctgcggcgctttgggcgggacaaggtaaccttttcctttgaggcaggccgtcgctgcgtctctggagagggcaactttgagttcgaaacccggcaaggcaatgagatcttcttggccctggaagaggccatctctgcccagaagaatgctgcacccgctacaccccaaccgcagccagccacaatccccgcgtcgctgccccggcctgatagcccctactctcggccgcatgactcactgccgccgccttcacccaccacaccggtgcctgctccacggcctcggggccaggagggggagtatgccgtgcccttcgatgcggtggcccgttccttggggaagaacttcaggggcatcttggcagtccctcctcagctcctggccgaccctctgtacgacagcattgaggagaccctgccccctcgacctgaccacatatacgatgagcccgagggagtggctgccctgtccctctatgacagcccgcaggagccccggggtgaggcatggaggaggcaggcgacagctgacagggaccctgctggcctccagcatgtccagccagccgggcaggatttctctgcttctggctggcagccaggaactgagtatgacaatgttgtactaaagaaaggcccaaagtgacagaggcagcagagggatggtccaccgccccttggcttctgctggtgactcctcctggccactgcatcagaagaacctcctctgccccttctggagcccgaggcctggcctgtcttcgttggggctgataaattgcctctcccagggcctgctgggtgagtcaccatcccaaagcaggaagggtgccctggagagaaccaccctcctcctactctttttccacttcctcctctttctttccccagctgaggaggaacctggggcatttagggcagaggacaaaaggatgtcagcaattgcttgggctgcttggctatgcaagcctcctgcctgctgatggccacttcagggacagcctgggcccaggcacccagggggatggcggcagcttcctgcacctttcagatttcttggtggcattaaagcattttcagaacaat

SEQ ID NO: 409154 - DNA, 1680 bp, Homo sapiens
gagacgggataacacacggctaagaagagagaggcaagggcaggagtgaaggagagagctgaagcctggggctccgagatggtcagaggatgggagacggggcagtgaaacaaggcttcttgtatcttcagcagcagcagacgtttggaaagaaatggcgccgcttcggcgcctcactgtatggagggtcggactgcgccttggcccggctggagctgcaggagggcccggagaagcctcgtcggtgtgaggctgcccggaaggtcatccgcctcagtgactgcctgcgggtggccgaggccggcggagaggccagcagcccccgggacaccagtgccttcttcctggagaccaaggagcgcctgtacctcctggcggcccctgcagcggagcgcggcgactgggtgcaggccatctgcctcctggccttcccctcggcccccacaaggaatttgctgtgaccatgagacctacagaagccagtgagaggtgccacctgcgggggtcctataccctccgggctggggagagtgccctggagctgtggggtgggcccgagccagggacccagctgtacgactggccctacaggtttctgcggcgctttgggcgggacaaggtaaccttttcctttgaggcaggccgtcgctgcgtctctggagagggcaactttgagttcgaaacccggcaaggcaatgagatcttcttggccctggaagaggccatctctgcccagaagaatgctgcacccgctacaccccaaccgcagccagccacaatccccgcgtcgctgccccggcctgatagcccctactctcggccgcatgactcactgccgccgccttcacccaccacaccggtgcctgctccacggcctcggggccaggagggggagtatgccgtgcccttcgatgcggtggcccgttccttggggaagaacttcaggggcatcttggcagtccctcctcagctcctggccgaccctctgtacgacagcattgaggagaccctgccccctcgacctgaccacatatacgatgagcccgagggagtggctgccctgtccctctatgacagcccgcaggagccccggggtgaggcatggaggaggcaggcgacagctgacagggaccctgctggcctccagcatgtccagccagccgggcaggatttctctgcttctggctggcagccaggaactgagtatgacaatgttgtactaaagaaaggcccaaagtgacagaggcagcagagggatggtccaccgccccttggcttctgctggtgactcctcctggccactgcatcagaagaacctcctctgccccttctggagcccgaggcctggcctgtcttcgttggggctgataaattgcctctcccagggcctgctgggtgagtcaccatcccaaagcaggaagggtgccctggagagaaccaccctcctcctactctttttccacttcctcctctttctttccccagctgaggaggaacctggggcatttagggcagaggacaaaaggatgtcagcaattgcttgggctgcttggctatgcaagcctcctgcctgctgatggccacttcagggacagcctgggcccaggcacccagggggatggcggcagcttcctgcacctttcagatttcttggtggcattaaagcattttcagaacaat

SEQ ID NO: 409155 - DNA, 496 bp, Homo sapiens
ggaaaatctcaagagacatataagagggtaaagtgtgcctaagtttatgtatttttgagttttaaaaatgtaattcaagtattctttatgaaccttcagatgatgacactctttcctttctgttccctttcccttgttttattaagatcgactttaactttctaatctgccatccttaactttttttttttttttttttttgagatagagtctcgctctgttacccaggctagagtgcagtggcgcgatctcggctcactgcaacctccgcctcccgggttaaagcgattctcctgcctcagcctcctgagtaggtgggattacaggcgcgtgtcaccacgcccagctagtttttgtatttttagtggagatggggtttcaccatgttggtcagactgatctcgaactcctgagctcgtgatccatctgtctcagcctcccaaagtgctgggattacaggtgtgagcctacccctggcctgctgactttaactttt

SEQ ID NO: 409156 - DNA, 833 bp, Homo sapiens
gaggaaccacacacttgggtctgagcagccagcagcttatcacatctggtgatcaatccttcaaaggttcctcctgaagtctgaatttttggaggtcaaatggattccacctgggaggggcttctgcttcaactcaggacatggggagaaggctgttcctcttccagggggaggcagttttcatggcattgagatgtcctctcacttattccccacccacccaccaagtcctttgtaagaggagtagggggagaggagagcgcctgcagcctcctgctcacattcctagacaccgactcactgagcccgtcgccgctggaacagcagagctgtgtgaaatgtcaagaggagttatgctcataggctccctggcctcagtctctttgtggcttgcatattcttccattagtactgtgttcatcacatggaaatcagagggtacaattaaaagataatttgctagtcccagacttaatttggggcccccttcttgcctgattgaattacaggggaacataatagatttttggtgagaaatagttgtctgtgtggctgggagaaagattgctcccagctctccagctgggcagccctttcagtatcccgtatgttatttccccacttccagcccacctcacctcctctgtggcccttgtgtgtcccctcggctaggatcctgacctcctgctcaagagtttaaactcaacttgagacccaaggaaaatagagagccctctgcaacctcataggggtgaaaaatgttgatgctgggagctatttagagacctaaccaaggcccagacagagagagtgacttgctaaaggccacatag

SEQ ID NO: 409157 - DNA, 252 bp, Homo sapiens
gtagttttaaaattactttgtatctattctaggtatcttttactctatcatagttaagacattgatgttatttattaatttgttcacattaaactcatgttctttcttcatttctgtaaaaatgtcaaccattttctttgcaatatttactgaataacgtactccttatttccttcattctgaaagtgtgatccatagagagatacctgtttcctcttctcattccatttcttgtgtgcattaattatgttt

SEQ ID NO: 409158 - DNA, 169 bp, Homo sapiens
attcccattctgctttgggattggtctctcatctactctcatcttcactctctcccaggcttattcactagtttgttttataaaaaaaaaagtccccacatacttgattcaatcacagacaatatattccctctatttctttggctggctttttccaaaagaactggtt

SEQ ID NO: 409159 - DNA, 647 bp, Homo sapiens
ggaacatcacgctactcaagggcgtggccgtcatcgtggtcgccatcatgggctcgggcatcttcgtgacgcccacgggcgtgctcaaggaggcaggctcgccggggctggcgctggtggtgtgggccgcgtgcggcgtcttctccatcgtgggcgcgctctgctacgcggagctgggcaccaccatctccaaatcgggcggcgactacgcctacatgctggacgtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtagcctgccactccgtgcgatggagtgtcactctgtcgcccaggctagagtgcagtggtgcaatctcggctcactgccagctccacctcctgggttcacgccattctcctgcctcagcctcccgagtagctgggattgcaggtgcccgccaccacgcctggctaattttttgtatttttagtagagatagggtttcaccgtgttagccaggatggtctcgatctcctgacctcgtgatccgcccgcctcggcctcccaaagtgctggga

SEQ ID NO: 409160 - DNA, 879 bp, Homo sapiens
catttctggctttcctggtttcatagccgcctattcgtctcgagatcctcccttgcgtcagttcccgctcctatctgctggtgtccttttcttgcttttcgtacccgtctggcaggctgagtttcatggtccatgtagatcccaccttgctagatgcctttgttcccgaatcctcgttattaaggtatatgttcatccagttaacccaagatctaggcatgttttccagtataagaggcataaatttagctcttgccaaaagcttcccatataatttccagcagcctgcctgatgatggcaggatctacttggatcctgcaattttttccacagatgttccctatatgcctctgctgcatgccgtgcgacagcggcggcgcggcgagcggagccgggaggcggggaagcagtggccgtgtgagcgtgaggagctgccgccaccgcctgttcctcgtcgtcctcctcctcgggggccccggcgacgtgggccgcgcagggccctggaagagacgtcgcctccccttcatccgcctctctctcaccgcgccgctcccgcctcctcgtcctgtgctgcgggctcaggcggaacccggaacggtcgtcctcttcccccgcccgccgccgcctcctcctcctcctccttctcggcttccttctcagccccgggccggagcggggtgttggcggcggccggttcgggtggcgactcgcgcttctctgggcggcggcgcttggccatatcgtgtcggggaaggtaatgagccgcagagccccggggtctcggctgagcggcggcggcggcaccaacggcaccaactattcgcggagctggaatgactggcaacccaggtgggtgaccggcccgggaccccgccccg

SEQ ID NO: 409161 - DNA, 1052 bp, Homo sapiens
ggaacatcacgctactcaagggcgtggccgtcatcgtggtcgccatcatgggctcgggcatcttcgtgacgcccacgggcgtgctcaaggaggcaggctcgccggggctggcgctggtggtgtgggccgcgtgcggcgtcttctccatcgtgggcgcgctctgctacgcggagctgggcaccaccatctccaaatcgggcggcgactacgcctacatgctggacgtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtagcctgccactccgtgccgtgagtacggggcgcgggccgggggttgggaggtcgtagtccctgggtccctgcatccttgcatcactacgcccctggctcccacatctctacatttttgcgttcctggaccgtcccggcagttctaggctaaggtcattggtcccagaaaccaagtgcgtttctttcattcattcttttacacttctccccacaggctgggaatatcttcagtgacgggacagcagggtccctgccctgcccttcggtgggcatttcattcccccacttaagcggttcaggcaagtgccagcctcccgttggccccgctgagcaatactcccagcctcttgcgtggcacccacgtggagtaactgagcaaccggtttattgttaaagctccgattgctgactggttggtgaaaacgaaattgcagttaaaaagaaaattattcatttctgctctccacaccagctcgtcaggaatcagtgacacgggctgactcataagaaaacagtagtaataaaatcgtgtgcgggtagtgactggtgctggtttaggctaagggatcccccctgagggttgcccagtagtgagagagcggagcttggctgcagattcagtcctgtgttacagtgattcgcgaatgggtacacagctcgattcgtatatgta

SEQ ID NO: 409162 - DNA, 952 bp, Homo sapiens
ggaacatcacgctactcaagggcgtggccgtcatcgtggtcgccatcatgggctcgggcatcttcgtgacgcccacgggcgtgctcaaggaggcaggctcgccggggctggcgctggtggtgtgggccgcgtgcggcgtcttctccatcgtgggcgcgctctgctacgcggagctgggcaccaccatctccaaatcgggcggcgactacgcctacatgctggacgtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtagcctgccactccgtgcgcacggcggggccgaccccgcctctcgctcccagcatgccgtgcgacagcggcggcgcggcgagcggagccgggaggcggggaagcagtggccgtgtgagcgtgaggagctgccgccaccgcctgttcctcgtcgtcctcctcctcgggggccccggcgacgtgggccgcgcagggccctggaagagacgtcgcctccccttcatccgcctctctctcaccgcgccgctcccgcctcctcgtcctgtgctgcgggctcaggcggaacccggaacggtcgtcctcttcccccgcccgccgccgcctcctcctcctcctccttctcggcttccttctcagccccgggccggagcggggtgttggcggcggccggttcgggtggcgactcgcgcttctctgggcggcggcgcttggccatatcgtgtcggggaaggtaatgagccgcagagccccggggtctcggctgagcggcggcggcggcaccaacggcaccaactattcgcggagctggaatgactggcaacccaggtgggtgaccggcccgggaccccgccccg

SEQ ID NO: 409163 - DNA, 586 bp, Homo sapiens
ggaacatcacgctactcaagggcgtggccgtcatcgtggtcgccatcatgggctcgggcatcttcgtgacgcccacgggcgtgctcaaggaggcaggctcgccggggctggcgctggtggtgtgggccgcgtgcggcgtcttctccatcgtgggcgcgctctgctacgcggagctgggcaccaccatctccaaatcgggcggcgactacgcctacatgctggacgtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtagcctgccactccgtgcaggcaattctgggtaaacgatcttcatttgcctataaagctgcacagctcacaggccttggaccgtttctgccccagccccagcattggcccccggggactgcctccaggagtcatttggagagcacagagaagcactggacccttccaagcaagggactctgtgtgactgcacaggttgcctgtctata

SEQ ID NO: 409164 - DNA, 404 bp, Homo sapiens
gaactgctgtgccaggtgcaccctgggggaccaggctgcctgggcttcctggaactggtgaagctgccgccacttcctctatgctctctccagcaggcaattctgggtaaacgatcttcatttgcctataaagctgcacagctcacaggccttggaccgtttctgccccagccccagcattggccctttggacagactctgaaaccgtgcgcagaacgcaccctgtcattacaaatgactcctggaggcagtccccgggggcctggcaggagcacctgtgtttctgtggggtctgaaaatgacagaccaatcgcttgaacccgggaggcggaagttgcagtgagccgagatcgagacattgccctccagcctgggcaacaagagcaaaactccatctcaaaaaa

SEQ ID NO: 409165 - DNA, 512 bp, Homo sapiens
ggaacatcacgctactcaagggcgtggccgtcatcgtggtcgccatcatgggctcgggcatcttcgtgacgcccacgggcgtgctcaaggaggcaggctcgccggggctggcgctggtggtgtgggccgcgtgcggcgtcttctccatcgtgggcgcgctctgctacgcggagctgggcaccaccatctccaaatcgggcggcgactacgcctacatgctggacgtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtagcctgccactccgtgctcatccccgaccagccccaaggtcttcccgctgagcctctgcagcacccagccagatgggaacgtggtcatcgcctgcctggtccagggcttcttcccccaggagtcactcagtgt

SEQ ID NO: 409166 - DNA, 706 bp, Homo sapiens
ggaacatcacgctactcaagggcgtggccgtcatcgtggtcgccatcatgggctcgggcatcttcgtgacgcccacgggcgtgctcaaggaggcaggctcgccggggctggcgctggtggtgtgggccgcgtgcggcgtcttctccatcgtgggcgcgctctgctacgcggagctgggcaccaccatctccaaatcgggcggcgactacgcctacatgctggacgtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtagcctgccactccgtgcaggcaattctgggtaaacgatcttcatttgcctataaagctgcacagctcacaggccttggaccgtttctgccccagccccagcattggccctttggacagactctgaaaccgtgcgcagaacgcaccctgtcattacaaatgactcctggaggcagtccccgggggcctggcaggagcacctgtgtttctgtggggtctgaaaatgacagaccaatcgcttgaacccgggaggcggaagttgcagtgagccgagatcgagacattgccctccagcctgggcaacaagagcaaaactccatctcaaaaaa

SEQ ID NO: 409167 - DNA, 756 bp, Homo sapiens
gaattaatggtccatagttttatctttggtttttacagaagttacctgcatttcagttactaagaaccaccacttcattcataaaaatgctctctgcatttctttctgtaattcataggcgttgtttatattagactattattatgggaaaatacactgctttaagaatttttaaacttggtaattttcagactcaaagtgtttgagattcttctgctgatagtttatttaaaaagaattacaaatttcagattgtggcctggtagggatgatacaaatacaaactgaatatacccacagtgattccttcctccacaaagtaaacctgtgattacacggagcccagtttgaagatctttattctagtttccgtttttcgcttatctcgcatgattttagatgtgtttaaagactacctggataaccaacttagaaatacaggctatatggcgtggtttcatgatgcggggattcacaggggaatcatggttgttgttgagggatgtgagccaaatgtgcagtaacagctgtcatagccgtagatagacgcagggctctctaaatttttactgaattaattaatggactgcagatccgagacctacgtaggaagtgaggtcaatgtaggtaggtgattcgaatcagttaacagtctttccagtggttatttggcaattctttttctttttcgttttctttttttgacacagagtctcacgctgtcgcccaggctggagtgcagtgacacaatcttgg

SEQ ID NO: 409168 - DNA, 1408 bp, Homo sapiens
cacagacctagtgatataggtggctctgtgacgagaagtatttgtaaaatgcctgtgaatgcatctatttaagacgtgtatgccccaaattgtatacatgagggtgcagatattgggaacatatggttccttgcaatgttgaacaaccccagaggaagggtttgactggggctgggtcccacaagtacctcctgaggctcatgggcatccctgaggatcctcaacccacccaaccaacttcccagaatacagaataggaaaatggttctgcagagagttgcattggagggctgaaggtggcctctcctgtggtccttttgtctctgatagagagcgagctggccaaaacggagagcacttatttggctgagatgcacagacaatctcccaaagagaaggccagcaagactacaacggtgcggaggaggaagcgtccccatgcccacctgcgagtccctcacctggaagaggtgatgagcccggtcaccacgcccacagatgaggatgtgggccacaggatcaaacatgtggcaggttccacacagacgcggcatatcccggaggacacccccaacggtttccacctgcagagcgtgtccaagctgctgctggttatcagctgtgttctggtgctgctggtcatccttaacatgatgctcttctacaaactctggatgttggaatacaccacgcagaccctcactgcctggcagggtctaaggctccaagaaaggttaccccagtctcagacagaatgggcccagctcttagagtcccaacaaaagtaccacgatactgagctccaaaaatggagggaaatcatcaaatcctcagtgatgctccttgaccagatgaaggactcgctcatcaaccttcagaacggcatcaggtcccgcgactacacgtcggaaagtgaagaaaagaggaatcgctatcattgacaaggcaggaacagggtggctgcaagaggcctgtgcaatacatgtacatagaccatataaatatatatatataaatatatatatatacagaatataaatatatatattatatacagattttaaaaaagagataatgcctatgtaccagggagaaggagcgggccctcccgcgccctgtgctggccggagcagcgttttcttatggtggagcagctgaggagggcaggaaccgcctctcagcaccgacctcccctgatctccctcctcccaccctctgttccccaccccttcccttgctggccattcttggcttttagaagggaaatgttgagccaaagttatgcctgcgaagaccctaaggtctcaaaaagaagtcttaagacggcattgcttaaggtgcttcattccctaatccccttttgatttgtttccaaaataaaagagaatcttttcttccctacaaaaag

SEQ ID NO: 409169 - DNA, 195 bp, Homo sapiens
gtgagatgccccaccttctctgcttgccctggtctttgggagcggggactccttcccttatgctgtgagaaagatcctcgtctctatcaccaccctccagacttctccctccaattcattcttcctccaggccatgcattgttctaaatggaaagccttccttgagtgggctgctagaaatgcaggtgtattcta

SEQ ID NO: 409170 - DNA, 347 bp, Homo sapiens
cttgctcctcagggtctccacagagctgcgctatcgaaaacagccctgggggttagtgaaaacgttcatcgagaagaacttctggagtgggctggaggactacttccgccatttagagagcgagctggccaaaacggagagcacttatttggctgagatgcacagacaatctcccaaagagaaggccagcaagactacaacggtgcggaggaggaagcgtccccatgcccacctgcgagtccctcacctggaagaggtgatgagcccggtcaccacgcccacagatgaggatgtgggccacaggatcaaacatgtggcaggtgtgtgccaggtggggacaggtcggg

SEQ ID NO: 409171 - DNA, 230 bp, Homo sapiens
atgagggctgaatacacctaccttattgttgggaggaataaataagatggtgaatgcaaagccctgcgacagtgcctggaacacagtaagcatggcagctcacagcttaccaagcacaaatttagtacggtggagaagcagttgtctttagaacactgtgcctcattattttgtttccctaaagtagaaagatttccttaagtaagacataaggcaaatattcaaaattt

SEQ ID NO: 409172 - DNA, 652 bp, Homo sapiens
  misc_feature (12)..(12): n is a, c, g, or t
  misc_feature (14)..(14): n is a, c, g, or t
  misc_feature (47)..(47): n is a, c, g, or t
ggaaaaaaaaananaaaaaaaagaagaaagatttgcaaaggagggcncctggaacactccatcaaagtactcgaactgatctccaccatctgggacacggaactgcacattgcgggcctcagactcctcaacaaccttccactgcccgactatgtgcatccacagctgcgacgggtgatgcctgccttgatggagatcctgcagtcagactacatcctggcacaggtgcaagccgtacgactgctgagctacctggcacagaagaatgaccttctctatgacattctcaactgccaggttcactccaacttcctaaacctgttccagcccacacagtcagggagtctcctgtatgaggtactggtgtttgctgagcggctgagtgagggccggaacgcaccccactaccacgtggtgaaatggcattacaacgaacagtccctgcatgaatccctctttggggaagagtcccgactggcagaccgactacttgccctggtcatccaccctgaggaagatgttcagatccaggcctgcaaggtcattgtcagcctgcagtatccccaggacttgagagcccggccctcctcctgccagcccagtcgttcctactttaaaaacacggaataaaattaaggagagccaataaatg

SEQ ID NO: 409173 - DNA, 1188 bp, Homo sapiens
agctctcacctgggcccagggcaacactgaagacatgggcaagagcatcccccaatacctggggcaactggacatccgcaaaagcgtagtcagcctggccacaggcgccggggcgatctacctgctctacaaggccatcaaggctggcataaaatgcaaaccacccctctgtagcaactcacccatctgcatcgcccgtgagtgtccgggccctggggagagggctctgccccaggaggcacctgctcccgaggcctctgctgtgggagggcccaaaggcctggcagtcgagcgagagcggcacgggcgggactcaggtgagctccggaggctcctcaactctttggagtgcaaacaggatgagtacgccaagagcatgatcctgcacagtatcactcgctgtgtgtacttgctggaggctgaggcctctgcttgtactacggatgacatcgtgttgctgggctacatgctggatgacaaggacaacagtgtcaaaacccaagctctgaatacacttaaagctttctctggcatcagaaaattcaggctcaaaatccaggaacactccatcaaagtactcgaactgatctccaccatctgggacacggaactgcacattgcgggcctcagactcctcaacaaccttccactgcccgactatgtgcatccacagctgcgacgggtgatgcctgccttgatggagatcctgcagtcagactacatcctggcacaggtgcaagccgtacgactgctgagctacctggcacagaagaatgaccttctctatgacattctcaactgccaggttcactccaacttcctaaacctgttccagcccacacagtcagggagtctcctgtatgaggtactggtgtttgctgagcggctgagtgagggccggaacgcaccccactaccacgtggtgaaatggcattacaacgaacagtccctgcatgaatccctctttggggaagagtcccgactggcagaccgactacttgccctggtcatccaccctgaggaagatgttcagatccaggcctgcaaggtcattgtcagcctgcagtatccccaggacttgagagcccggccctcctcctgccagcccagtcgttcctactttaaaaacacggaataaaattaaggagagccaataaatgagtataggagagaaacttgaaaaaaatt

SEQ ID NO: 409174 - DNA, 1315 bp, Homo sapiens
agctctcacctgggcccagggcaacactgaagacatgggcaagagcatcccccaatacctggggcaactggacatccgcaaaagcgtagtcagcctggccacaggcgccggggcgatctacctgctctacaaggccatcaaggctggcataaaatgcaaaccacccctctgtagcaactcacccatctgcatcgcccgtgagtgtccgggccctggggagagggctctgccccaggaggcacctgctcccgaggcctctgctgtgggagggcccaaaggcctggcagtcgagcgagagcggcacgggcgggactcaggtgagctccggaggctcctcaactctttggagtgcaaacaggatgagtacgccaagagcatgatcctgcacagtatcactcgctgtgtgtacttgctggaggctgaggcctctgcttgtactacggatgacatcgtgttgctgggctacatgctggatgacaaggacaacagtgtcaaaacccaagctctgaatacacttaaagctttctctggcatcagaaaattcaggctcaaaatccaggaacactccatcaaagtactcgaactgatctccaccatctgggacacggaactgcacattgcgggcctcagactcctcaacaaccttccactgcccgactatgtgcatccacagctgcgacgggtgatgcctgccttgatggagatcctgcagtcagactacatcctggcacaggtgcaagccgtacgactgctgagctacctggcacagaagaatgaccttctctatgacattctcaactgccaggttcactccaacttcctaaacctgttccagcccacacagtcagggagtctcctgtatgaggtactggtgtttgctgagcggctgagtgagggccggaacgcaccccactaccacgtggtgaaatggcattacaacgaacagtccctgcatgaatccctctttggggaagagtcccgactggcagaccgactacttgccctggtcatccaccctgaggaagatgttcagatccaggcctgcaaggtcattgtcagcctgcagtatccccaggacttgagagcccggccctcctcctgccagcccagtcgttcctactttaaaaacacggaataaaattaaggagagccaataaatgaaaaaataaatcctattaagtaagaatgttataatagctttgttggggaattgatagaggaaaataggagatccggcctcgttggcctaaggggtggagctttggggccgtttccttttagagagggtaaatcatgaacctggctcctgacctgc

SEQ ID NO: 409175 - DNA, 680 bp, Homo sapiens
  misc_feature (12)..(12): n is a, c, g, or t
  misc_feature (14)..(14): n is a, c, g, or t
  misc_feature (47)..(47): n is a, c, g, or t
ggaaaaaaaaananaaaaaaaagaagaaagatttgcaaaggagggcncctggaacactccatcaaagtactcgaactgatctccaccatctgggacacggaactgcacattgcgggcctcagactcctcaacaaccttccactgcccgactatgtgcatccacagctgcgacgggtgatgcctgccttgatggagatcctgcagtcagactacatcctggcacaggtgcaagccgtacgactgctgagctacctggcacagaagaatgaccttctctatgacattctcaactgccaggttcactccaacttcctaaacctgttccagcccacacagtcagggagtctcctgtatgaggtactggtgtttgctgagcggctgagtgagggccggaacgcaccccactaccacgtggtgaaatggcattacaacgaacagtccctgcatgaatccctctttggggaagagtcccgactggcagaccgactacttgccctggtcatccaccctgaggaagatgttcagatccaggcctgcaaggtcattgtcagcctgcagtatccccaggacttgagagcccggccctcctcctgccagcccagtcgttcctactttaaaaacacggaataaaattaaggagagccaataaatgagtataggagagaaacttgaaaaaaatt

SEQ ID NO: 409176 - DNA, 1107 bp, Homo sapiens
agctctcacctgggcccagggcaacactgaagacatgggcaagagcatcccccaatacctggggcaactggacatccgcaaaagcgtagtcagcctggccacaggcgccggggcgatctacctgctctacaaggccatcaaggctggcataaaatgcaaaccacccctctgtagcaactcacccatctgcatcgcccgcctggcagtcgagcgagagcggcacgggcgggactcaggtgagctccggaggctcctcaactctttggagtgcaaacaggatgagtacgccaagagcatgatcctgcacagtatcactcgctgtgtgtacttgctggaggctgaggcctctgcttgtactacggatgacatcgtgttgctgggctacatgctggatgacaaggacaacagtgtcaaaacccaagctctgaatacacttaaagctttctctggcatcagaaaattcaggctcaaaatccaggaacactccatcaaagtactcgaactgatctccaccatctgggacacggaactgcacattgcgggcctcagactcctcaacaaccttccactgcccgactatgtgcatccacagctgcgacgggtgatgcctgccttgatggagatcctgcagtcagactacatcctggcacaggtgcaagccgtacgactgctgagctacctggcacagaagaatgaccttctctatgacattctcaactgccaggttcactccaacttcctaaacctgttccagcccacacagtcagggagtctcctgtatgaggtactggtgtttgctgagcggctgagtgagggccggaacgcaccccactaccacgtggtgaaatggcattacaacgaacagtccctgcatgaatccctctttggggaagagtcccgactggcagaccgactacttgccctggtcatccaccctgaggaagatgttcagatccaggcctgcaaggtcattgtcagcctgcagtatccccaggacttgagagcccggccctcctcctgccagcccagtcgttcctactttaaaaacacggaataaaattaaggagagccaataaatgagtataggagagaaacttgaaaaaaatt

SEQ ID NO: 409177 - DNA, 1228 bp, Homo sapiens
agctctcacctgggcccagggcaacactgaagacatgggcaagagcatcccccaatacctggggcaactggacatccgcaaaagcgtagtcagcctggccacaggcgccggggcgatctacctgctctacaaggccatcaaggctggcataaaatgcaaaccacccctctgtagcaactcacccatctgcatcgcccgtgagtgtccgggccctggggagagggctctgccccaggaggcacctgctcccgaggcctctgctgtgggagggcccaaaggcctggcagtcgagcgagagcggcacgggcgggactcaggtgagctccggaggctcctcaactctttggagtgcaaacaggatgagtacgccaagagcatgatcctgcacagtatcactcgctgtgtgtacttgctggaggctgaggcctctgcttgtactacggatgacatcgtgttgctgggctacatgctggatgacaaggacaacagtgtcaaaacccaagctctgaatacacttaaagctttctctggcatcagaaaattcaggctcaaaatccaggaacactccatcaaagtactcgaactgatctccaccatctgggacacggaactgcacattgcgggcctcagactcctcaacaaccttccactgcccgactatgtgcatccacagctgcgacgggtgatgcctgccttgatggagatcctgcagtcagactacatcctggcacaggtgcaagccgtacgactgctgagctacctggcacagaagaatgaccttctctatgacattctcaactgccaggttcactccaacttcctaaacctgttccagcccacacagtcagggagtctcctgtatgaggtactggtgtttgctgagcggctgagtgagggccggaacgcaccccactaccacgtggtgaaatggcattacaacgaacagtccctgcatgaatccctctttggggaagagtcccgactggcagaccgactacttgccctggtcatccaccctgaggaagatgttcagatccaggcctgcaaggtcattgtcagcctgcagtatccccaggacttgagagcccggccctcctcctgccagcccagtcgttcctactttaaaaacacggaataaaattaaggagagccaataaatgaaatacataataaagtagctgcgcgcattaagtagggaagggacgagattcggccttgttggcctcaa

SEQ ID NO: 409178 - DNA, 711 bp, Homo sapiens
cacctaggtgggctggcaaccagccaccagtttccaactctttctccaacagggaagccgcaatgacacagccgactaggccctcggtcacctgtgaccagggatcctccacgatcggcgggaccgccgcccaggcgaccaccagttccagcgccacctcgggttcgaactaccagcgcgatagactcggccgccgcccagaaatcggcgtagggggtcagccgcagatctgctttccgcggccgaggtccgcgcagcagccggtgctgttcagcttaatgaattccagtgaagcagcgatgaaaaaaactttacccaagagccatttatctcgggtgattattcatgataaccgcatcacacaacgaatctatgagatggaggtgagcgctttagagaagaccaagaaaaagatcagccactactatgaacacctgaaaaaaaagttcatgacagagcagctcagaaagctcgggcgatggagagaggaatccgtgaacagcaaccggtacttaaccttcgggataccaccaccagtttaaactccagtctcccaagaaaggccaaccaccctagttctggcaaagggatctgccccagggtcacgatgacaccagtgtgacccgaggagaactagtaactacaacctacacaactgtagaacaataaacagaaaccagcagacagcggagcataataaatcctcagcaa

SEQ ID NO: 409179 - DNA, 113 bp, Homo sapiens
aaggaaacggagaaagcagaattcagctgtgttttaagatttattttatatataccttttgtcccttgtaaaaagaaaatttgaaaaagaagaagaaaaagaagaggagggtg

SEQ ID NO: 409180 - DNA, 1242 bp, Homo sapiens
ttctactcctccatagttaacttgctacgtacatgaagccagaatagactagttcatatatccaagagcagggctcctgaagggcatggactctagcttattacagacataccctggcatctagcacaatacctggcacataatagacagcagtctgcagcctggaagaggaccctcaccagaacctgaccatcttagcactgtgttttggacttccaggctccataactcctccatttagaaagggagcatgagaagcactgaaaagtaaggcactgtgatctacacggaaaccatatattgggctcacagctactgaatgagaccgactggtggagacagtttagtgaacctggtaaacactacacgtgaagagtggtgaaagggaacattgattactgaagtgccctggagagggaaagcactggtcaacatcacatggacaaatttcattgttttctaaagatggcctggaagtagtctttgccactgcttcctccacaaacagctcttcataacatgggctgcatgaaatcaaagcaaactttcccatttcctaccatatatgaaggtgagaagcagcatgagagtgaagaaccctttatgccagaagagagatgtctacctaggatggcttctccagttaatgtcaaagaggaagtgaaggaacctccagggaccaatattgtgatcttggaatatgcacaccgcctgtctcaggatatcttgtgtgatgccttgcagcaatgggcatgcaataacatcaagtaccatgacattccatacattgagagtgaggggccttgaggctgtaggatgacaacactttgactgtggaggtgctagtttgaataaatgtgacaaaagcaaaaactggtgtgaaaaagtacaaataactatctggatttaaaaatgtgtctacgataatgtcactattataagaacaactaggatgaaatgcattttaagtacttctatgttaacagcaatttctgtttagtcttagattttagtcatctgaagggctgaacagaggtcctgtgacacccaataatcagctgaatgtcacagcacttcttcctaagtaatggcatcaccaaagaaaatgctaaggaataaaaactgccccaaattccaatggttgaagtttatcctttaaaataacaatttttgtttgtttatacccaaaaaaagtccagatatgaaaagggcttttctaaaatttcttggcgagggaatggc

SEQ ID NO: 409181 - DNA, 688 bp, Homo sapiens
ctgccgcccgcccagacgccagcaagcccccctcccacgacagggctgctccgggagcttcggagacccgccccgggcctgagcgcaggctgcctccgggaccccacggctgtccggacgtgccatgggcgcgcagctgccgggcaacgtgttgtgtaagtgaacatctgggaggtaaacactacacgtgaagagtggtgaaagggaacattgattactgaagtgccctggagagggaaagcactggtcaacatcacatggacaaatttcattgttttctaaagatggcctggaagtagtctttgccactgcttcctccacaaacagctcttcataacatgggctgcatgaaatcaaagcaaactttcccatttcctaccatatatgaaggtgagaagcagcatgagagtgaagaaccctttatgccagaagagagatgtctacctaggatggcttctccagttaatgtcaaagaggaagtgaaggaacctccagggaccaatattgtgatcttggaatatgcacaccgcctgtctcaggatatcttgtgtgatgccttgcagcaatgggcatgcaataacatcaagtaccatgacattccatacattgagagtgaggggccttgaggctgtaggatgacaacactttgactgtggaggtgctagtttgaataaatgtgacaaaagca

SEQ ID NO: 409182 - DNA, 297 bp, Homo sapiens
gtgtctcaggttcatcctggactttccctgcttgagtcctggaatcgaccttttctccaaggagccttgttccttttagtggggaaaggtatttagaagctaagatcttggtgttggctgtgttcactacaattggtgtatctacttctccatcctccagcgtcctctggtgatcgagaatctgaagttccaggttttcataggccccagtgaccttgtcctcagaaggagaaagatcctctctcctttggtgttcccctcaactcccttaaataaaggactctattggtcctgccc

SEQ ID NO: 409183 - DNA, 2951 bp, Homo sapiens
ggcttacggtctccgggatacgggtgtacacagcagcggcgtcgcggcccgcagccccgcggcggcggaaaggtaaccgacccgccctggggtgctgcgtgcgctgcctgctcccgcctgaggaaaacactgcccatggcgcaaggccgggagcgcgacgaaggcccccactccgccggcggcgcgtccttgtccgtgagatgggtgcaaggattccctaagcagaatgttcattttgtcaacgacaacaccatttgctacccttgtgggaattatgtaatatttattaatattgaaaccaagaaaaagactgtactgcagtgtagtaatggaattgtgggcgtcatggcaactaacatcccctgtgaagttgtggctttttctgaccggaagctaaaacctctcatctacgtatacagctttccaggattgaccagaaggaccaaattgaaaggcaacattctcctggactacactttactttcattcagttactgtggcacctacctggctagttactcctctctcccagaatttgaactggccctttggaactgggaatcgagtatcattttgtgtaagaaatcacagcctggaatggatgtgaaccaaatgtcttttaaccccatgaactggcgccagctgtgcttatcaagtccaagtacagtgagcgtgtggaccattgaaagaagtaaccaggagcattgtttcagagcaaggtcggtgaaattacctctagaagatgggtcattttttaatgaaacggatgtcgttttcccccagtcgttgccgaaagatctcatctatggtcccgtgctgccactgtcagccattgccgggctggtaggcaaagaggcagagactttccggccgaaagatgatctatatcctttgcttcacccgactatgcattgctggactccaacaagtgacttgtacattggctgtgaagagggtcatcttttaatgattaatggagacaccttgcaagtgactgtacttaataagatagaagaggaatcgccattggaagacagaagaaattttatcagtccagtaaccttggtatatcagaaggagggcgtgctggcttctggaattgatggctttgtgtattcttttattattaaagatagaagttacatgatcgaggattttcttgagattgaaagacctgtagaacatatgacattttctcccaattatacagtgttgctgattcaaacagacaagggatctgtttatatctacacttttggtaaggagccaaccttaaataaagtcctagatgcttgtgatgggaaatttcaggcaattgactttatcacacctggaacccaatacttcatgacacttacatattcaggggaaatttgtgtttggtggctggaggattgtgcttgtgtaagcaagatttatctgaataccctagcaacggttctggcttgctgtccatcctccctctctgcagccgtgggcacggaggatggctcggtctacttcatcagcgtatatgataaggaatcccctcaggtcgtgcacaaggcctttctctcggaatcgtccgtgcagcacgtcgtgtaagtcctttctgcctccaggagcggctccgtgtcacacccgtctgttgaaaattctagtgaagccatcctttcttttaattttaagttttacgtgtttcatttgttttgaatgttaatatattcacacagttcaacactcaaaaggtacagagggctgtgtagtaaagtaccccccatacccaggtctgtccttgcaggcagcctggtaccaatttctcatgtctctcctgagatgttttatccatgaacaagcaaaacataataagcacttctttttacttgtatcaatggccatcatgtgtgtatagtgtgccaggcacttctgctgtattaactccatgaggtaaacactcttgttgtctctatttgacaggtgaggaagataaggcacaaggattttaaataacttgctcaatagtacacagatagtgaatggcaaatgttgggatttgaacccaggtagttgggctgcagagtcactgcctttgctcttaaaaggagaaaactatgtacaatgcctcatttcttttttcacttaatcgtatatcttggagaatgttttatatccacacataaagaccagcctgattatttgtatagccacatagtattccattatatgaatatactatcattttttaaaaacggtatattaatgaacatttagagtatttcaaaacttttgaagcaatacttttaagatgataatatagagacattagatttggacttgtaggtgctatcattattactgtttctttttaatttattatattattaggtattaataagaacagacatttgtattctgctttacagcttgagatcactgtagcttgtggcatgtgatcctcaaaacaccagtcagaaaggtgttattcttatccctattagacaaattagggaattcagggttagagaggtgaggaaaagcattgtccaagattacacattacacagctagcacactgaggagctggccctgccactgtggactgcccagctccaccaccctagctcagtggggaaggatggataacctccttccatttaccccctgcctttctgcactgtcatttttttgtgcctttcctttctcagatcctcttattctaatttacatcttcccactttttctaatttgataaagttgtagacatgtttcactacattcttcctcccactgccaggtaccagacacagggtaatgaaatgtcacacccaccactaatttgagaattgcttatttgcgcttgaaacatcaagaaagctctaccgacagacatgtttcattcacttatgatgaaccaactgcccatctttactgaatcttcttgactgtatttattaaagttgcaatttggaaat

SEQ ID NO: 409184 - DNA, 1701 bp, Homo sapiens
ggcttacggtctccgggatacgggtgtacacagcagcggcgtcgcggcccgcagccccgcggcggcggaaaggtaaccgacccgccctggggtgctgcgtgcgctgcctgctcccgcctgaggaaaacactgcccatggcgcaaggccgggagcgcgacgaaggcccccactccgccggcggcgcgtccttgtccgtgagatgggtgcaaggattccctaagcagaatgttcattttgtcaacgacaacaccatttgctacccttgtgggaattatgtaatatttattaatattgaaaccaagaaaaagactgtactgcagtgtagtaatggaattgtgggcgtcatggcaactaacatcccctgtgaagttgtggctttttctgaccggaagctaaaacctctcatctacgtatacagctttccaggattgaccagaaggaccaaattgaaaggcaacattctcctggactacactttactttcattcagttactgtggcacctacctggctagttactcctctctcccagaatttgaactggccctttggaactgggaatcgagtatcattttgtgtaagaaatcacagcctggaatggatgtgaaccaaatgtcttttaaccccatgaactggcgccagctgtgcttatcaagtccaagtacagtgagcgtgtggaccattgaaagaagtaaccaggagcattgtttcagagcaaggtcggtgaaattacctctagaagatgggtcattttttaatgaaacggatgtcgttttcccccagtcgttgccgaaagatctcatctatggtcccgtgctgccactgtcagccattgccgggctggtaggcaaagaggcagagactttccggccgaaagatgatctatatcctttgcttcacccgactatgcattgctggactccaacaagtgacttgtacattggctgtgaagagggtcatcttttaatgattaatggagacaccttgcaagtgactgtacttaataagatagaagaggaatcgccattggaagacagaagaaattttatcagtccagtaaccttggtatatcagaaggagggcgtgctggcttctggaattgatggctttgtgtattcttttattattaaagatagaagttacatgatcgaggattttcttgagattgaaagacctgtagaacatatgacattttctcccaattatacagtgttgctgattcaaacagacaagggatctgtttatatctacacttttggtaaggagccaaccttaaataaagtcctagatgcttgtgatgggaaatttcaggcaattgactttatcacacctggaacccaatacttcatgacacttacatattcaggggaaatttgtgtttggtggctggaggattgtgcttgtgtaagcaagatttatctgaataccctagcaacggttctggcttgctgtccatcctccctctctgcagccgtgggcacggaggatggctcggtctacttcatcagcgtatatgataaggaatcccctcaggtcgtgcacaaggcctttctctcggaatcgtccgtgcagcacgtcgtttatgatcagcaaggaatatttctgttagttggaacagcagaaggaaaagtctttattatcaatgccaactcctcaagctcatttcagattattggattcacaggtacaacatagaatgct

SEQ ID NO: 409185 - DNA, 1474 bp, Homo sapiens
ggcttacggtctccgggatacgggtgtacacagcagcggcgtcgcggcccgcagccccgcggcggcggaaaggtaaccgacccgccctggggtgctgcgtgcgctgcctgctcccgcctgaggaaaacactgcccatggcgcaaggccgggagcgcgacgaaggcccccactccgccggcggcgcgtccttgtccgtgagatgggtgcaaggattccctaagcagaatgttcattttgtcaacgacaacaccatttgctacccttgtgggaattatgtaatatttattaatattgaaaccaagaaaaagactgtactgcagtgtagtaatggaattgtgggcgtcatggcaactaacatcccctgtgaagttgtggctttttctgaccggaagctaaaacctctcatctacgtatacagctttccaggattgaccagaaggaccaaattgaaaggcaacattctcctggactacactttactttcattcagttactgtggcacctacctggctagttactcctctctcccagaatttgaactggccctttggaactgggaatcgagtatcattttgtgtaagaaatcacagcctggaatggatgtgaaccaaatgtcttttaaccccatgaactggcgccagctgtgcttatcaagtccaagtacagtgagcgtgtggaccattgaaagaagtaaccaggagcattgtttcagagcaaggtcggtgaaattacctctagaagatgggtcattttttaatgaaacggatgtcgttttcccccagtcgttgccgaaagatctcatctatggtcccgtgctgccactgtcagccattgccgggctggtaggcaaagaggcagagactttccggccgaaagatgatctatatcctttgcttcacccgactatgcattgctggactccaacaagtgacttgtacattggctgtgaagagggtcatcttttaatgattaatggagacaccttgcaagtgactgtacttaataagatagaagaggaatcgccattggaagacagaagaaattttatcagtccagtaaccttggtatatcagaaggagggcgtgctggcttctggaattgatggctttgtgtattcttttattattaaagatagaagttacatgatcgaggattttcttgagattgaaagacctgtagaacatatgacattttctcccaattatacagtgttgctgattcaaacagacaaggtatgttggatggtaatttcttgatatgtgattttcagatagtattattatcatcattacatgacaggaatgaggagcagagtatgctgcacagtggtactctacttgtcaagactctaggttgtaaatgaaaaaatacccaatttaaaaggcctaaattacaaagagctattggtttatttttgtgcatgtaactgaaagggcaaggagtgaatctgaataaaagagctatcatgatgcc

SEQ ID NO: 409186 - DNA, 1447 bp, Homo sapiens
ggcttacggtctccgggatacgggtgtacacagcagcggcgtcgcggcccgcagccccgcggcggcggaaaggtaaccgacccgccctggggtgctgcgtgcgctgcctgctcccgcctgaggaaaacactgcccatggcgcaaggccgggagcgcgacgaaggcccccactccgccggcggcgcgtccttgtccgtgaggcaacattctcctggactacactttactttcattcagttactgtggcacctacctggctagttactcctctctcccagaatttgaactggccctttggaactgggaatcgagtatcattttgtgtaagaaatcacagcctggaatggatgtgaaccaaatgtcttttaaccccatgaactggcgccagctgtgcttatcaagtccaagtacagtgagcgtgtggaccattgaaagaagtaaccaggagcattgtttcagagcaaggtcggtgaaattacctctagaagatgggtcattttttaatgaaacggatgtcgttttcccccagtcgttgccgaaagatctcatctatggtcccgtgctgccactgtcagccattgccgggctggtaggcaaagaggcagagactttccggccgaaagatgatctatatcctttgcttcacccgactatgcattgctggactccaacaagtgacttgtacattggctgtgaagagggtcatcttttaatgattaatggagacaccttgcaagtgactgtacttaataagatagaagaggaatcgccattggaagacagaagaaattttatcagtccagtaaccttggtatatcagaaggagggcgtgctggcttctggaattgatggctttgtgtattcttttattattaaagatagaagttacatgatcgaggattttcttgagattgaaagacctgtagaacatatgacattttctcccaattatacagtgttgctgattcaaacagacaagggatctgtttatatctacacttttggtaaggagccaaccttaaataaagtcctagatgcttgtgatgggaaatttcaggcaattgactttatcacacctggaacccaatacttcatgacacttacatattcaggggaaatttgtgtttggtggctggaggattgtgcttgtgtaagcaagatttatctgaataccctagcaacggttctggcttgctgtccatcctccctctctgcagccgtgggcacggaggatggctcggtctacttcatcagcgtatatgataaggaatcccctcaggtcgtgcacaaggcctttctctcggaatcgtccgtgcagcacgtcgtttatgatcagcaaggaatatttctgttagttggaacagcagaaggaaaagtctttattatcaatgccaactcctcaagctcatttcagattattggattcacaggtacaacatagaatgct

SEQ ID NO: 409187 - DNA, 1306 bp, Homo sapiens
ctcccccatcacacacaccaggccctgccaggacaaggcagctcctggaagctccaccaggacccacgtccaccaggcatctcgaacccttggcccccatggaccccctgaggcgctccccctctccctgcctgtcctcgcagccctccagccccagcaccccaccctgcgagatgcttggtcctgtgggcattgaggctgtgctggaccagctgaagatcaaggctatgaagatggggtttgagttcaacatcatggtggtggggcaaagcgggctgggcaagtccacgatggtgaacacgctgttcaagtccaaagtgtggaagtcaaacccaccgggcttgggggtgcccacaccccagacgctgcagctgcattcactgacccatgtcatagaggagaagggtgtgaagctgaagctgacggtgacggacacgcccggcttcggggaccagatcaacaatgacaactgctgggaccccatcctgggctacatcaacgagcaatacgagcagtacctgcaggaggagatcctcatcacccgccagcgccacatcccagacacccgggtgcactgctgcgtgtactttgtaccacccactgggcactgcctgcgggccctggacattgagttcctgcagcggctgtgccggactgtgaatgtggtgcccgtgattgccagggccgacagcctgaccatggaggagcgagaggccttcaggcgcaggatccagcagaacctgaggacccactgcatcgacgtctacccccagatgtgctttgacgaggacatcaatgacaaaatcctcaacagcaagttacgggaccgaatcccttttgccgtggtaggggctgaccaagagcacctggtgaacgggaggtgtgtcctgggccggaagaccaagtggggcatcattgaagtggagaacatggcgcactgtgaatttcctctcctgagagacctgcttatccgctcccacctccaagacctgaaggacataacccacaacatccactatgagaactaccgcgtcatcagactcaatgaaagccacctgctgccccgcgggcccggctgggtgaacctggccccggcctccccaggacagctgaccaccccccggaccttcaaggtctgcaggggggcccatgacgattctgatgatgagttctgaccaccggcggatcccggggctgctgggcttcctgagtccccagcggctctcaacacacacctatgtaccagagcatctattaaatgtgagccttgctttttatgaaaagctgtgctttgaaaacaaaaaca

SEQ ID NO: 409188 - DNA, 1092 bp, Homo sapiens
ctcccccatcacacacaccaggccctgccaggacaaggcagctcctggaagctccaccaggacccacgtccaccaggcatctcgaacccttggcccccatggaccccctgaggcgctccccctctccctgcctgtcctcgcagccctccagccccagcaccccaccctgcgagatgcttggtcctgtgggcattgaggctgtgctggaccagctgaagatcaaggctatgaagatggggtttgagttcaacatcatggtggtggggcaaagcgggctgggcaagtccacgatggtgaacacgctgttcaagtccaaagtgtggaagtcaaacccaccgggcttgggggtgcccacaccccagacgctgcagctgcattcactgacccatgtcatagaggagaagggtgtgaagctgaagctgacggtgacggacacgcccggcttcggggaccagatcaacaatgacaactgctgggaccccatcctgggctacatcaacgagcaatacgagcaatccagcagaacctgaggacccactgcatcgacgtctacccccagatgtgctttgacgaggacatcaatgacaaaatcctcaacagcaagttacgggaccgaatcccttttgccgtggtaggggctgaccaagagcacctggtgaacgggaggtgtgtcctgggccggaagaccaagtggggcatcattgaagtggagaacatggcgcactgtgaatttcctctcctgagagacctgcttatccgctcccacctccaagacctgaaggacataacccacaacatccactatgagaactaccgcgtcatcagactcaatgaaagccacctgctgccccgcgggcccggctgggtgaacctggccccggcctccccaggacagctgaccaccccccggaccttcaaggtctgcaggggggcccatgacgattctgatgatgagttctgaccaccggcggatcccggggctgctgggcttcctgagtccccagcggctctcaacacacacctatgtaccagagcatctattaaatgtgagccttgctttttatgaaaagctgtgctttgaaaacaaaaaca

SEQ ID NO: 409189 - DNA, 806 bp, Homo sapiens
cggcggttcaagactgatttttctatctcttcagtgcctctttcaacaatgaagatcaaaccaggttttgtgcaaatatctgctgagtgaactacttatttgaaaatacatcattggttaatattcccttttgctcactgaaatctcaaagactacagaccccgcacaagacattctgacattcccgtctttgaaatgaatgacagcaatgataaatatggctcacctccagagatacagatctcacaacttcatatttttaatataaattattaatctgaggtgtggtgcaattccattagatgaaagagatctacatattcagaagcacatgattcttcccccttccatgattccagtggccaatagaatggagtgtagtggcgtgatcttggctcacaacaacttctgcttcccacattcaagcgatcctcccaccttatactcctgagtagctggaaccacagacaaactacaataaagccatgccctgactggatgtgcctaacatttgtctggtgcttaaaggagttggctgcatgcatgggatggagaaggattcaacatttaatggcagttagaatcaaatttttaactcaagaaggcagaaggaatccacctaaataaatgttggaaagtcaccaaaaatagttctccaagtcagaagcggtgcaaaagctgcctcagctcttggtggattttcaatttctcccagccatctctgtttcgctaaaggtttctgaagacagtgggtatgtggcaaacttctgcaattctatattaagataaactgttagatcaataaa

SEQ ID NO: 409190 - DNA, 1344 bp, Homo sapiens
  misc_feature (751)..(751): n is a, c, g, or t
  misc_feature (753)..(753): n is a, c, g, or t
cggcggttcaagactgatttttctatctcttcagtgcctctttcaacaatgaagatcaaaccaggtactgaggtagtgggagtgctcatctagtttttggcttttagttttgtgcaaatatctgctgagtgaactacttatttgaaaatacatcattggttaatattcccttttgctcactgaaatctcaaagactacagaccccgcacaagacattctgacattcccgtctttgaaatgaatgacagcaatgataaatatggctcacctccagagatacagatctcacaacttcatatttttaatataaattattaatctgaggtgtggtgcaattccattagatgaaagagatctacatattcagaagcacatgattcttcccccttccatgattccagtggccaatagacaaactacaataaagccatgccctgactggatgtgcctaacatttgtctggtgcttaaaggagttggctgcatgcatgggatggagaaggattcaacatttaatggcagttagaatcaaatttttaactcaagaaggcagaaggaatccacctaaataaatgttggaaagtcaccaaaaatagttctccaagtcagaagcggtgcaaaagctgcctcagctcttggtggattttcaatttctcccagccatctctgtttcgctaaaggtttctgaagacagtggaatgctgttgaagacaccaccttgataaaacaaaaacatcagccaaattaaattnanaggagtttaattgagcaaagaattattcatgaatcaagcagtcttccaagccagagtaggctcaaatactccagcacagccacgtggtggaagatttatggacaaaagaagaaaagtaacatacagaaaatggaacatgaggggaagcttttttctcctccccatcctgatcactagtatgagaaggggtgctaatggaccagccttggccttgcagatgaagatgatgaaggaagaagatgtataaagaacctctgaaagagtcccagttttacatttcaaagtctttttccttctgttgtttattgtgttgggttggagtggaggatatttgatggagaattgattctgaaacttgccaaaatatggataatactttgctccttttccattgtgggttatcacaaagaagagtttcacttttagtcatctatttacagtctagaaacaggaacaaacccaaaccaagcagaaaaacagaaataaccaagatcaaaacggaactaaatgaaattgaaatgaaaaagtacaaagataaatgaaacaaaaacctggtttattgaaaagttaaataaaattgataattcaaaa

SEQ ID NO: 409191 - DNA, 876 bp, Homo sapiens
cggcggttcaagactgatttttctatctcttcagtgcctctttcaacaatgaagatcaaaccaggttttgtgcaaatatctgctgagtgaactacttatttgaaaatacatcattggttaatattcccttttgctcactgaaatctcaaagactacagaccccgcacaagacattctgacattcccgtctttgaaatgaatgacagcaatgataaatatggctcacctccagagatacagatctcacaacttcatatttttaatataaattattaatctgaggtgtggtgcaattccattagatgaaagagatctacatattcagaagcacatgattcttcccccttccatgattccagtggccaataggaattctaattggaacagacaaaaacccaatacatgtttaagcagtaaagtattcatcaggtcacaaaaagaggagcaagaggagctgactctttatgtcatatcttggccttgtaatttgattctttgccaacatgcatggtttttctccataggctgtgcattgggacaaactacaataaagccatgccctgactggatgtgcctaacatttgtctggtgcttaaaggagttggctgcatgcatgggatggagaaggattcaacatttaatggcagttagaatcaaatttttaactcaagaaggcagaaggaatccacctaaataaatgttggaaagtcaccaaaaatagttctccaagtcagaagcggtgcaaaagctgcctcagctcttggtggattttcaatttctcccagccatctctgtttcgctaaaggtttctgaagacagtgggtatgtggcaaacttctgcaattctatattaagataaactgttagatcaataaa

SEQ ID NO: 409192 - DNA, 1013 bp, Homo sapiens
  misc_feature (420)..(420): n is a, c, g, or t
  misc_feature (422)..(422): n is a, c, g, or t
cggcggttcaagactgatttttctatctcttcagtgcctctttcaacaatgaagatcaaaccaggttttgtgcaaatatctgctgagtgaactacttatttgaaaatacatcattggttaatattcccttttgctcactgaaatctcaaagactacagacaaactacaataaagccatgccctgactggatgtgcctaacatttgtctggtgcttaaaggagttggctgcatgcatggaaatgttggaaagtcaccaaaaatagttctccaagtcagaagcggtgcaaaagctgcctcagctcttggtggattttcaatttctcccagccatctctgtttcgctaaaggtttctgaagacagtggaatgctgttgaagacaccaccttgataaaacaaaaacatcagccaaattaaattnanaggagtttaattgagcaaagaattattcatgaatcaagcagtcttccaagccagagtaggctcaaatactccagcacagccacgtggtggaagatttatggacaaaagaagaaaagtaacatacagaaaatggaacatgaggggaagcttttttctcctccccatcctgatcactagtatgagaaggggtgctaatggaccagccttggccttgcagatgaagatgatgaaggaagaagatgtataaagaacctctgaaagagtcccagttttacatttcaaagtctttttccttctgttgtttattgtgttgggttggagtggaggatatttgatggagaattgattctgaaacttgccaaaatatggataatactttgctccttttccattgtgggttatcacaaagaagagtttcacttttagtcatctatttacagtctagaaacaggaacaaacccaaaccaagcagaaaaacagaaataaccaagatcaaaacggaactaaatgaaattgaaatgaaaaagtacaaagataaatgaaacaaaaacctggtttattgaaaagttaaataaaattgataattcaaaa

SEQ ID NO: 409193 - DNA, 708 bp, Homo sapiens
cggcggttcaagactgatttttctatctcttcagtgcctctttcaacaatgaagatcaaaccaggttttgtgcaaatatctgctgagtgaactacttatttgaaaatacatcattggttaatattcccttttgctcactgaaatctcaaagactacagaccccgcacaagacattctgacattcccgtctttgaaatgaatgacagcaatgataaatatggctcacctccagagatacagatctcacaacttcatatttttaatataaattattaatctgaggtgtggtgcaattccattagatgaaagagatctacatattcagaagcacatgattcttcccccttccatgattccagtggccaatagacaaactacaataaagccatgccctgactggatgtgcctaacatttgtctggtgcttaaaggagttggctgcatgcatgggatggagaaggattcaacatttaatggcagttagaatcaaatttttaactcaagaaggcagaaggaatccacctaaataaatgttggaaagtcaccaaaaatagttctccaagtcagaagcggtgcaaaagctgcctcagctcttggtggattttcaatttctcccagccatctctgtttcgctaaaggtttctgaagacagtgggtatgtggcaaacttctgcaattctatattaagataaactgttagatcaataaa

SEQ ID NO: 409194 - DNA, 557 bp, Homo sapiens
cggcggttcaagactgatttttctatctcttcagtgcctctttcaacaatgaagatcaaaccaggttttgtgcaaatatctgctgagtgaactacttatttgaaaatacatcattggttaatattcccttttgctcactgaaatctcaaagactacagaccccgcacaagacattctgacattcccgtctttgaaatgaatgacagcaatgataaatatggctcacctccagagatacagatctcacaacttcatatttttaatataaattattaatctgaggtgtggtgcaattccattagatgaaagagatctacatattcagaagcacatgattcttcccccttccatgattccagtggccaataggtaatcagaacttctctgttcagctaaaagacagaaaaagagcatatgaaagacgtattttcccagaagtgctcatcctgataactgtgtacagcactactgctcatattccattggccaatatttaggtagataacttcactaactacaaggtatgctgggaaataaagtccagatatgtgtgacat

SEQ ID NO: 409195 - DNA, 244 bp, Homo sapiens
ccattatggaaaattatatttatgttgaacataaataatcagatgtttgcttcactaatgatccagcttattttaaaattatgttactggatttaacgatgtgacctctgttctgcgactttgtgtattctggaggcttgttatgcatgtcaagggtatttccttttatttgttttaattttacctgccatttaaatcattgaatgacccttcataattgtattatgaaaccatataataagga

SEQ ID NO: 409196 - DNA, 712 bp, Homo sapiens
catcaagcaaagaacttgtaatacgctgaatgctgcatagaaggttttgaaactacttacctgctgtggaacacctgtataactttaaaatgcatcaatcaatctcgagagtatgatcatgcttcctgcttttaaggatctgaagttaactgcaactccaagtatacaagacttctttgggacccatggaagcatctctacatgctcatgtttgccagattcagtggcctcctgaaacctggccctagctaataagttaaaaagctctaagtaatcccgagctgcatttgaatctccaagatcacttgttcatgggttggtaatactttaaagagccatttgtttaactgctaatctggatcttatattctgagccccagcttttttctaaagcaaagaaaatacaaaataaaagtaagaccaaatgcctttgtaccatggagagagaaatgactcattggaatgcttctgtttttcatcacatcaaagatgcatcaacataaatcaaccattatatcatgcaccatgataaaaaagggggataaaagtccccaaaccactgccaattaaaccaacacagtgcctttgtattattcagaatttttatcttagccttattgaaagagcttttttagaacatatttaaacaattctgtcatatttcattcttgcatactcattaaaaaggaaaatatgagagatacaaatgaaa

SEQ ID NO: 409197 - DNA, 1679 bp, Homo sapiens
ggcagcggcgccgcgtccgctctcgcccgctctcgcccgctctcgcccgctcgccagccggctctcctcccgccgcagacccgcgcgccgcgctcgggggccatgcagcgcctggccatggacctgcggatgttgtcccgggagctctccctctacctggaacaccaagtccgggtggggttcttcggctcgggggtgggcttatcccttatcctgggcttcagcgtcgcttatgccttctactacctgagcagcattgccaagaaaccccagttagtgaccgggggtgagagtttcagccgcttccttcaagaccactgtcccgtggttacagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacagatgtgtggtttttaacaacagaggagtggcgggggagaatctcttgacgccaaggacttattgttgtgctaacactgaagacttggagacagttattcaccatgtacacagcctgtacccttctgctcctttcctggcagcaggggtttcaatgggagggtaaggttttccctttctaaaataatctctgagagggaagctattttattggctgtctctttgagaggactataagctagctgtatggacactttttaaataaatgtctgattatgtttatcatattttattaaatgcggttgattgaatgaacgaaggaaggaaagaattaattcaggtgaattttaatatttttcttaactacgggtctctgtgactgcggattttgtgagcctgaaggtttgtctgaagcccatgaagtcgattgcatcactcaccggctgccatgttgaccttctgattcctgacgcactcccagccatccctggagctgcgttctgaagctgaacttgtagcatgactttcatcactccagttacagaaataatcacttattgctctctccagctgcagtggccttcaaaattatttttccccaggtggtattctgtttagttttgttttgttgctgggcaaatggaactactgtggagtgctctcctagaaactgaaattttgttaaccccctactccagctgttattttaagcatacggatattgtcatttgtgctgcttgcaattactttggggcttatttggaactttcctatttaggcttatttctactaattgtttttggggttttttttttgggttgttctagtgatggtgagcttaaggaaatccaaaatttttattatcgggaattttactaagcttttagattcctgaagccattgtccaaaactagttttttaaatcagcaaatactgaagatagaaaatgatattttttcataattttataattggtttatctgtcatttcagtttttagaacatcttgaacatgaatcacttgaaaatgaatagcatttttctatagccagtggctgtgaaaaagaaaaaa

SEQ ID NO: 409198 - DNA, 1709 bp, Homo sapiens
ggcagcggcgccgcgtccgctctcgcccgctctcgcccgctctcgcccgctcgccagccggctctcctcccgccgcagacccgcgcgccgcgctcgggggccatgcagcgcctggccatggacctgcggatgttgtcccgggagctctccctctacctggaacaccaagtccgggtggggttcttcggctcgggggtgggcttatcccttatcctgggcttcagcgtcgcttatgccttctactacctgagcagcattgccaagaaaccccagttagtgaccgggggtgagagtttcagccgcttccttcaagaccactgtcccgtggttacagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacagatgtgtggtttttaacaacagaggagtggcgggggagaatctcttggtaagtaaatttaaatgacaacagtcttaaacgccaaggacttattgttgtgctaacactgaagacttggagacagttattcaccatgtacacagcctgtacccttctgctcctttcctggcagcaggggtttcaatgggagggtaaggttttccctttctaaaataatctctgagagggaagctattttattggctgtctctttgagaggactataagctagctgtatggacactttttaaataaatgtctgattatgtttatcatattttattaaatgcggttgattgaatgaacgaaggaaggaaagaattaattcaggtgaattttaatatttttcttaactacgggtctctgtgactgcggattttgtgagcctgaaggtttgtctgaagcccatgaagtcgattgcatcactcaccggctgccatgttgaccttctgattcctgacgcactcccagccatccctggagctgcgttctgaagctgaacttgtagcatgactttcatcactccagttacagaaataatcacttattgctctctccagctgcagtggccttcaaaattatttttccccaggtggtattctgtttagttttgttttgttgctgggcaaatggaactactgtggagtgctctcctagaaactgaaattttgttaaccccctactccagctgttattttaagcatacggatattgtcatttgtgctgcttgcaattactttggggcttatttggaactttcctatttaggcttatttctactaattgtttttggggttttttttttgggttgttctagtgatggtgagcttaaggaaatccaaaatttttattatcgggaattttactaagcttttagattcctgaagccattgtccaaaactagttttttaaatcagcaaatactgaagatagaaaatgatattttttcataattttataattggtttatctgtcatttcagtttttagaacatcttgaacatgaatcacttgaaaatgaatagcatttttctatagccagtggctgtgaaaaagaaaaaa

SEQ ID NO: 409199 - DNA, 1655 bp, Homo sapiens
ggcagcggcgccgcgtccgctctcgcccgctctcgcccgctctcgcccgctcgccagccggctctcctcccgccgcagacccgcgcgccgcgctcgggggccatgcagcgcctggccatggacctgcggatgttgtcccgggagctctccctctacctggaacaccaagtccgggtggggttcttcggctcgggggtgggcttatcccttatcctgggcttcagcgtcgcttatgccttctactacctgagcagcattgccaagaaaccccagttagtgaccgggggtgagagtttcagccgcttccttcaagaccactgtcccgtggttacagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacagatgtgtggtttttaacaacagaggagtggcgggggagaatctcttggtaagtaaatttaaatgacaacagtcttaaacgccaaggacttattgttgtgctaacactgaagacttggagacagttattcaccatgtacacagcctgtacccttctgctcctttcctggcagcaggggtttcaatgggagggtaaggttttcccttttataagctagctgtatggacactttttaaataaatgtctgattatgtttatcatattttattaaatgcggttgattgaatgaacgaaggaaggaaagaattaattcaggtgaattttaatatttttcttaactacgggtctctgtgactgcggattttgtgagcctgaaggtttgtctgaagcccatgaagtcgattgcatcactcaccggctgccatgttgaccttctgattcctgacgcactcccagccatccctggagctgcgttctgaagctgaacttgtagcatgactttcatcactccagttacagaaataatcacttattgctctctccagctgcagtggccttcaaaattatttttccccaggtggtattctgtttagttttgttttgttgctgggcaaatggaactactgtggagtgctctcctagaaactgaaattttgttaaccccctactccagctgttattttaagcatacggatattgtcatttgtgctgcttgcaattactttggggcttatttggaactttcctatttaggcttatttctactaattgtttttggggttttttttttgggttgttctagtgatggtgagcttaaggaaatccaaaatttttattatcgggaattttactaagcttttagattcctgaagccattgtccaaaactagttttttaaatcagcaaatactgaagatagaaaatgatattttttcataattttataattggtttatctgtcatttcagtttttagaacatcttgaacatgaatcacttgaaaatgaatagcatttttctatagccagtggctgtgaaaaagaaaaaa

SEQ ID NO: 409200 - DNA, 1495 bp, Homo sapiens
agctgtgatcatgccactgcaatctagcctgagtgacagtgcaagactctgtctttccaaaacaaacaaaaaaaaaggttattttgtctttgagggtacaggttgttttttgtttaatagaaagcacagttctctgctttttttcctaaactgctctggttaagttggagacacgtttgagtatggtactttgtttaattgaaggtatttgtattggtcttgccccatctgcatcaagccttccttgcatgttcatggtctttttgttagtgccaactctaactgtgctgactttaaatggcatgtatgtgcgctgcaagacaggaaaatgataaattattaatactacagtatgtgcaaacaaaggttattttctcatatgtatgactccttgctcctgtttacatttctgcattttacaaatcattaacctcacattgtaatttttgtgctttacttgtcactacttccagacgccaaggacttattgttgtgctaacactgaagacttggagacagttattcaccatgtacacagcctgtacccttctgctcctttcctggcagcaggggtttcaatgggagggtaaggttttccctttctaaaataatctctgagagggaagctattttattggctgtctctttgagaggactataagctagctgtatggacactttttaaataaatgtctgattatgtttatcatattttattaaatgcggttgattgaatgaacgaaggaaggaaagaattaattcaggtgaattttaatatttttcttaactacgggtctctgtgactgcggattttgtgagcctgaaggtttgtctgaagcccatgaagtcgattgcatcactcaccggctgccatgttgaccttctgattcctgacgcactcccagccatccctggagctgcgttctgaagctgaacttgtagcatgactttcatcactccagttacagaaataatcacttattgctctctccagctgcagtggccttcaaaattatttttccccaggtggtattctgtttagttttgttttgttgctgggcaaatggaactactgtggagtgctctcctagaaactgaaattttgttaaccccctactccagctgttattttaagcatacggatattgtcatttgtgctgcttgcaattactttggggcttatttggaactttcctatttaggcttatttctactaattgtttttggggttttttttttgggttgttctagtgatggtgagcttaaggaaatccaaaatttttattatcgggaattttactaagcttttagattcctgaagccattgtccaaaactagttttttaaatcagcaaatactgaagatagaaaatgatattttttcataattttataattggtttatctgtcatttcagtttttagaacatcttgaacatgaatcacttgaaaatgaatagcatttttctatagccagtggctgtgaaaaagaaaaaa

SEQ ID NO: 409201 - DNA, 1023 bp, Homo sapiens
  misc_feature (954)..(954): n is a, c, g, or t
ggcagcggcgccgcgtccgctctcgcccgctctcgcccgctctcgcccgctcgccagccggctctcctcccgccgcagacccgcgcgccgcgctcgggggccatgcagcgcctggccatggacctgcggatgttgtcccgggagctctccctctacctggaacaccaagtccgggtggggttcttcggctcgggggtgggcttatcccttatcctgggcttcagcgtcgcttatgccttctactacctgagcagcattgccaagaaaccccagttagtgaccgggggtgagagtttcagccgcttccttcaagaccactgtcccgtggttacagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacagatgtgtggtttttaacaacagaggagtggcgggggagaatctcttgacgccaaggacttattgttgtgctaacactgaagacttggagacagttattcaccatgtacacagcctgtacccttctgctcctttcctggcagcaggggtttcaatgggagggtaaggttttccctttaaattacttgggcaaaattgggtccaaaacgcctttgatggcagctgcaactttttccgttggttggaacaccttcgcttgctcagagtcattggaaaaaccactgaactggctactttttaattactatttgacaacctgccttcagtcttcagttaataagcaccngacatatggtaggtaaaacaaggtgatatggatcatgtctgaaggtaatcatcagagagtatgattaag

SEQ ID NO: 409202 - DNA, 769 bp, Homo sapiens
ggcagcggcgccgcgtccgctctcgcccgctctcgcccgctctcgcccgctcgccagccggctctcctcccgccgcagacccgcgcgccgcgctcgggggccatgcagcgcctggccatggacctgcggatgttgtcccgggagctctccctctacctggaacaccaagtccgggtggggttcttcggctcgggggtgggcttatcccttatcctgggcttcagcgtcgcttatgccttctactacctgagcagcattgccaagaaaccccagttagtgaccgggggtgagagtttcagccgcttccttcaagaccactgtcccgtggttacagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacagatgtgtggtttttaacaacagaggagtggcgggggagaatctcttgtgacttaggcactggaggaaatgaagatcaacacgatttcgaaagcaaaagttgcagagtgttatggtcttactcaagtgccttgtaataaatagcttgacgtgaaggttca

SEQ ID NO: 409203 - DNA, 782 bp, Homo sapiens
aaaaaaggaggctttataccctactaagggcttctaaaacagtacctatgagatctacttgaaaggtaattccaacacctctgccacatttgaatctggctttatttattgcttagtctcttaacagtgtttcctttatgtatcttttctgtttctatatatgtctggtaagttttactcaaaaagtgaactgtgtagagtagactaatatagaaagcaaaaccaacatgtgttcccttttactaggctgaatgtgtgtgttttgagggagaaggttgaatcaatctagtcaggagttgatttggttttgggtcttgttcctcttagagttaatttcagtgcaccataggtttcctgctcatctagcattactttgtgtttcggattggactggttcagcagcttttctcagtatctgctgtatcctcacctttaagtttcccttcaaattccgttcagtcccccagaagacactgctttgacctgttactcaacaattgttagcctagttgggagtggggatgaggatggagaagcatactctgtcattctgatgaagctcagtcacaggttgacactgtttctgggtcttcatggctggaaccttcttaatgatcctgtccaaacttcaggtgtacatctaaatcctccacatatttttttcctcttttttgttttcccatctccaaagttcaattagttttaccagtgtcccaagggcaatgatattccttatcttttcctttgtagttttaggttttgttacacgggagagacgggga

SEQ ID NO: 409204 - DNA, 1316 bp, Homo sapiens
acacctgcccacggcagcctgcctcgccctcaagcgcctcaaagcttcctaagcgcttacattggtcttgggacagccgactttggcttctttgtttgtttgagggaccgcggaagtggcggggaatgtgcccccgcttgagaccgcttattgtgagccctcaacggaaatcctgcacggaaggcaaccgcctccccgctcgcgttagaaggcttcatttgctctgagttatcattgagaactaaatggagaagaaaagaactgaaggcctgaagatatgtcatctgtagaaaagatggacatctgaaatcatcaaacccttgagagaaacagccctcattcttttatgagacaacctggaagaaaacaggactctgaagatttgtctccatattctctggaaagatgtactctgtttgcaataagagggagccacatggtttattagatggttattaattgagcattctgtgcaaagaagtttgtgccttagttatattgaaaagaagaaaatctctccagtttcagaaacactggccttttggatactgaggagttggaaatggaaaggggattttaatgagtttctcggcaatgaggctagagaaaatattatccatctccccctgttctccaattcagcagctcggactcctgttttcatcacagtcctgttagataattacagccccaaaggcctcctgttccttctttctgtgttccctgaatcttctttcccagagccaggacctcttggaaattctcagcctctgttagttgcccgctctgggagcccgactcctcacatccgtcatctctttcttctcccccttcacctgctgtagtgtccccactgtctctctttacctcagctccttaccattcctttccctctacacccttttcctttggttcatagtcaggatgtgctagttgcattcaagccctttttgatactaagaattcagggggacaaatccaaaccctggagactactgtcttccccttagtgatgctaatgaatataattcctgatctgaaattacctgcactttatttggctccatctacttttctgccacttactccctgtataaccataggctacgtaccctacctctctctgggttttttttactcctcagttaaaaggaggattaaaatggcaatcacaacaccttgctacagatacgttaggaagattaaatgggataacatgcagggtgcctagccttcctggcatatagtaaatgtctataaaatataacaagtgtcatgtattattattaaattgtatctacctggtagaaaaaaaa

SEQ ID NO: 409205 - DNA, 662 bp, Homo sapiens
acacctgcccacggcagcctgcctcgccctcaagcgcctcaaagcttcctaagcgcttacattggtcttgggacagccgactttggcttctttgtttgtttgagggaccgcggaagtggcggggaatgtgcccccgcttgagaccgcttattgtgagccctcaacggaaatcctgcacggaaggcaaccgcctccccgctcgcgttagaaggcttcatttgctctgagttatcattgagaactaaatggagaagaaaagaactgaaggcctgaagatatgtcatctgtagaaaagatggacatctgaaatcatcaaacccttgagagaaacagccctcattcttttatgagacaacctggaagaaaacaggactctgaagatttgtctccatattctctggaaagatgtactctgtttgcaataagagggagccacatggtttattagatggttattaattgagcattctgtgcaaagaagtttgtgccttagatttagaattccaccctcagttggaatacagatgatccctaacaagtcacatgaaaaaatgaattgtggagccagaagagtgagttcttggagaactaagggccagagacctgtgagcaagatttgataattttataaaaattaaaagacgatttgaaatgttaaaagt

SEQ ID NO: 409206 - DNA, 184 bp, Homo sapiens
aaaggtgagctgaacttttctctgtctgaacatactttgggtttacaatgagacatttacgtatttgtataaatcggttatactctgagctaatgtgaacacaaacttggtataaatacagatgactccctctctgctgctgtgggaggttcaactgacacctggggctcagaccagtcttgtt

SEQ ID NO: 409207 - DNA, 851 bp, Homo sapiens
acacctgcccacggcagcctgcctcgccctcaagcgcctcaaagcttcctaagcgcttacattggtcttgggacagccgactttggcttctttgtttgtttgagggaccgcggaagtggcggggaatgtgcccccgcttgagaccgcttattgtgagccctcaacggaaatcctgcacggaaggcaaccgcctccccgctcgcgttagaaggcttcatttgctctgagttatcattgagaactaaatggagaagaaaagaactgaaggcctgaagatatgtcatctgtagaaaagccccatccttctgcaggtggcctcttctcaagctttcttggcaaatcaagagcttctgccttttggaggacatcctcttgacctcccacccatatcagctcttagaggacattccacaggaacattgccttcttgtcctccagtattttttatggaaacagaaattaggttatcttccttatgctctagatggacatctgaaatcatcaaacccttgagagaaacagccctcattcttttatgagacaacctggaagaaaacaggactctgaagatttgtctccatattctctggaaagatgtactctgtttgcaataagagggagccacatggtttattagatggttattaattgagcattctgtgcaaagaagtttgtgccttagatttagaattccaccctcagttggaatacagatgatccctaacaagtcacatgaaaaaatgaattgtggagccagaagagtgagttcttggagaactaagggccagagacctgtgagcaagatttgataattttataaaaattaaaagacgatttgaaatgttaaaagt

SEQ ID NO: 409208 - DNA, 112 bp, Homo sapiens
tcaattttaaggtaagagtaaatggaaatgaaatattggtataatattctataccaattgtgtgcctcaaattgtacattaaggaaacaagaaaaacaacttcagtgtatga

SEQ ID NO: 409209 - DNA, 2506 bp, Homo sapiens
acgcagtgggcgtcttgcacgtgcagccgtttaagtcgcgtgggcgcctgcgagggcttgggagagcaagccgcggagagaacttgaagccaccatgggagatgaagattgggaagcagaaatcaaccctcatatgtcttcctatgttcccatatttgagaaggataggtattctggagaaaatggagacaattttaacaggactccagcttcatcatcagaaatggatgatggaccttctcgaagagatcatttcatgaaaagtggatttgcctctgggcggaattttggaaacagagatgctggtgagtgtaataagcgagataatacatccacaatgggtggttttggagttggaaagagttttggaaacagaggtttttcaaacagcaggtttgaagatggtgatagctctggtttctggagagagtctagtaatgactgcgaagataatccaacacggaacagagggttttccaagagaggcggctatcgagatggaaataattcagaagcttcagggccatacagaagaggtggaagaggtagtttccgaggttgccgtggaggatttggtctaggaagtccaaataatgacttagacccagacgaatgtatgcagcgcactggtggcctttttggttctagaagaccagtattaagtggcacaggtaatggtgatacttctcaaagcagaagtggcagtggaagtgaacgaggtggttacaaaggtttaaatgaagaagtaataacaggctctggaaagaattcttggaagtcagaagcagaaggaggagaaagtagtgatactcaaggaccaaaagtgacctacataccccctcctccacctgaggatgaggactccatctttgcacattatcagacaggcataaacttcgacaaatacgacactattcttgtggaagtgtctggacatgatgcaccaccagcaattctgacttttgaagaagctaatctctgtcagacactgaataacaacattgctaaagctggttatactaagcttactcctgtgcaaaaatacagtattcctatcatacttgcaggacgagatttgatggcttgcgctcaaacagggtctgggaagactgcggcttttctcctaccaattttggctcatatgatgcatgatggaataactgccagtcgttttaaagagttgcaggaaccagagtgtattattgtagcaccaactcgagaattggtcaaccagatttatttggaagccagaaaattttcttttgggacttgtgtaagagctgttgttatatatgggggaacccagctgggacattcaattcgacaaatagtacaaggctgtaatatattatgtgctactcctggaagactgatggatatcataggcaaagaaaagattggtctcaaacagatcaaatacttagttttggatgaagctgatcgcatgttggatatgggttttggtccagaaatgaagaagttaatttcttgcccaggaatgccatcaaaggaacagcgccaaacccttatgttcagtgcaacttttccagaggaaattcaaaggttggctgcagagtttttaaagtcaaattatctgtttgttgctgttggacaagtgggtggagcatgtagagatgttcagcagaccgttctccaagttggccagttctcaaaaagagaaaagctcgttgaaattctgcgaaacataggggatgaaagaactatggtctttgttgaaactaagaaaaaagcagattttattgcaacttttctttgtcaagaaaaaatatcaactacaagtattcatggtgatcgggaacagagagagcgggagcaagctcttggagattttcgctttggaaagtgcccagttcttgttgctacttcagtagctgccagagggctggatattgaaaatgtgcaacatgttatcaattttgatcttccttctaccattgatgaatatgttcatcgaattgggcgtactggtcgttgtgggaatactggcagagcaatttccttttttgatcttgaatcggataaccatttagcacagcctctagtaaaagtattgacagatgctcaacaggatgttcctgcatggttggaagaaattgcctttagtacatacattcctggcttcagtggtagtacaagaggaaacgtgtttgcatcagttgataccagaaagggcaagagcactttgaacacagctgggttttcttcttcacaagctcccaatccagtagatgatgagtcatgggattaaagccaaaacatccttcaagtctgtggttttgatgcagagaagaaaatagttttgatttttgagtttttaacagaagtataaaacttaacattctcatagctcctgtccttgtattctcactcctacacttaaaaaaaaaatccttactgactagttatgtgagatgctaaaacttacaacattgcagttactgatacaaatggtgttaactgggaatattaaagcattctaaatgtc

SEQ ID NO: 409210 - DNA, 636 bp, Homo sapiens
acgcagtgggcgtcttgcacgtgcagccgtttaagtcgcgtgggcgcctgcgagggcttgggagagcaagccgcggagagaacttgaagccaccatgggagatgaagattgggaagcagaaatcaaccctcatatgtcttcctatgttcccatatttgagaaggataggtattctggagaaaatggagacaattttaacaggactccagcttcatcatcagaaatggatgatggaccttctcgaagagatcatttcatgaaaagtggatttgcctctgggcggaattttggaaacagagatgctggtgagtgtaataagcgagataatacatccacaatgggtggttttggagttggaaagagttttggaaacagaggtttttcaaacagcaggtttgaagatggtgatagctctggtttctggagagagtctagtaatgactgcgaagataatccaacacggaacagagggttttccaagagaggcggtaaggaccacattttggaacaatttgtacttaacacagagacactaaactggtaaaactgattttgaaggagctggatgaaaaacactgatcgtgaaaacctttgaagaaaaatactttggtatatgttttctgcttttaatatttg

SEQ ID NO: 409211 - DNA, 2823 bp, Homo sapiens
acgcagtgggcgtcttgcacgtgcagccgtttaagtcgcgtgggcgcctgcgagggcttgggagagcaagccgcggagagaacttgaagccaccatgggagatgaagattgggaagcagaaatcaaccctcatatgtcttcctatgttcccatatttgagaaggataggtattctggagaaaatggagacaattttaacaggactccagcttcatcatcagaaatggatgatggaccttctcgaagagatcatttcatgaaaagtggatttgcctctgggcggaattttggaaacagagatgctggtgagtgtaataagcgagataatacatccacaatgggtggttttggagttggaaagagttttggaaacagaggtttttcaaacagcaggtttgaagatggtgatagctctggtttctggagagagtctagtaatgactgcgaagataatccaacacggaacagagggttttccaagagaggcgataatgacttagacccagacgaatgtatgcagcgcactggtggcctttttggttctagaagaccagtattaagtggcacaggtaatggtgatacttctcaaagcagaagtggcagtggaagtgaacgaggtggttacaaaggtttaaatgaagaagtaataacaggctctggaaagaattcttggaagtcagaagcagaaggaggagaaagtagtgatactcaaggaccaaaagtgacctacataccccctcctccacctgaggatgaggactccatctttgcacattatcagacaggcataaacttcgacaaatacgacactattcttgtggaagtgtctggacatgatgcaccaccagcaattctgacttttgaagaagctaatctctgtcagacactgaataacaacattgctaaagctggttatactaagcttactcctgtgcaaaaatacagtattcctatcatacttgcaggacgagatttgatggcttgcgctcaaacagggtctgggaagactgcggcttttctcctaccaattttggctcatatgatgcatgatggaataactgccagtcgttttaaagagttgcaggaaccagagtgtattattgtagcaccaactcgagaattggtcaaccagatttatttggaagccagaaaattttcttttgggacttgtgtaagagctgttgttatatatgggggaacccagctgggacattcaattcgacaaatagtacaaggctgtaatatattatgtgctactcctggaagactgatggatatcataggcaaagaaaagattggtctcaaacagatcaaatacttagttttggatgaagctgatcgcatgttggatatgggttttggtccagaaatgaagaagttaatttcttgcccaggaatgccatcaaaggaacagcgccaaacccttatgttcagtgcaacttttccagaggaaattcaaaggttggctgcagagtttttaaagtcaaattatctgtttgttgctgttggacaagtgggtggagcatgtagagatgttcagcagaccgttctccaagttggccagttctcaaaaagagaaaagctcgttgaaattctgcgaaacataggggatgaaagaactatggtctttgttgaaactaagaaaaaagcagattttattgcaacttttctttgtcaagaaaaaatatcaactacaagtattcatggtgatcgggaacagagagagcgggagcaagctcttggagattttcgctttggaaagtgcccagttcttgttgctacttcagtagctgccagagggctggatattgaaaatgtgcaacatgttatcaattttgatcttccttctaccattgatgaatatgttcatcgaattgggcgtactggtcgttgtgggaatactggcagagcaatttccttttttgatcttgaatcggataaccatttagcacagcctctagtaaaagtattgacagatgctcaacaggatgttcctgcatggttggaagaaattgcctttagtacatacattcctggcttcagtggtagtacaagaggaaacgtgtttgcatcagttgataccagaaagggcaagagcactttgaacacagctgggttttcttcttcacaagctcccaatccagtagatgatgagtcatgggattaaagccaaaacatccttcaagtctgtggttttgatgcagagaagaaaatagttttgatttttgagtttttaacagaagtataaaacttaacattctcatagctcctgtccttgtattctcactcctacacttaaaaaaaaaatccttactgactagttatgtgagatgctaaaacttacaacattgcagttactgatacaaatggtgttaactgggaatattaaagcattctaaatgtcaaaaaaaaaaaaaaaaaaaagaaaaaaaaaaaaaaaaaaaaaaaaaaaaaaaaaaaaaaaaaaaaaagaaaaaaacaaaacagaagagaggcacgcacaaaagaaacaacatacacgacaaggagcggcagagcaccacacacaaacagaaacacagacgaaacagaagaacgcagagagcgagcaagaacacgggatcgacagagcgacacagagcgagcccagacacaccccgccaggaggaggaggagagcacacggcaggacgcgagagaaggacaaggaacggaggaagggcggaggcacgaggagcagagcagaaccaggcagcgcgccgagggagggggagaaaacagcaagagaaaggcgaaagaaaaaacaacgaagaggaacaagacagaaggagcacaaaacgcaagc

SEQ ID NO: 409212 - DNA, 2865 bp, Homo sapiens
acgcagtgggcgtcttgcacgtgcagccgtttaagtcgcgtgggcgcctgcgagggcttgggagagcaagccgcggagagaacttgaagccaccatgggagatgaagattgggaagcagaaatcaaccctcatatgtcttcctatgttcccatatttgagaaggataggtattctggagaaaatggagacaattttaacaggactccagcttcatcatcagaaatggatgatggaccttctcgaagagatcatttcatgaaaagtggatttgcctctgggcggaattttggaaacagagatgctggtgagtgtaataagcgagataatacatccacaatgggtggttttggagttggaaagagttttggaaacagaggtttttcaaacagcaggtttgaagatggtgatagctctggtttctggagaggctatcgagatggaaataattcagaagcttcagggccatacagaagaggtggaagaggtagtttccgaggttgccgtggaggatttggtctaggaagtccaaataatgacttagacccagacgaatgtatgcagcgcactggtggcctttttggttctagaagaccagtattaagtggcacaggtaatggtgatacttctcaaagcagaagtggcagtggaagtgaacgaggtggttacaaaggtttaaatgaagaagtaataacaggctctggaaagaattcttggaagtcagaagcagaaggaggagaaagtagtgatactcaaggaccaaaagtgacctacataccccctcctccacctgaggatgaggactccatctttgcacattatcagacaggcataaacttcgacaaatacgacactattcttgtggaagtgtctggacatgatgcaccaccagcaattctgacttttgaagaagctaatctctgtcagacactgaataacaacattgctaaagctggttatactaagcttactcctgtgcaaaaatacagtattcctatcatacttgcaggacgagatttgatggcttgcgctcaaacagggtctgggaagactgcggcttttctcctaccaattttggctcatatgatgcatgatggaataactgccagtcgttttaaagagttgcaggaaccagagtgtattattgtagcaccaactcgagaattggtcaaccagatttatttggaagccagaaaattttcttttgggacttgtgtaagagctgttgttatatatgggggaacccagctgggacattcaattcgacaaatagtacaaggctgtaatatattatgtgctactcctggaagactgatggatatcataggcaaagaaaagattggtctcaaacagatcaaatacttagttttggatgaagctgatcgcatgttggatatgggttttggtccagaaatgaagaagttaatttcttgcccaggaatgccatcaaaggaacagcgccaaacccttatgttcagtgcaacttttccagaggaaattcaaaggttggctgcagagtttttaaagtcaaattatctgtttgttgctgttggacaagtgggtggagcatgtagagatgttcagcagaccgttctccaagttggccagttctcaaaaagagaaaagctcgttgaaattctgcgaaacataggggatgaaagaactatggtctttgttgaaactaagaaaaaagcagattttattgcaacttttctttgtcaagaaaaaatatcaactacaagtattcatggtgatcgggaacagagagagcgggagcaagctcttggagattttcgctttggaaagtgcccagttcttgttgctacttcagtagctgccagagggctggatattgaaaatgtgcaacatgttatcaattttgatcttccttctaccattgatgaatatgttcatcgaattgggcgtactggtcgttgtgggaatactggcagagcaatttccttttttgatcttgaatcggataaccatttagcacagcctctagtaaaagtattgacagatgctcaacaggatgttcctgcatggttggaagaaattgcctttagtacatacattcctggcttcagtggtagtacaagaggaaacgtgtttgcatcagttgataccagaaagggcaagagcactttgaacacagctgggttttcttcttcacaagctcccaatccagtagatgatgagtcatgggattaaagccaaaacatccttcaagtctgtggttttgatgcagagaagaaaatagttttgatttttgagtttttaacagaagtataaaacttaacattctcatagctcctgtccttgtattctcactcctacacttaaaaaaaaaatccttactgactagttatgtgagatgctaaaacttacaacattgcagttactgatacaaatggtgttaactgggaatattaaagcattctaaatgtcaaaaaaaaaaaaaaaaaaaagaaaaaaaaaaaaaaaaaaaaaaaaaaaaaaaaaaaaaaaaaaaaaagaaaaaaacaaaacagaagagaggcacgcacaaaagaaacaacatacacgacaaggagcggcagagcaccacacacaaacagaaacacagacgaaacagaagaacgcagagagcgagcaagaacacgggatcgacagagcgacacagagcgagcccagacacaccccgccaggaggaggaggagagcacacggcaggacgcgagagaaggacaaggaacggaggaagggcggaggcacgaggagcagagcagaaccaggcagcgcgccgagggagggggagaaaacagcaagagaaaggcgaaagaaaaaacaacgaagaggaacaagacagaaggagcacaaaacgcaagc

SEQ ID NO: 409213 - DNA, 391 bp, Homo sapiens
atattaaagcattctaaatgtctttcttatttctggtatattctttagggggcttagacatgtttaatgtttaaatgccaagtcttactatagtgtttattgatcttataaaacaagcaaataggatatgatacacttttggttaaaaattactgggtctcatttttacttgagtctttaaaacagtagtgtgtcactataatgtgataatctttaagagaaagtagaatacttaagcctttcaaagtgattttgatttttagatcatcagatgtatgatgaaaatggttaaatgtttgtgatgggagctctgtactcaatggcataacaatgtttatttttataatatacaatctttccttgaaataaaggatgaaacacttttccctta

SEQ ID NO: 409214 - DNA, 2446 bp, Homo sapiens
acgcagtgggcgtcttgcacgtgcagccgtttaagtcgcgtgggcgcctgcgagggcttgggagagcaagccgcggagagaacttgaagccaccatgggagatgaagattgggaagcagaaatcaaccctcatatgtcttcctatgttcccatatttgagaaggataggtattctggagaaaatggagacaattttaacaggactccagcttcatcatcagaaatggatgatggaccttctcgaagagatcatttcatgaaaagtggatttgcctctgggcggaattttggaaacagagatgctggtgagtgtaataagcgagataatacatccacaatgggtggttttggagttggaaagagttttggaaacagaggtttttcaaacagcaggtttgaagatggtgatagctctggtttctggagagagtctagtaatgactgcgaagataatccaacacggaacagagggttttccaagagaggcggctatcgagatggaaataattcagaagcttcagggccatacagaagaggtggaagaggtagtttccgaggttgccgtggaggatttggtctaggaagtccaaataatgacttagacccagacgaatgtatgcagcgcactggtggcctttttggttctagaagaccagtattaagtggcacaggtaatggtgatacttctcaaagcagaagtggcagtggaagtgaacgaggtggttacaaaggtttaaatgaagaagtaataacaggctctggaaagaattcttggaagtcagaagcagaaggaggagaaagtagtgatactcaaggaccaaaagtgacctacataccccctcctccacctgaggatgaggactccatctttgcacattatcagacaggcataaacttcgacaaatacgacactattcttgtggaagtgtctggacatgatgcaccaccagcaattctgacttttgaagaagctaatctctgtcagacactgaataacaacattgctaaagctggttatactaagcttactcctgtgcaaaaatacagtattcctatcatacttgcaggacgagatttgatggcttgcgctcaaacagggtctgggaagactgcggcttttctcctaccaattttggctcatatgatgcatgatggaataactgccagtcgttttaaagagttgcaggaaccagagtgtattattgtagcaccaactcgagaattggtcaaccagatttatttggaagccagaaaattttcttttgggacttgtgtaagagctgttgttatatatgggggaacccagctgggacattcaattcgacaaatagtacaaggctgtaatatattatgtgctactcctggaagactgatggatatcataggcaaagaaaagattggtctcaaacagatcaaatacttagttttggatgaagctgatcgcatgttggatatgggttttggtccagaaatgaagaagttaatttcttgcccaggaatgccatcaaaggaacagcgccaaacccttatgttcagtgcaacttttccagaggaaattcaaaggttggctgcagagtttttaaagtcaaattatctgtttgttgctgttggacaagtgggtggagcatgtagagatgttcagcagaccgttctccaagttggccagttctcaaaaagagaaaagctcgttgaaattctgcgaaacataggggatgaaagaactatggtctttgttgaaactaagaaaaaagcagattttattgcaacttttctttgtcaagaaaaaatatcaactacaagtattcatggtgatcgggaacagagagagcgggagcaagctcttggagattttcgctttggaaagtgcccagttcttgttgctacttcagtagctgccagagggctggatattgaaaatgtgcaacatgttatcaattttgatcttccttctaccattgatgaatatgttcatcgaattgggcgtactggtcgttgtgggaatactggcagagcaatttccttttttgatcttgaatcggataaccatttagcacagcctctagtaaaagtattgacagatgctcaacaggatgttcctgcatggttggaagaaattgcctttagtacatacattcctggcttcagtggtagtacaagaggaaacgtgtttgcatcagttgataccagaaagggcaagagcactttgaacacagctgggttttcttcttcacaagctcccaatccagtagatgatgagtcatgggattaaagccaaaacatccttcaagtctgtggttttgatgcagagaagaaaatagttttgatttttgagtttttaacagaagtataaaacttaacattctcatagctcctgtccttgtattctcactcctacattactgatacaaatggtgttaactgggaatattaaagcattctaaatgtc

SEQ ID NO: 409215 - DNA, 2925 bp, Homo sapiens
acgcagtgggcgtcttgcacgtgcagccgtttaagtcgcgtgggcgcctgcgagggcttgggagagcaagccgcggagagaacttgaagccaccatgggagatgaagattgggaagcagaaatcaaccctcatatgtcttcctatgttcccatatttgagaaggataggtattctggagaaaatggagacaattttaacaggactccagcttcatcatcagaaatggatgatggaccttctcgaagagatcatttcatgaaaagtggatttgcctctgggcggaattttggaaacagagatgctggtgagtgtaataagcgagataatacatccacaatgggtggttttggagttggaaagagttttggaaacagaggtttttcaaacagcaggtttgaagatggtgatagctctggtttctggagagagtctagtaatgactgcgaagataatccaacacggaacagagggttttccaagagaggcggctatcgagatggaaataattcagaagcttcagggccatacagaagaggtggaagaggtagtttccgaggttgccgtggaggatttggtctaggaagtccaaataatgacttagacccagacgaatgtatgcagcgcactggtggcctttttggttctagaagaccagtattaagtggcacaggtaatggtgatacttctcaaagcagaagtggcagtggaagtgaacgaggtggttacaaaggtttaaatgaagaagtaataacaggctctggaaagaattcttggaagtcagaagcagaaggaggagaaagtagtgatactcaaggaccaaaagtgacctacataccccctcctccacctgaggatgaggactccatctttgcacattatcagacaggcataaacttcgacaaatacgacactattcttgtggaagtgtctggacatgatgcaccaccagcaattctgacttttgaagaagctaatctctgtcagacactgaataacaacattgctaaagctggttatactaagcttactcctgtgcaaaaatacagtattcctatcatacttgcaggacgagatttgatggcttgcgctcaaacagggtctgggaagactgcggcttttctcctaccaattttggctcatatgatgcatgatggaataactgccagtcgttttaaagagttgcaggaaccagagtgtattattgtagcaccaactcgagaattggtcaaccagatttatttggaagccagaaaattttcttttgggacttgtgtaagagctgttgttatatatgggggaacccagctgggacattcaattcgacaaatagtacaaggctgtaatatattatgtgctactcctggaagactgatggatatcataggcaaagaaaagattggtctcaaacagatcaaatacttagttttggatgaagctgatcgcatgttggatatgggttttggtccagaaatgaagaagttaatttcttgcccaggaatgccatcaaaggaacagcgccaaacccttatgttcagtgcaacttttccagaggaaattcaaaggttggctgcagagtttttaaagtcaaattatctgtttgttgctgttggacaagtgggtggagcatgtagagatgttcagcagaccgttctccaagttggccagttctcaaaaagagaaaagctcgttgaaattctgcgaaacataggggatgaaagaactatggtctttgttgaaactaagaaaaaagcagattttattgcaacttttctttgtcaagaaaaaatatcaactacaagtattcatggtgatcgggaacagagagagcgggagcaagctcttggagattttcgctttggaaagtgcccagttcttgttgctacttcagtagctgccagagggctggatattgaaaatgtgcaacatgttatcaattttgatcttccttctaccattgatgaatatgttcatcgaattgggcgtactggtcgttgtgggaatactggcagagcaatttccttttttgatcttgaatcggataaccatttagcacagcctctagtaaaagtattgacagatgctcaacaggatgttcctgcatggttggaagaaattgcctttagtacatacattcctggcttcagtggtagtacaagaggaaacgtgtttgcatcagttgataccagaaagggcaagagcactttgaacacagctgggttttcttcttcacaagctcccaatccagtagatgatgagtcatgggattaaagccaaaacatccttcaagtctgtggttttgatgcagagaagaaaatagttttgatttttgagtttttaacagaagtataaaacttaacattctcatagctcctgtccttgtattctcactcctacacttaaaaaaaaaatccttactgactagttatgtgagatgctaaaacttacaacattgcagttactgatacaaatggtgttaactgggaatattaaagcattctaaatgtcaaaaaaaaaaaaaaaaaaaagaaaaaaaaaaaaaaaaaaaaaaaaaaaaaaaaaaaaaaaaaaaaaagaaaaaaacaaaacagaagagaggcacgcacaaaagaaacaacatacacgacaaggagcggcagagcaccacacacaaacagaaacacagacgaaacagaagaacgcagagagcgagcaagaacacgggatcgacagagcgacacagagcgagcccagacacaccccgccaggaggaggaggagagcacacggcaggacgcgagagaaggacaaggaacggaggaagggcggaggcacgaggagcagagcagaaccaggcagcgcgccgagggagggggagaaaacagcaagagaaaggcgaaagaaaaaacaacgaagaggaacaagacagaaggagcacaaaacgcaagc

SEQ ID NO: 409216 - DNA, 2847 bp, Homo sapiens
acgcagtgggcgtcttgcacgtgcagccgtttaagtcgcgtgggcgcctgcgagggcttgggagagcaagccgcggagagaacttgaagccaccatgggagatgaagattgggaagcagaaatcaaccctcatatgtcttcctatgttcccatatttgagaaggataggtattctggagaaaatggagacaattttaacaggactccagcttcatcatcagaaatggatgatggaccttctcgaagagatcatttcatgaaaagtggatttgcctctgggcggaattttggaaacagaggtttttcaaacagcaggtttgaagatggtgatagctctggtttctggagagagtctagtaatgactgcgaagataatccaacacggaacagagggttttccaagagaggcggctatcgagatggaaataattcagaagcttcagggccatacagaagaggtggaagaggtagtttccgaggttgccgtggaggatttggtctaggaagtccaaataatgacttagacccagacgaatgtatgcagcgcactggtggcctttttggttctagaagaccagtattaagtggcacaggtaatggtgatacttctcaaagcagaagtggcagtggaagtgaacgaggtggttacaaaggtttaaatgaagaagtaataacaggctctggaaagaattcttggaagtcagaagcagaaggaggagaaagtagtgatactcaaggaccaaaagtgacctacataccccctcctccacctgaggatgaggactccatctttgcacattatcagacaggcataaacttcgacaaatacgacactattcttgtggaagtgtctggacatgatgcaccaccagcaattctgacttttgaagaagctaatctctgtcagacactgaataacaacattgctaaagctggttatactaagcttactcctgtgcaaaaatacagtattcctatcatacttgcaggacgagatttgatggcttgcgctcaaacagggtctgggaagactgcggcttttctcctaccaattttggctcatatgatgcatgatggaataactgccagtcgttttaaagagttgcaggaaccagagtgtattattgtagcaccaactcgagaattggtcaaccagatttatttggaagccagaaaattttcttttgggacttgtgtaagagctgttgttatatatgggggaacccagctgggacattcaattcgacaaatagtacaaggctgtaatatattatgtgctactcctggaagactgatggatatcataggcaaagaaaagattggtctcaaacagatcaaatacttagttttggatgaagctgatcgcatgttggatatgggttttggtccagaaatgaagaagttaatttcttgcccaggaatgccatcaaaggaacagcgccaaacccttatgttcagtgcaacttttccagaggaaattcaaaggttggctgcagagtttttaaagtcaaattatctgtttgttgctgttggacaagtgggtggagcatgtagagatgttcagcagaccgttctccaagttggccagttctcaaaaagagaaaagctcgttgaaattctgcgaaacataggggatgaaagaactatggtctttgttgaaactaagaaaaaagcagattttattgcaacttttctttgtcaagaaaaaatatcaactacaagtattcatggtgatcgggaacagagagagcgggagcaagctcttggagattttcgctttggaaagtgcccagttcttgttgctacttcagtagctgccagagggctggatattgaaaatgtgcaacatgttatcaattttgatcttccttctaccattgatgaatatgttcatcgaattgggcgtactggtcgttgtgggaatactggcagagcaatttccttttttgatcttgaatcggataaccatttagcacagcctctagtaaaagtattgacagatgctcaacaggatgttcctgcatggttggaagaaattgcctttagtacatacattcctggcttcagtggtagtacaagaggaaacgtgtttgcatcagttgataccagaaagggcaagagcactttgaacacagctgggttttcttcttcacaagctcccaatccagtagatgatgagtcatgggattaaagccaaaacatccttcaagtctgtggttttgatgcagagaagaaaatagttttgatttttgagtttttaacagaagtataaaacttaacattctcatagctcctgtccttgtattctcactcctacacttaaaaaaaaaatccttactgactagttatgtgagatgctaaaacttacaacattgcagttactgatacaaatggtgttaactgggaatattaaagcattctaaatgtcaaaaaaaaaaaaaaaaaaaagaaaaaaaaaaaaaaaaaaaaaaaaaaaaaaaaaaaaaaaaaaaaaagaaaaaaacaaaacagaagagaggcacgcacaaaagaaacaacatacacgacaaggagcggcagagcaccacacacaaacagaaacacagacgaaacagaagaacgcagagagcgagcaagaacacgggatcgacagagcgacacagagcgagcccagacacaccccgccaggaggaggaggagagcacacggcaggacgcgagagaaggacaaggaacggaggaagggcggaggcacgaggagcagagcagaaccaggcagcgcgccgagggagggggagaaaacagcaagagaaaggcgaaagaaaaaacaacgaagaggaacaagacagaaggagcacaaaacgcaagc

SEQ ID NO: 409217 - DNA, 481 bp, Homo sapiens
aatttaaccagttccctactggtggatgtctaggtttccccgatgttttgctattaaaaacacacatggtacacgtttttctagatcgggcagggtttgcccatctccacttcaagcagcacaaccaccatctgccagtgttggggtttactctacagtcagcaaacactgttggcacatccagtcagagaaactgaaaacagaaagcagaaatggcttacactggactaattttagaatttctaagtacatttaagtgatgactcatcccacttaaattcaaagctgtttgttgtgccatctggctcatcagaacatgaaagacttctcctgcaacctggaaaaaggccagagaggaagacgaatggaggagtcaaccccatgggaatgctgactgagtgttagctccccgtggacaggaatgtcactgcatgaataggctgcagtatgtctgggcctgtttttttttcataaaatgttc

SEQ ID NO: 409218 - DNA, 300 bp, Homo sapiens
catgcatccatttttattggcttgttcataaatgttaactatgctttgttctttagcgctgaaagtaagcactaatgctacccaacaggagtgaaatttttagaaggtgctcttatcaagaatagttggttaagaaaagaaaatctgggttcccagacctgggctcagatccaactctgcaacttagtagaaagtttcttaagctttctaaacctcagctgtttcatttctaaaaggggattgttctaagaattaaatataaacttcttacctcatttcttggtactcatttttttctgg

SEQ ID NO: 409219 - DNA, 283 bp, Homo sapiens
tttaattttaagaatatagtttgacatgaatatttatagggaaatacttagatttatggggaatattgtagggaaaaaatatttctaagcttgggtgtgatcaccgatccaactacataaaaatttgaaaagcacaaagaacattacatcttgggaaatgattgcagtaaatataaaaataaaaatgttgtaaagtattatatgaaaagaaaagcacaataccttagtgaatgagaagaactctaaaaagcacttgataaatgcatacacaaaatgaagaccg

SEQ ID NO: 409220 - DNA, 520 bp, Homo sapiens
caggcccctcttgattcaattttagtccatgcctttccatgtatttaaattatataagtgttggccaggtgtggtggctcacacctgtaatcccagcacttcgggaggctgaggcaggaggatcacttgagcccaggagttcgaaccaaccttgggcagcatagtgagaccccttctcttaataattttttttgaaaataattttttaaaaattacaaatatggaccagacacctgggaggattacctcacgcctgtaatcccagcactttgggaggctgaggtgggtggatcacctgaggtcaggagtttgagactatcctggccaacatggtgaaaccctgtctctactaaaaatacaaaaattagccagatgtggtggtgggtacctgtaatcccagctactcgggaggctgagacaggagaatcacttgaacctgggaggcggaggttgcagtgagctgagatcacgtcattgcactccagcctgggtgactacagtgagactccctctcaaaaaa

SEQ ID NO: 409221 - DNA, 968 bp, Homo sapiens
agcgggcgctgtcagaaccggattgggccgcggcggggacggaagcggcccctgggcccgaggggctggagccgggccggggcgatgtggagcgcgggccgcggcggggctgcctggccggtgctgttggggctgctgctggcgctgttagtgccgggcggtggtgccgccaagaccggtgcggagctcgtgacctgcgggtcggtgctgaagctgctcaatacgcaccaccgcgtgcggctgcactcgcacgacatcaaatacggatccggcagcggccagcaatcggtgaccggcgtagaggcgtcggacgacgccaatagctactggcggatccgcggcggctcggagggcgggtgcccgcgcgggtccccggtgcgctgcgggcaggcggtgaggctcacgcatgtgcttacgggcaagaacctgcacacgcaccacttcccgtcgccgctgtccaacaaccaggaggtgagtgcctttggggaagacggcgagggcgacgacctggacctatggacagtgcgctgctctggacagcactgggagcgtgaggctgctgtgcgcttccagcatgtgggcacctctgtgttcctgtcagtcacgggtgagcagtatggaagccccatccgtgggcagcatgaggtccacggcatgcccagtgccaacacgcacaatacgtggaaggccatggaaggcatcttcatcaagcctagtgtggagccctctgcaggtcacgatgaactctgagtgtgtggatggatgggtggatggagggtggcaggtggggcgtctgcagggccactcttggcagagactttgggtttgtaggggtcctcaagtgcctttgtgattaaagaatgttggtctatgattgcgtttcactgtgagcctgaggatgaccaggaggtgccagcccaggcccagttgatcatttcttccccagtgcaaaacctgtctccagccca

SEQ ID NO: 409222 - DNA, 907 bp, Homo sapiens
agcgggcgctgtcagaaccggattgggccgcggcggggacggaagcggcccctgggcccgaggggctggagccgggccggggcgatgtggagcgcgggccgcggcggggctgcctggccggtgctgttggggctgctgctggcgctgttagtgccgggcggtggtgccgccaagaccggtgcggagctcgtgacctgcgggtcggtgctgaagctgctcaatacgcaccaccgcgtgcggctgcactcgcacgacatcaaatacggatccggcagcggccagcaatcggtgaccggcgtagaggcgtcggacgacgccaatagctactggcggatccgcggcggctcggagggcgggtgcccgcgcgggtccccggtgcgctgcgggcaggcggtgaggctcacgcatgtgcttacgggcaagaacctgcacacgcaccacttcccgtcgccgctgtccaacaaccaggaggtgagtgcctttggggaagacggcgagggcgacgacctggacctatggacagtgcgctgctctggacagcactgggagcgtgaggctgctgtgcgcttccagcatgtgggcacctctgtgttcctgtcagtcacgggtgagcagtatggaagccccatccgtgggcagcatgaggtccacggcatgcccagtgccaacacgcacaatacgtggaaggccatggaagatggatgggtggatggagggtggcaggtggggcgtctgcagggccactcttggcagagactttgggtttgtaggggtcctcaagtgcctttgtgattaaagaatgttggtctatgattgcgtttcactgtgagcctgaggatgaccaggaggtgccagcccaggcccagttgatcatttcttccccagtgcaaaacctgtctccagccca

SEQ ID NO: 409223 - DNA, 305 bp, Homo sapiens
ttcaagcttctaacgatgtacggggacatggaaggcatcttcatcaagcctagtgtggagccctctgcaggtcacgatgaactctgagtgtgtggatggatgggtggatggagggtggcaggtggggcgtctgcagggccactcttggcagagactttgggtttgtaggggtcctcaagtgcctttgtgattaaagaatgttggtctatgattgcgtttcactgtgagcctgaggatgaccaggaggtgccagcccaggcccagttgatcatttcttccccagtgcaaaacctgtctccagccca

SEQ ID NO: 409224 - DNA, 1194 bp, Homo sapiens
agcgggcgctgtcagaaccggattgggccgcggcggggacggaagcggcccctgggcccgaggggctggagccgggccggggcgatgtggagcgcgggccgcggcggggctgcctggccggtgctgttggggctgctgctggcgctgttagtgccgggcggtggtgccgccaagaccggtgcggagctcgtgacctgcgggtcggtgctgaagctgctcaatacgcaccaccgcgtgcggctgcactcgcacgacatcaaatacggatccggcagcggccagcaatcggtgaccggcgtagaggcgtcggacgacgccaatagctactggcggatccgcggcggctcggagggcgggtgcccgcgcgggtccccggtgcgctgcgggcaggcggtgaggctcacgcatgtgcttacgggcaagaacctgcacacgcaccacttcccgtcgccgctgtccaacaaccaggaggtgagtgcctttggggaagacggcgagggcgacgacctggacctatggacagtgcgctgctctggacagcactgggagcgtgaggctgctgtgcgcttccagcatgtgggcacctctgtgttcctgtcagtcacgggtgagcagtatggaagccccatccgtgggcagcatgaggtccacggcatgcccagtgccaacacgcacaatacgtggaaggccatggaaggcatcttcatcaagcctagtgtggagccctctgcaggtcacgatgaactctgagtgtgtggatggatgggtggatggagggtggcaggtggggcgtctgcagggccactcttggcagagactttgggtttgtaggggtcctcaagtgcctttgtgattaaagaatgttgaaaaaaaaaaaaaaaaaaaaaaaaaaaaaatgttgtgtggggcgggctgtggggccgctggagaaagagtttttttagaaaccattgcgttggggcggcggcggggcccagtgggtcattgcagaaactggggccaaaggcgtggtggcccaagagaaacccggggccatgacatcaggtggcggggagtctcccccagcaatgtaaaaaaaccggccggggggggcacacgaggcgtgttctggaaacaaatcccaagagggcggccgaagcgggccatcacggggccctatacacgagggagcccaaggcgcgtccgatctcaatg

SEQ ID NO: 409225 - DNA, 583 bp, Homo sapiens
ctgccctcatctccagggccttgacctcactggactgtgactgtcctcaggacacctgcccctcctcacctaacggactgcagggctgagcatgtgtctgaggtcacactctctgcccactcacctccttggctgacatcggttgtgtttggtgctgacactctgatcccgaagccagggagccccaaggggctgcatgaccctggggtgccccacacagttcagccctgcctggcagggacgccagtactactgtaactgcagcaggagctgcccggcctgccttctggccccacgcccacaggcgtagtcgcatcttcatcaagcctagtgtggagccctctgcaggtcacgatgaactctgagtgtgtggatggatgggtggatggagggtggcaggtggggcgtctgcagggccactcttggcagagactttgggtttgtaggggtcctcaagtgcctttgtgattaaagaatgttggtctatgattgcgtttcactgtgagcctgaggatgaccaggaggtgccagcccaggcccagttgatcatttcttccccagtgcaaaacctgtctccagccca

SEQ ID NO: 409226 - DNA, 273 bp, Homo sapiens
caatcttgaaaaagaggaacaaagtcggaggagtcacagttccttatttattttatttattcatgtttttattgttattgagatggagtctcactctgtcgcccaggctggagtgcagtggtgcaagctcagctcagtacaacctccgcctcccaggttcaagtgattgttctgcctcagcctcccaagtagccgggattatatgcatgcgccaccacacctggctaatttttatatttttagtagagatagggtttcgccatgttgggtgtt

SEQ ID NO: 409227 - DNA, 156 bp, Homo sapiens
cgtggggggggtgtaagttggtggggaaagaggccagtggagtcagaaaggtggggccttgaaggcggctgagtttgggcatgatactgtagattttaggaaaggtgaaagagttagaagcaagggaaagggtaacttaagcagatctatgccttg

SEQ ID NO: 409228 - DNA, 296 bp, Homo sapiens
ccaagaggaaggcacaattccattcatgagggatccacctctgtggtccaaataccttccattagaccccatctccaacactgaggatcaagttttaccatgaggtttagggggacaaacagtccaaactatagcaagtgtgttgtctgttatcttctttaaaccattggttgtctacagtgaattgttcaatttccacacatttgtgaattttctggtttcccttcattactaatttttagtttcatttcattgtggtcagaaaagatatttcatatgatttcagtcttttaaaa

SEQ ID NO: 409229 - DNA, 260 bp, Homo sapiens
agagaatcaaagtcactctaagaactgaggaaagctttttgtatcatgcttttttaaacagctgagttatggacagaatctaatcttttctaatccgttataccttttgaaatgtacaaatctgtcattttaggagatttttttgaggattttcctttatggatatcaaccataatatgtactatataccttattttagttattactctgtgtacatatttcactctttcattattcaaaagcactgttgataaagtggt

SEQ ID NO: 409230 - DNA, 339 bp, Homo sapiens
aggaaaaataactttaagaaaaaactagaacctcgaaggagaaattttagatttttggtccatgttaatatgcatcagatttgtatcaaaatggtatggatggtcccctgacatgaaagtaggcaaaatggagactttattttctagactgaactatttctatactggaagaaaacgtgtattccaaggctactaagtgcttgaataaggactagtcatataaaatttgtctcacttttctcaactgtacattgtaagaatttacagagagacatcttgaagaccatcaacactagcggtttactttgtaatgaaaattggcatgagggggaagtaagg

SEQ ID NO: 409231 - DNA, 267 bp, Homo sapiens
gaaacctgaatattgagaaggaactagccatgcagaatatttgcaggagaactcttaaaaaggtggaagccaggtgcggctgtttctatgaaaaagaaaagcatgactcattggcccttaaatcacactaattgttttgtatttgatgcaagaaacaagatccatgttttgtttttggattcaataatgccatatcatggccagtaattttgtcagaatagtgctgtaatttcaggtggtgaacctatggactgaagaagcagtttt

SEQ ID NO: 409232 - DNA, 774 bp, Homo sapiens
gccagatgtggtggctcatgcctgcaatcccaggactttgggaggcccagctgggaggagaggagagcttgagcccaagagtttgaggccagcctgggcaacatagtggcactttgttctccacaaaaataattaataaagcaagtaagcattcctatcactaaaagtacttaaaaaaacaaatcaagcttaaacttacaatagggggtgggagaagtgaattaactttttattttcattagtgcgtgctcatgtgaaaggagcagttaggcaatggagtgttaccactgcagccaggcaggtctagtgtagattcgtccccaaaccatggtatttgccaggcagctctgagggtatgaacaaggcatgtgcattgtgtcctgttgtgtgtaatgcgtttgtatgaagcagattctgtcagaagatgatgttggctgagatgtgggccagctgtacttcactgcttcattacaagggtaaggctggccaggtgcgatggctcacgcctgtcatcccagcactttgggaggccaaggtgggtggatcacttgagttcaggagctcaagagcagcctggccaacatggcaaaaccctatctctactaaacatacaaaacaaaaaaaatagccgggtgtggtggagcacctgtaaacccagctgctcgggaggctgaggtgggcaaatcacatgaacccaggagttggaggttgcagtgagccaagatggcaccaccactgcactccagcctgagcaacagagtgagactccgtctc

SEQ ID NO: 409233 - DNA, 300 bp, Homo sapiens
cccttcacagaaggaaggtggaaaaagctcacgtgaacgttgctttcctgtccttggacttctgacattcctcgggccagccctcagcagtgagccaacccgcaagtcctgggatccagtgggaaggcagctgtcctcttggatgatcctggcaccatattggaaggagtccatctgtggaggccatcagagatttgatcacctcagctgttgttcagctcctccggggactgggggaattttcgtgccattggtgttgacaatgacataatcctagctctaagtcgtctaagtgtgttt

SEQ ID NO: 409234 - DNA, 156 bp, Homo sapiens
cataatcactattaacaaggttcctggcagcagcaaggaagatggtcagagtggggagagagtgccacttccctggccctaggtcagctccaaagcaacttaccctgcagactgatgtgccatttgtgtagtctggaagcctattcgcagtcattg

SEQ ID NO: 409235 - DNA, 283 bp, Homo sapiens
cccaaatagaaagtcaaagggcttaaataaaatatgtctaggctgatttcctgccctgacatagattttattaatctgttttttcttctttatctttcaacgtttctctcatatactttgcatattttcctcctgaagttttcggctttaacttcaaacttagctttttgagaaacaccgccatgtacaatattgatctttgtcttattagtcccttttatcaaagaaagaatgtaatttttgactaggtgttaatctgcagattaaaaaggatttcaaattt

SEQ ID NO: 409236 - DNA, 1887 bp, Homo sapiens
agaatatgaaatgttaatttattaaatgttgatactctatttgaaatttaatagtttctataatgtattataaaacttttccaagtatagttttttataaataataatttagtacattagttatagctgtgtttatatttacatttatctaagtcaactaaaaatacatgagccaaactgaaataaaataagaatgttttatgatggatctttgaaacatgatttcatttttttctttttctagagatacaatcttgcttgaccgtttgggacatcaatcttccacatgaagtgcaaaatttagaaaaacacattgaagtgagaaaagaattagctgaaaaaatgagacgaacatctgttgagtaagagagaaataggaattgtctttggataggaaaattattctctcctcttgtaaatatttattttaaaaatgttcacatggaaagggtactcacattttttgaaatagctcgtgtgtatgaaggaatgttattatttttaatttaaatatatgtaaaaatacttaccagtaaatgtgtattttaaagaactatttaaaacacaatgttatatttcttataaataccagttactttcgttcattaattaatgaaaataaatctgtgaagtacctaatttaagtactcatactaaaatttataaggccgataattttttgttttcttgtctgtaatggaggtaaactttattttaaattctgtgcttcagacaggactattgcttgttgatttttctagaaatctgcacggtataatgaaaatattaagacagtttcccatgtaatgtattccttcttagattgcatcgaaatgcactatcatatatgcttgtaaatattcaaatgaatttgcactaataaagtcctttgttggtatgtgaattctctttgttgctgttgcaaacagtgcatcttacacaacttcactcaattcaaaagaaaactccattaaaagtactaatgaaaaaacatgacatactgtcaaagtcctcatatctaggaaagacacagaaactctctttgtcacagaaactctctgtgtctttcctagacataatagagttgtttttcaactctatgtttgaatgtggataccctgaattttgtataattagtgtaaatacagtgttcagtccttcaagtgatatttttatttttttattcataccactagctacttgttttctaatctgcttcattctaatgcttatattcatcttttccctaaatttgtgatgctgcagatcctacatcattcagatagaaaccttttttttttcagaattatagaattccacagctcctaccaagaccatgaggataaatatctaacacttttcagttgctgaaggagaaaggagctttagttatgatggataaaaatatctgccaccctaggcttccaaattatacttaaattgtttacatagcttaccacaataggagtatcagggccaaatacctatgtaataatttgaggtcatttctgctttaggaaaagtactttcggtaaattctttggccctgaccagtattcattatttcagataattccctgtgataggacaactagtacatttaatattctcagaacttatggcattttactatgtgaaaactttaaatttatttatattaagggtaatcaaattcttaaagatgaaagattttctgtattttaaaggaagctatgctttaacttgttatgtaattaacaaaaaaatcatatataatagagctctttgttccagtgttatctctttcattgttactttgtatttgcaattttttttaccaaagacaaattaaaaaaatgaataccatatttaaatggaataataaaggttttttaaaaactttaaaaa

SEQ ID NO: 409237 - DNA, 705 bp, Homo sapiens
gtttgattttaaaataaagatcaattggaggatagcctacaaggtgctgcatgagctggcttcactgtacctctcctgcctccatcatctaccacattcctaccagatcttgcttgtctagatgaacatccagttcttctcaattactatgctatattttgcctcagggatttgcacatgctgtttatttctttgcttagttaacatagctttttttcatgcttatttaactcatatgctttgaaatgttagctcctgtgtcaaaacctctgagaagccaacactgattaggtcaaagttcccgctttgggttcccataacagctttcttgcatagttttgatcatggtcatatttttttttcattaatgctagtctcttcactagaatataaactccaagacggttgggttagtgtgtttttgtttaccccttttttcccaggatctagcctagggcctacatagaagacttttgatgcaaatttgttgaataaattagtgaatgatttgaaaagaaaatatgatattttgacatagtatcagtatatccatccatctaagtgtccatctaaatactcatatttgtactaaatactcatatttgtaccttaccatatccaaagaacttttcacacacattacctcgtttaacattgtaactttgggaagggtaatgtataaatactgagcctattttatagaaa

SEQ ID NO: 409238 - DNA, 619 bp, Homo sapiens
aggaagttgctgatagtagaatattgtgcttagccttggtgcatcttcctgttgaaaaggaaagctggattgtgtctgggacacagtctggtactctcctggtcatcaataccgaagatgggaaaaagagacataccctagaaaagatgactgattctgtcacttgtttgtattgcaattccttttccaagcaaaggtatggtagtgaatttgatcaatggggaaattacagatcttttaaacgactgaattgtgtgcataattgttattgcatcagcaaagattgttcatttttagcctattttcattggtttgcatatattaaagggaattgtggaaggtcacagagatatttgttgtttttctgaatacagatctagctgagacatttataaaataagtcaaccatttattcaggcctaccagccctgctcctggtattacctcaactgtggctctatctctttacttctcctcagatcaatgaatctttgtagggcctcttcaaggataaattctcattcattcattctttgaaaaaaaaaaaatatatatatatatatatatgaaacccattgtgtgccaggcttaaacataccagttatctaactaccaaatt

SEQ ID NO: 409239 - DNA, 403 bp, Homo sapiens
acaatttcatttgatcttccccaccactcaatacacaaccccattctacagatgtcttaagtgaagctgggagaggctaagtaaactttgcccatttcccctatcggcagagtcactattttcctcatctagggtcaaaaccaaggtcatccatgaccccccgctctccctcattcaggggcaagtcacaaacatccattagtcacaaatgcccatctcttcccccttttctgttttcactgctgccattctggggtagactgttaagcttaaaggagctgctcctttgaagatactaaatataggaaatgtcagtactccattgatgtgtttgagtgaatccacaaattcaacggaaagaaatgtaatgtggggaggagaagcagcaggcccgagctgacta

SEQ ID NO: 409240 - DNA, 2531 bp, Homo sapiens
aggaagttgctgatagtagaatattgtgcttagccttggtgcatcttcctgttgaaaaggaaagctggattgtgtctgggacacagtctggtactctcctggtcatcaataccgaagatgggaaaaagagacataccctagaaaagatgactgattctgtcacttgtttgtattgcaattccttttccaagcaaagcaaacaaaaaaattttcttttggttggaaccgctgatggcaagttagcaatttttgaagataagactgttaagcttaaaggagctgctcctttgaagatactaaatataggaaatgtcagtactccattgatgtgtttgagtgaatccacaaattcaacggaaagaaatgtaatgtggggaggatgtggcacaaagattttctccttttctaatgatttcaccattcagaaactcattgagacaagaacaagccaactgttttcttatgcagctttcagtgattccaacatcataacagtggtggtagacactgctctctatattgctaagcaaaatagccctgttgtggaagtgtgggataagaaaactgaaaaactctgtggactaatagactgcgtgcactttttaagggaggtaacggtaaaagaaaacaaggaatcaaaacacaaaatgtcttattctgggagagtgaaaaccctctgccttcagaagaacactgctctttggataggaactggaggaggccatattttactcctggatctttcaactcgtcgacttatacgtgtaatttacaacttttgtaattcggtcagagtcatgatgacagcacagctaggaagccttaaaaatgtcatgctggtattgggctacaaccggaaaaatactgaaggtacacaaaagcagaaagagatacaatcttgcttgaccgtttgggacatcaatcttccacatgaagtgcaaaatttagaaaaacacattgaagtgagaaaagaattagctgaaaaaatgagacgaacatctgttgagtaagagagaaataggaattgtctttggataggaaaattattctctcctcttgtaaatatttattttaaaaatgttcacatggaaagggtactcacattttttgaaatagctcgtgtgtatgaaggaatgttattatttttaatttaaatatatgtaaaaatacttaccagtaaatgtgtattttaaagaactatttaaaacacaatgttatatttcttataaataccagttactttcgttcattaattaatgaaaataaatctgtgaagtacctaatttaagtactcatactaaaatttataaggccgataattttttgttttcttgtctgtaatggaggtaaactttattttaaattctgtgcttcagacaggactattgcttgttgatttttctagaaatctgcacggtataatgaaaatattaagacagtttcccatgtaatgtattccttcttagattgcatcgaaatgcactatcatatatgcttgtaaatattcaaatgaatttgcactaataaagtcctttgttggtatgtgaattctctttgttgctgttgcaaacagtgcatcttacacaacttcactcaattcaaaagaaaactccattaaaagtactaatgaaaaaacatgacatactgtcaaagtcctcatatctaggaaagacacagaaactctctttgtcacagaaactctctgtgtctttcctagacataatagagttgtttttcaactctatgtttgaatgtggataccctgaattttgtataattagtgtaaatacagtgttcagtccttcaagtgatatttttatttttttattcataccactagctacttgttttctaatctgcttcattctaatgcttatattcatcttttccctaaatttgtgatgctgcagatcctacatcattcagatagaaaccttttttttttcagaattatagaattccacagctcctaccaagaccatgaggataaatatctaacacttttcagttgctgaaggagaaaggagctttagttatgatggataaaaatatctgccaccctaggcttccaaattatacttaaattgtttacatagcttaccacaataggagtatcagggccaaatacctatgtaataatttgaggtcatttctgctttaggaaaagtactttcggtaaattctttggccctgaccagtattcattatttcagataattccctgtgataggacaactagtacatttaatattctcagaacttatggcattttactatgtgaaaactttaaatttatttatattaagggtaatcaaattcttaaagatgaaagattttctgtattttaaaggaagctatgctttaacttgttatgtaattaacaaaaaaatcatatataatagagctctttgttccagtgttatctctttcattgttactttgtatttgcaattttttttaccaaagacaaattaaaaaaatgaataccatatttaaatggaataataaaggttttttaaaaactttaaaaa

SEQ ID NO: 409241 - DNA, 547 bp, Homo sapiens
aggaagttgctgatagtagaatattgtgcttagccttggtgcatcttcctgttgaaaaggaaagctggattgtgtctgggacacagtctggtactctcctggtcatcaataccgaagatgggaaaaagagacataccctagaaaagatgactgattctgtcacttgtttgtattgcaattccttttccaagcaaagcaaacaaaaaaattttcttttggttggaaccgctgatggcaagttagcaatttttgaagataagactgttaaggtaaatgttgaatgcattctacatctaaatttattttaagtcttttgttttatatatatctcacacccctcttatgggattataaactccctgagagcaagaatcataaattatgctgtatttgtattgcttcataaaatcttgaacacagtagatcctctgaaaatacttgctgattgactgtatattttatatgaatgaactaagaataaaatgataaatgacatctgattgataatattgggaatggaaataattcaatttgtacataactgagg

SEQ ID NO: 409242 - DNA, 525 bp, Homo sapiens
ctaaagtaaatactctaagaaaagggaggttaggaatttatagttgagaagtctatctaaagtttaataaagtggaggagaacattaaggccattttagtcaacatacatgttctttttgtaacaatttcaacatttttccttttagcaaacaaaaaaattttcttttggttggaaccgctgatggcaagttagcaatttttgaagataagactgttaaggtaaatgttgaatgcattctacatctaaatttattttaagtcttttgttttatatatatctcacacccctcttatgggattataaactccctgagagcaagaatcataaattatgctgtatttgtattgcttcataaaatcttgaacacagtagatcctctgaaaatacttgctgattgactgtatattttatatgaatgaactaagaataaaatgataaatgacatctgattgataatattgggaatggaaataattcaatttgtacataactgaggcagataattccttataaatatattgtg

SEQ ID NO: 409243 - DNA, 629 bp, Homo sapiens
tacatagaagacttttgatgcaaatttgttgaataaattagtgaatgatttgaaaagaaaatatgatattttgacatagtatcagtatatccatccatctaagtgtccatctaaatactcatatttgtactaaatactcatatttgtaccttaccatatccaaagaacttttcacacacattacctcgtttaacattgtaactttgggaagggtaatgtataaatactgagcctattttatagaaaggttaagctgttttctcagactcacataattaagaattgcagcaaggagtggatcacagattttgttattttttaaaaaaatgctggtctttattcaatataattgaagggtcacctagaaaatagaattgtgaattcagttccaaggtatttgtgtcttaaactatgaacaactttacttttttttcaggccagtttaatatatagttttaacagaaaacttacatattttgtttttgtaaaggaagccttaaaaatgtcatgctggtattgggctacaaccggaaaaatactgaaggtacacaaaagcagaaaggtaacatttagaaggatactgttttccaaacagggcaatgatgtgaatgatggtaacatattatgtg

SEQ ID NO: 409244 - DNA, 2513 bp, Homo sapiens
aggaagttgctgatagtagaatattgtgcttagccttggtgcatcttcctgttgaaaaggaaagctggattgtgtctgggacacagtctggtactctcctggtcatcaataccgaagatgggaaaaagagacataccctagaaaagatgactgattctgtcacttgtttgtattgcaattccttttccaagcaaagcaaacaaaaaaattttcttttggttggaaccgctgatggcaagttagcaatttttgaagataagactgttaagcttaaaggagctgctcctttgaagatactaaatataggaaatgtcagtactccattgatgtgtttgagtgaatccacaaattcaacggaaagaaatgtaatgtggggaggatgtggcacaaagattttctccttttctaatgatttcaccattcagaaactcattgagacaagaacaagccaactgttttcttatgcagctttcagtgattccaacatcataacagtggtggtagacactgctctctatattgctaagcaaaatagccctgttgtggaagtgtgggataagaaaactgaaaaactctgtggactaatagactgcgtgcactttttaagggaggtaacggtaaaagaaaacaaggaatcaaaacacaaaatgtcttattctgggagagtgaaaaccctctgccttcagaagaacactgctctttggataggaactggaggaggccatattttactcctggatctttcaactcgtcgacttatacgtgtaatttacaacttttgtaattcggtcagagtcatgatgacagcacagctaggaagccttaaaaatgtcatgctggtattgggctacaaccggaaaaatactgaagagatacaatcttgcttgaccgtttgggacatcaatcttccacatgaagtgcaaaatttagaaaaacacattgaagtgagaaaagaattagctgaaaaaatgagacgaacatctgttgagtaagagagaaataggaattgtctttggataggaaaattattctctcctcttgtaaatatttattttaaaaatgttcacatggaaagggtactcacattttttgaaatagctcgtgtgtatgaaggaatgttattatttttaatttaaatatatgtaaaaatacttaccagtaaatgtgtattttaaagaactatttaaaacacaatgttatatttcttataaataccagttactttcgttcattaattaatgaaaataaatctgtgaagtacctaatttaagtactcatactaaaatttataaggccgataattttttgttttcttgtctgtaatggaggtaaactttattttaaattctgtgcttcagacaggactattgcttgttgatttttctagaaatctgcacggtataatgaaaatattaagacagtttcccatgtaatgtattccttcttagattgcatcgaaatgcactatcatatatgcttgtaaatattcaaatgaatttgcactaataaagtcctttgttggtatgtgaattctctttgttgctgttgcaaacagtgcatcttacacaacttcactcaattcaaaagaaaactccattaaaagtactaatgaaaaaacatgacatactgtcaaagtcctcatatctaggaaagacacagaaactctctttgtcacagaaactctctgtgtctttcctagacataatagagttgtttttcaactctatgtttgaatgtggataccctgaattttgtataattagtgtaaatacagtgttcagtccttcaagtgatatttttatttttttattcataccactagctacttgttttctaatctgcttcattctaatgcttatattcatcttttccctaaatttgtgatgctgcagatcctacatcattcagatagaaaccttttttttttcagaattatagaattccacagctcctaccaagaccatgaggataaatatctaacacttttcagttgctgaaggagaaaggagctttagttatgatggataaaaatatctgccaccctaggcttccaaattatacttaaattgtttacatagcttaccacaataggagtatcagggccaaatacctatgtaataatttgaggtcatttctgctttaggaaaagtactttcggtaaattctttggccctgaccagtattcattatttcagataattccctgtgataggacaactagtacatttaatattctcagaacttatggcattttactatgtgaaaactttaaatttatttatattaagggtaatcaaattcttaaagatgaaagattttctgtattttaaaggaagctatgctttaacttgttatgtaattaacaaaaaaatcatatataatagagctctttgttccagtgttatctctttcattgttactttgtatttgcaattttttttaccaaagacaaattaaaaaaatgaataccatatttaaatggaataataaaggttttttaaaaactttaaaaa

SEQ ID NO: 409245 - DNA, 501 bp, Homo sapiens
agtttttgcattttccactctatttttaattccttggagctgtgacttgacttgggtgcaggtgtggtgaagtctagttagttgacttgggtacgggtgtggagaagtctagttcagttcttgagcatcctgaattagggaatctgtgctgttaactctagcagtgaggtgatgagcacatagtaaaccaatcacaatgtacctttttaaaaatacaattcagattgtttaaatgtagggagaaaaaagatttcttggtatgaaatgaatatattacactgtccttttttacttccatgttaatatgtcattattataaaaagataaaaatactagacaagttatgaacaaaattgataacatccatgagggcacctgtaatcccagctacttgggaggctgaggcaggagaattgtttgaacctgggaggcggaggttgcagtgagccaagatcacaccatcgcattccagcctgggcaacagggcaagaccctttctca

SEQ ID NO: 409246 - DNA, 1422 bp, Homo sapiens
gcacatgaaccttttttataaaaacaaggggctgggtgccattgctcatacctgtaatcctagcaccttggaagaccaaagcagaaggatcacttgaggccaggcgtttgagatcagcttgtgcaacctgatgagacccccatctgcaaaaaaataatttaaaaaattagctgggtgtggtggcacctgcctgtagtcctagctactcaggaggttcaggcaggaggatcccttgagcccaagggcagttcccttcaactgaccaatatcgagaaaactgacctctctgctcctcaggtgctgcagaagcagctgagtcagcctctttccccatcctgaccctgagtgatggagcacagccacgcttagagctccgggaaggacctgatatgttggatttttctctatgcctccctaacctagatcattttagaaccagggcactgtcatagggtgggcttaggggtcatggaagagctgtgctttagagataagggagcctcacactccctttcaagaggaattgcgccaagctccctcccaactcctttagggaatggaatctgcctgtcttctgggccagggtgcatgtgagcaggacaggccctagagctggaaagccttcctccacagtgggcaggggaaaagaaaactcacttttgctgggttcctactatttgccaagcataacaattccgtaaggtgtgattattattcccctttggtaaatgaaaagatggaggcttagggaatttaaagaacctgcctgaggtccagcttctagaatggtggacccgaatccagagatcattacacacctctgcctcgccaaagccttgtcacctggcccaatgagagccacttcgacttaatgccttgttaagttcctccctggaggtaagatcctactgcaagaatctcactctaaggcgcacgcgtgaaaggaaggcagggccaacagccataagccctaaagagaagagttagtattggccccacacacagggccagacaagcacacacgcggtaggttcataggaaatcagatatcggctgaatgagaagaggaccaccaggggaatattctctgcccttctgctgtctattatgagtctgactggcacagacatctgtcaaggaagaaggattctttgagcgtatttgtgtcagtcaactgcatatatggaccacaacagaaagcaccatggacgaggaaatcagctcgcctcggcagagaagctgtgcaactttggactaatcactgaacctccctggacctccgttttcacctctttccaataagagaccccattttccctgcctccctcccacagttgttggggagatcatgacagtgggtgaagaagggagatataagtgaaatttgaaaaaaataaatttagaagtatattatcattttga

SEQ ID NO: 409247 - DNA, 848 bp, Homo sapiens
  misc_feature (744)..(744): n is a, c, g, or t
  misc_feature (757)..(757): n is a, c, g, or t
  misc_feature (764)..(764): n is a, c, g, or t
  misc_feature (767)..(768): n is a, c, g, or t
  misc_feature (770)..(770): n is a, c, g, or t
gcacatgaaccttttttataaaaacaaggggctgggtgccattgctcatacctgtaatcctagcaccttggaagaccaaagcagaaggatcacttgaggccaggcgtttgagatcagcttgtgcaacctgatgagacccccatctgcaaaaaaataatttaaaaaattagctgggtgtggtggcacctgcctgtagtcctagctactcaggaggttcaggcaggaggatcccttgagcccaagggcagttcccttcaactgaccaatatcgagaaaactgacctctctgctcctcaggtgctgcagaagcagctgagtcagcctctttccccatcctgaccctgagtgatggagcacagccacgcttagagctccgggaaggacctgatatgttggatttttctctatgcctccctaacctagatcattttagaaccagggcactgtcatagggtgggcttaggggtcatggaagagctgtgctttagagataagggagcctcacactccctttcaagaggaattgcgccaagctccctcccaactcctttagggaatggaatctgcctgtcttctgggccagggtgcatgtgagcaggacaggccctagagctggaaagccttcctccacagtgggcaggggaaaagaaaactcacttttgctgggttcctactatttgccaagcataacaattccgtaaggtgtgattattattcccctttggtaaatgaaaagatggggtnggattaagaccgnggggccnttnnangggggcgaccaagaataactttctctccaattgtttgcgccaggagcctaagcgggtcccgggagcggagacccaggg

SEQ ID NO: 409248 - DNA, 1170 bp, Homo sapiens
tcctgtggaggaagcggcgagggcgagccgcggggtctcggcgcctctgtatgcttgcacttaacgagaacccagagcgaacacgacccacatttctctttttgttttaagaggaaatataggagttacagcatagaattacaatatctggacattagaaataacaggtcccggtcacggtatggcaccgcgcgacacacttggtccctgaggcctggatgccgctcagcaaacgttcgcggaatagggttgggtttactgtcccccaccgagccggttgctcattcattcagcataattgaatacctcctgtgtgccaggcactgaatcaagtgtcggagacaatgtcctgccctcaagctcctggccggttacttgacaaccttccgggacctcaacgctatgtgcctactgtgtgaaagcaaagtgccaggtggaggacacaaagatggcgagcgacacaggatagtccttaacaattaagcgtgactaattttaataacaaatgagaatatgatgtgacatccgttccaaatcctgtcgttccaagtaacttcttaagcatctttcacgatacagcctctgcttgaaaggaattaaaacaggtacaagcatggaaggagacgttgctatcatatttcaagaataagaaaatgctgttttgtgtggttgtgcagcaggcaatgaaatgagcttacattcaagcttccgtgttttactgaaacaacagtcacagatgcagtagatgttaaaggttgaaagacgagtgcagtaaaagcattatgaggacaagaagaaaacgtaaatatttgtgttgtttcattctttgttgtggtggcagaaacagccccctctttctaaggtaactccaatataatgatctctcccagctttgaaatactccatgtctgtttcattttccagaaatatggaaaaatgaatatataataaaaaaccctatttctcatttattgtctattttagatctttatgtggaaaagcacttactctcttcccagagcactgtttttaaagtaggtatatttgccataacctatgctcgtctctacaaaaggatcacaccaccgtgtccaccattaaaggggaaattctttaatggtggacacagtggtgtccctgaatcctcatcctcaagtgtttcaatcttcc

SEQ ID NO: 409249 - DNA, 290 bp, Homo sapiens
atcgcttgaacctgggcagcagagattgtggtgagcggagattgcaccactgccctccagcctgggttgcaacagagcaagactccatctcaaataaataaataaataaagcctgtacttacgctttatatttaatgttgacaacgtaccaggttttgagacctcaggcatattatactttacatgtttagagttatatctgagtagctacagtaatgaattcctagtaatacagtttttagtgtacatcattaaaattgctttcatcaggactggagtgtagctgtatt

SEQ ID NO: 409250 - DNA, 585 bp, Homo sapiens
gtcaggatgaaagagttcttggctttaactcccagaaattctggtaacgtcatgtatagtgacggccgcatgtctaacaggtggccaggtaagtcttttggggtggtctgtgaatcacagtttgggagacattgacttttagggagtttgttctgaattcactagataatagagatataatacagagctttgaaagctggtgtcttgatgacagagccgtggcaatggggagggttgaggaggtggctgttgggcctgtctcctggtgagagttgaaagggcctgaactcaagcagaggcctcagaaccgaaaggtggtggaaggatgcagcaagaggcgccacacaggagtactctgcgccctggcagggtctgaatacacgtgggagtggtgagagggagaactttaagtccaggttttgtgcctcagtgacttagtgtggccatatcattagaaatgtgttgaggccgggcacagtggctcatgtctgtaatcccagcactttgagaggctgaggcaggaggatggcttgaggccaggagtttaaaaccagcctggacaacatagtgagagcctgtctctac

SEQ ID NO: 409251 - DNA, 2190 bp, Homo sapiens
gagcttaggtaaattgaactaatgacatctggatgaatacacaacttttctagaacagttttcacaccacacagcacctatggttcagtttaagggcaggacctagagatgacagacaaggctcaaactaaacacattctcttaagatttggttacacgtttttctagggcattctctctgaatgccctagaaacatgtaaccaaatcttgagtctcaggaaatgcaaactgaaagccactggtatttagaatgcacagcaataatgattcaccttcatcccagctgcagcaactgcatccctccaactgggcatttgcagaaaagaggcaagactaagcatggagatcatccttgtgctcagtagttcctccttcagggaaaaacattaaactttcctctgctttctcccacctgttccaaccacttatcaaagttatgtcagctttggttataaaaccatctgggggtgagcttcaaatattatatgtgaataaaatattaagcacctgtgtgataaaacaattttagcttgaatacttaaagaatcagattttcttatgtactatctgcaaatgtatccatctgttcatagagtgctatctctataaagaattagaaatatctaaaatctacagatgtcagagttgaaaggaatctgggagatacctggcttcctgtagctgcacatcacagacatgaaagtgaggctcaaaggagctcactagcttggtccgggtctcacaactggatcatagcagatacagggcttgtactagctgcttagtcccagtgcacttagcattccaccctttctctgacacttgaaaactgactaaacaaaggaaatgaaaacatacttttaaagggttaagattaggtaggagaaaagagttggtatggaaggatcaagagtaacaaaatcaaatctagaaggaactgctaccttccaggttatgctaattactttttcaaaaacagtcctcttagaccttattgtcagattattctctgtggggaacaacaacaaaaaaagatttctaccacagtatatctacagatgaccgaaaccaagtgccttcctgagaaattctagtcctgccctgcacagttctctgtgctccaaatgttttttattctctctccttccacttgtattttctagattattcctttcccattggcccttttccagtttacaagctgttcaaatctaccttcatagaagctgccacttctccaagattctgcttccctttcctcattcattctacaaatatttattgaacaccggcaatataccaaacattctacaaccaagctccttgaaaaagtctatattaactgctctttccttcttctcatctctccacttctctgtaaactgccaaattgctaaagacaattgattctcaatccttttatgcatttacaaggttgactacttcctcaaattctctcctgtcagctttcaaaacatcccctgctcctgattcttctttctcagtgactctttttcataggcttctcttcattcatctgccacttaagagttggtattccccgagggttgtatcatggctctcttctcgctcaacatgttctacctgggccttcctaatcactcccatgctttagcgattccctgtgagtcagccaatgaaagatgagattggcttttgaagcacattaattctttaagacctctggtaaggtgacccagagaatgtcacattcagagttagccagtcttcccttggagaaggcacacaagaagcaaggaggtgacaagcagtgattattttaatgttctcttcctactctatagggccatccccctccctttagaaatgtaaagcggggaaataaagatggatctaccaatccataccagtatgctttccttttattggtgtgggtgtgccccttgaagagacgaccatcactgtgtcaagacaggccaataccacttccatgactccactcccctgagaccttccactatactttctgtgtcatcctgacacctgtagataatcaaatggtaggataggatattaatcactgtagcttaaagctaagtttctcccaaggctgacattcattccctgttctacttaccacctcagctcatagcgagacacttttgtcagaggaggttgtacaatgagcaccacacaaaaaaaaaaaa

SEQ ID NO: 409252 - DNA, 1934 bp, Homo sapiens
cttaatagcataaatgaaaacaaagtcatccagatggggagagtttttcttgaaatgtccctagcgaggaatggtccccagacaaccaaaagtcaaatctttgaactgggagatatttatagaataatttcttagataagaggcaagttttccatcatttattttctttaattatctctttttgacaccatcttagtggaatttgctctacgtttgcagtttgccgtgcaacagttgatcggaagtagggagaggggaggggacgctcagggagaaggttctgtcgggcgtcttctgggcttccttctgtgttaacgtgtcactcaatcccagaagtgcaacttgaggtcctagtaaaggtatcagaaaatgaggaggagaaatcggcttacagtctaagctgagatcatgtaggtcatcatccttcctagacactgatcagaatgaaattaagaaaatgaccactttgttcactttcattggtcacctagaagggaacgaactggctctggacttagggagtgtgtcactatgggggcagccacaggggacacagcaactcctctcctggcttctttccagaccataaatctaacagctaaagctactcaagttcaaagccatggccttgctccttataaccatatgaaagacaagacacattgaccaatgatacaagtaacccaagtgatttgcatttatggaaaaaggctattactcctgagaaagagttgccattttatataaaagaaaagaagataggaaaaagaaaagcacacaagttttatttggaatgaaggcaattcacaggtcacaaaataattcatgctgaaagggcctgcagagttcttgcactgtgatgtcttcgagccatctttattgtcatgctgcatgcacgtatagaaaatggaataggtccattctatgtagccatttttgattttctgaaccacctaactacttgtacccacctgcaatgtgtaattcatggggcagtgccctccttacacaaccgcacacgctcacaggcaccaactcacagggattctccttgtccacgctacctgtgagcccaaagtgacagccccacaaaggagcttccacaacttcccaaaccgtctctgctccttgctttcttccacctgctccccagaggccccaggaaggagttggccctgatgagaacggtgctccatgggtgaccgcgaatccggcttagccctcactccggtcccacgtgtggcccagtccattctcagctcattcccctggaaagcaagatcatggtcttcagaggcctcccgcttctaacatttcctaactcagtggttgccactctcctgtgaccagcccttcttcccacctcactgtgaaaaattcccagaagccaggatcacgactcacttgtcttcacataatggatatttacttaatatttattatcaatttccccacctccaaccctgtccctggcacacacttggcatcatttatccaataggggactgggaattttggtgaagtgaatcaaggctattcagggtcaagagagagattaacttgaatgggccaatttgctagataattaatgtcttaaaaaccaaaaccagagagaagcccacagccctgtcctctgtggcttgaaaaagaaacccagcatcagaggaatgagcgatgatgccccctggggcgcccacttctgtttgtcaggagggatggtcggaggggcagctcacctggcgaggtgatggctctgcatttcccacgaacatatatgtgacatgtacataaatataaatacttatgtttataaatgttgaatggttccttctagctgtggctgagtagacgttggtgtttctaacttctttcagtgtgttagagattgattacatgctagctataaaaagtaaaataaatattttaccatgcta

SEQ ID NO: 409253 - DNA, 2588 bp, Homo sapiens
cttaatagcataaatgaaaacaaagtcatccagatggggagagtttttcttgaaatgtccctagcgaggaatggtccccagacaaccaaaagtcaaatctttgaactgggagatatttatagaataatttcttagataagaggcaagttttccatcatttattttctttaattatctctttttgacaccatcttagtggaatttgctctacgtttgcagtttgccgtgcaacagttgatcggaagtagggagaggggaggggacgctcagggagaaggttctgtcgggcgtcttctgggcttccttctgtgttaacgtgtcactcaatcccagaagtgcaacttgaggtcctagtaaaggtatcagaaaatgaggaggagaaatcggcttacagtctaagctgagatcatgtaggtcatcatccttcctagacactgatcagaatgaaattaagaaaatgaccactttgttcactttcattggtcacctagaagggaacgaactggctctggacttagggagtgtgtcactatgggggcagccacaggggacacagcaactcctctcctggcttctttccagaccataaatctaacagctaaagctactcaagttcaaagccatggccttgctccttataaccatatgaaagacaagacacattgaccaatgatacaagtaacccaagtgatttgcatttatggaaaaaggctattactcctgagaaagagttgccattttatataaaagaaaagaagataggaaaaagaaaagcacacaagttttatttggaatgaaggcaattcacaggtcacaaaataattcatgctgaaagggcctgcagagttcttgcactgtgatgtcttcgagccatctttattgtcatgctgcatgcacgtatagaaaatggaataggtccattctatgtagccatttttgattttctgaaccacctaactacttgtacccacctgcaatgtgtaattcatggggcagtgccctccttacacaaccgcacacgctcacaggcaccaactcacagggattctccttgtccacgctacctgtgagcccaaagtgacagccccacaaaggagcttccacaacttcccaaaccgtctctgctccttgctttcttccacctgctccccagaggccccaggaaggagttggccctgatgagaacggtgctccatgggtgaccgcgaatccggcttagccctcactccggtcccacgtgtggcccagtccattctcagctcattcccctggaaagcaagatcatggtcttcagaggcctcccgcttctaacatttcctaactcagtggttgccactctcctgtgaccagcccttcttcccacctcactgtgaaaaattcccagaagccaggatcacgactcacttgtcttcacataatggatatttacttaatatttattatcaatttccccacctccaaccctgtccctggcacacacttggcatcatttatccaataggggactgggaattttggtgaagtgaatcaaggctattcagggtcaagagagagattaacttgaatgggccaatttgctagataattaatgtcttaaaaaccaaaaccagagagaagcccacagccctgtcctctgtggcttgaaaaagaaacccagcatcagaggaatgagcgatgatgccccctggggcgcccacttctgtttgtcaggagggatggtcggaggggcagctcacctggcgaggtgatggctctgcatttcccacgaacatatatgtgacatgtacataaatataaatacttatgtttataaatgttgaatggttccttctagctgtggctgagtagacgttggtgtttctaacttctttcagtgtgttagagattgattacatgctagctataaaaagtaaaataaatattttaccatgctattaaagcttggaccattatcaaacacacacaaacacacactcattctgctgtttaaaaattcatctgcgttcgttctcccaggagtgctccagggaaccacaggcttcccggcacttgaaggctgaactgagcgtgagtgccctggtccccaggaagcaggcggatgctgcaggaaggtggcagacagcctgcatccaggagggccccaggaagtggggatgctgcaggaaggcggcacaaagcctgcatccgggagggccccaggaagcagggggatgctgcaggaaggtggcagacagactgcatccaggagggcacagtgacctgtcactccgttctgcagaaattggcccagcagttgcgttatgcccaaccaaaagatgctcgttccagctttcaaatgtgatgatttcagcctgtgaggacaatgccatgtccccaccctaagccagcaaaatgcgaaatctctgttctggcccagaatggcacaagggaggagtctttgcagagttccacgccaccccccagcttactgcggccttcaccggctctgtctaggattgccagctgtggttccaagtgaggagcaaacccattttatgagccatgttcctgcggagacctgatgggccaggccttctgtggctttgaaa

SEQ ID NO: 409254 - DNA, 301 bp, Homo sapiens
tagcaattaatagaacactcatttattttctcacagattcaggaatcttggcagatctcagctcagtcctctgtttcaaagttcctcacaaggctgcatagaagatgttgtcagggttgtggtcctgtgtgaaggcttgactggtgaatgatttgttcctaagctcattcatatgattggcaggattcagttcctccagagtgattggactgagggccttcattcttggatgtttgttgtccagaacccacccttggttccttgatcatggacctctcagtagggcagctcataaaagtcc

SEQ ID NO: 409255 - DNA, 490 bp, Homo sapiens
ggctcaagcaatccacctgcctcggcctcccaaagtgctaggaatacaggtcattaatcacctattttatgtaaaagaaggaacaagggatgtttcagccagagatacatgacgttgtttaagtataagtcaccaattgtagagagaaagagagtatcttctgccttctaagcaaatagacttcaaaatagctccgtctttacatattgacaatatgtgattcaggaatcttggcagatctcagctcagtcctctgtttcaaagttcctcacaaggctgcatagaagatgttgtcagggttgtggtcctgtgtgaaggcttgactgatgacacttccatcagaatgcagccttcacaatttactatcgtcttgactcattcacctccctcattagacactgagcttgcaggaaggaggaagcatttctgtttactattgttttctcgcatgtaccacagcttctggcaaatataagtatgtaacacacaa

SEQ ID NO: 409256 - DNA, 443 bp, Homo sapiens
tttgatgacttcaacagaatcctaattggtctttctgccttctctcctgttttgtgataatcatggcattcccatgtttggaacatttcactgactacctcttcaggaggagattgaaactccttgtcatgtgtttcaaggttatttaccttttcactcccactaaaatgtacttagactgaactcctttgttcctggaacagagacacttaaaagacttggagacttctccctgaacacagtttaatttaaccaattcttcatttggcttgtatttagatgacacttccatcagaatgcagccttcacaatttactatcgtcttgactcattcacctccctcattagacactgagcttgcaggaaggaggaagcatttctgtttactattgttttctcgcatgtaccacagcttctggcaaatataagtatgtaacacacaa

SEQ ID NO: 409257 - DNA, 331 bp, Homo sapiens
taggctcagtagagctttcagcctagtttttattttgtgttccacaactagggtaattgtgctaaaatttagctgttacttgaagaaaagtttctttttgttttccatatccagttaagttccaagtgaaatttttctgactggttatcaagaaatttcaaaattgatgaagaagtatagcattttgctcatctcactgaatttcaagtcttaataagcaatgagttataatctgtcactgtctgtttattttgatgctagaattgtgaatatataatttatgttaatatatttttataatgtcatcaccatgattactaatatatataac

SEQ ID NO: 409258 - DNA, 346 bp, Homo sapiens
attcacaagtcctcttgttgctttaaaatgtatctcaattttgatatgttcaaaactgagcttacctctttctgcctctgcaaacctgctcactctctagtattttccaccttgaagaatggtcctgtcatgaattcagttgtcccagccagaaactcatccttaactctggtcttctccctatccctcccttctacttaattaagtcttgtcgactctacttcctaaaagatcatccactgtttccccaacctgcgtatttacctttcttaccttctttcctttagttggctactcattcatcttttattcatgttgttgtcaaagtaaaacttctaaaacttaa

SEQ ID NO: 409259 - DNA, 219 bp, Homo sapiens
ggagctaactttcctgtttggcagacacaggaaatcaccgagatcaggttcttggtccagaccatgacataagagaaaagattttcttcagacctttgcattgcccccagtgataccctgagttttccattttgggtggctggagaacagggtgtgtggtgacagatggggttgagcggagagcctggaatctgtcatcgtctttagtaaaattgcctt

SEQ ID NO: 409260 - DNA, 490 bp, Homo sapiens
aagaaggtcaaccttaatacattcagaacctcaaagcaaaaaaaaaaaaaaaaaagtccacaggataatcccatgcctcaaacctgttagttacatgcccaatccagcaaactagtttgttctcaagctttacagtaaaagcttttgacaatgttctggtacagaagggctgcctccaagtccacgagatgccattagcagataaattatattggcctcaaacacaaaccctatttcaactatctcaaattaaatctgatgcctataagctctaattttttgccaataagtacaaaaatgacaaatgaaaatttctatagtggatttacgcattagcagtcaaaaaaagcttgcttgtcagcaagttcatccagactccagatctcatgtgtccttcatgctctctacccagccagagacctcatatctcatgcccaggtctttcctcaggctctgacctgaagcctcccttgcagggagggccagagct

SEQ ID NO: 409261 - DNA, 530 bp, Homo sapiens
aagaaggtcaaccttaatacattcagaacctcaaagcaaaaaaaaaaaaaaaaaagtccacaggataatcccatgcctcaaacctgttagttacatgcccaatccagcaaactagtttgttctcaagctttacagtaaaagcttttgacaatgttctggtacagaagggctgcctccaagtccacgagatgccattagcagataaattatattggcctcaaacacaaaccctatttcaactatctcaaattaaatctgatgcctataagctctaattttttgccaataagtacaaaaatgacaaatgaaaatttctatagtggatttacgcattagcagtcaaaaaaagcttgcttgtcagcaagttcatccagactccagatctcatgtgtccttcatgctctctacctgcacacacaccttcacatgcacaccttcacatgcacacgcagacctccatatgcacatgcacaccacatgcgcacacacacctccacatgcacacggggtaccgagcctcgaatccgcaa

SEQ ID NO: 409262 - DNA, 3086 bp, Homo sapiens
acttgcttgctggttttgcttgcatctgatgagtagaaattcagcctattctttgttttggaaatacaaaagatataataatgatatatgaagaagatgctgaggaatgggctctgtacttgacagaagtatttttacatgttgtgaaaagggaagccatcctgttatatcgcttggagaatttctcttttcggcatttggagttgctgaacttaacgtcttacaaatgtaaacttttgatattatcaaatagcctgcttagagacctaactccaaagaaatgtcagtttctggaaaagatacttcattcaccaaaaagtgtagttactttgctttgtggagtgaagagttcagatcagctctatgaattactaaatatctctcaaagcagatgggagatctcaactgaacaggaacttgaagactacatctctgtaatccagagtatcatattcaaagattctgaagactactttgaggtcaacattccaacagacctacgagcaaaacattctggggaaataagtgagagaaaggaaattgaagaactatcagaagcttcaagaaacaccataccactagcagtggtgcttcccactgaaattccatgtgagaatcctggtgaaatattcataattttgagagatgaagtaattggtgatactgtagaggttgaatttacatcaagtaataagcgcattagaacacggccagccctttggaataagaaagtctggtgcatgaaagctttagagtttcctgctggttcagtccatgtcaatgtctactgtgatggaatcgttaaagctacaaccaaaattaagtactacccaacagcaaaggcaaaggaatgcctattcagaatggcagattcaggagagagtttgtgccagaatagcattgaagaacttgatggtgtccttacatccatattcaaacatgagataccatattatgagttccagtctcttcaaactgaaatttgttctcaaaacaaatatactcatttcaaagaacttccaactcttctccactgtgcagcaaaatttggcttaaagaacctggctattcatttgcttcaatgttcaggagcaacctgggcatctaagatgaaaaatatggagggttcagaccccgcacatattgctgaaaggcatggtcacaaagaactcaagaaaatcttcgaagacttttcaatccaagaaattgacataaataatgagcaagaaaatgattatgaagaggatattgcctcattttccacatatattccttccacacagaacccagcatttcatcatgaaagcaggaagacatacgggcagagtgcagatggagctgaggcaaatgaaatggaaggggaaggaaaacagaatggatcaggcatggagaccaaacacagcccactagaggttggcagtgagagttctgaagaccagtatgatgacttgtatgtgttcattcctggtgctgatccagaaaataattcacaagagccactcatgagcagcagacctcctctccccccgccgcgacctgtagctaatgccttccaactggaaagacctcacttcaccttaccagggacaatggtggaaggccaaatggaaagaagtcaaaactggggtcatcctggtgttagacaagaaacaggagatgaacccaaaggagaaaaagagaagaaagaagaggaaaaagagcaggaggaggaagaagacccatatacttttgctgagattgatgacagtgaatatgacatgatattggccaatctgagtataaagaaaaaaactgggagtcggtctttcattataaatagacctcctgcccccacaccccgacccacaagtatacctccaaaagaggaaactacaccttacatagctcaagtgtttcaacaaaagacagccagaagacaatctgatgatgacaagttccgtggtcttcctaagaaacaagacagagctcggatagagagtccagccttttctactctcaggggctgtctaactgatggtcaggaagaactcatcctcctgcaggagaaagtaaagaatgggaaaatgtctatggatgaagctctggagaaatttaaacactggcagatgggaaaaagtggcctggaaatgattcagcaggagaaattacgacaactacgagactgcattattgggaaaaggccagaagaagaaaatgtctataataaactcaccattgtgcaccatccaggtggtaaggaaactgcccacaatgaaaataagttttataatgtacacttcagcaataagcttcctgctcgaccccaagttgaaaaggaatttggtttctgttgcaagaaagatcattaaagaaggttattataatgaaactcacgaatctacggacattttgctttcagggtgaagcaagcttgaatttggattgcctgctctctttaaagcgaattcatactatgacagcagaaacaaaacttcagatttcagaatttgttattggcaaaatttattctcattatacctgcttcatatgggtatattactattaaaacagaataccatagagtaattgcattatttgaaaattctctcattttacaatgcacttcaccaatgaaacagctaatttccattttgaaaattaaaagaaaacagcacagagaagttaaatgcggtgtagcaaagttatggggtctgcttgagggcactaacctcaacagattattcctcctctccttagaataaccatgaaaatacaaatttacttagcacatttttgctttttaagtagctggttcattttctgaatttctcacattcagagttccagtcattattgttacatcatgtttgcagaaaccttgtcttatttagtgtctatttgcatataaccctgaaaacattattatttgaaaacttttctatatctcaaattaatatacattttcataacctacctttgtattaagacttgcaattttatcaatctattatttcttagaaacaatttactagcttagaatagaaagcaatgttatcgtcatataattttcatgtacaaatgccacaaataaattgaatgtttaaagc

SEQ ID NO: 409263 - DNA, 3248 bp, Homo sapiens
tgagacctggccgcagcctccgcgggtggcaagcgggctggggagagccgagggccaaaggaagagaaaatcgcggggagtctctggccgggagagtccaggtagcgctcggcgggcagcagtgcgcaggcccctcggcttcaaccgccacaatgctgccagcagcgccaggcaaggggcttgggagcccggaccccgccccctgcggcccagcgcccccaggaaatacaaaagatataataatgatatatgaagaagatgctgaggaatgggctctgtacttgacagaagtatttttacatgttgtgaaaagggaagccatcctgttatatcgcttggagaatttctcttttcggcatttggagttgctgaacttaacgtcttacaaatgtaaacttttgatattatcaaatagcctgcttagagacctaactccaaagaaatgtcagtttctggaaaagatacttcattcaccaaaaagtgtagttactttgctttgtggagtgaagagttcagatcagctctatgaattactaaatatctctcaaagcagatgggagatctcaactgaacaggaacttgaagactacatctctgtaatccagagtatcatattcaaagattctgaagactactttgaggtcaacattccaacagacctacgagcaaaacattctggggaaataagtgagagaaaggaaattgaagaactatcagaagcttcaagaaacaccataccactagcagtggtgcttcccactgaaattccatgtgagaatcctggtgaaatattcataattttgagagatgaagtaattggtgatactgtagaggttgaatttacatcaagtaataagcgcattagaacacggccagccctttggaataagaaagtctggtgcatgaaagctttagagtttcctgctggttcagtccatgtcaatgtctactgtgatggaatcgttaaagctacaaccaaaattaagtactacccaacagcaaaggcaaaggaatgcctattcagaatggcagattcaggagagagtttgtgccagaatagcattgaagaacttgatggtgtccttacatccatattcaaacatgagataccatattatgagttccagtctcttcaaactgaaatttgttctcaaaacaaatatactcatttcaaagaacttccaactcttctccactgtgcagcaaaatttggcttaaagaacctggctattcatttgcttcaatgttcaggagcaacctgggcatctaagatgaaaaatatggagggttcagaccccgcacatattgctgaaaggcatggtcacaaagaactcaagaaaatcttcgaagacttttcaatccaagaaattgacataaataatgagcaagaaaatgattatgaagaggatattgcctcattttccacatatattccttccacacagaacccagcatttcatcatgaaagcaggaagacatacgggcagagtgcagatggagctgaggcaaatgaaatggaaggggaaggaaaacagaatggatcaggcatggagaccaaacacagcccactagaggttggcagtgagagttctgaagaccagtatgatgacttgtatgtgttcattcctggtgctgatccagaaaataattcacaagagccactcatgagcagcagacctcctctccccccgccgcgacctgtagctaatgccttccaactggaaagacctcacttcaccttaccagggacaatggtggaaggccaaatggaaagaagtcaaaactggggtcatcctggtgttagacaagaaacaggagatgaacccaaaggagaaaaagagaagaaagaagaggaaaaagagcaggaggaggaagaagacccatatacttttgctgagattgatgacagtgaatatgacatgatattggccaatctgagtataaagaaaaaaactgggagtcggtctttcattataaatagacctcctgcccccacaccccgacccacaagtatacctccaaaagaggaaactacaccttacatagctcaagtgtttcaacaaaagacagccagaagacaatctgatgatgacaagttccgtggtcttcctaagaaacaagacagagctcggatagagagtccagccttttctactctcaggggctgtctaactgatggtcaggaagaactcatcctcctgcaggagaaagtaaagaatgggaaaatgtctatggatgaagctctggagaaatttaaacactggcagatgggaaaaagtggcctggaaatgattcagcaggagaaattacgacaactacgagactgcattattgggaaaaggccagaagaagaaaatgtctataataaactcaccattgtgcaccatccaggtggtaaggaaactgcccacaatgaaaataagttttataatgtacacttcagcaataagcttcctgctcgaccccaagttgaaaaggaatttggtttctgttgcaagaaagatcattaaagaaggttattataatgaaactcacgaatctacggacattttgctttcagggtgaagcaagcttgaatttggattgcctgctctctttaaagcgaattcatactatgacagcagaaacaaaacttcagatttcagaatttgttattggcaaaatttattctcattatacctgcttcatatgggtatattactattaaaacagaataccatagagtaattgcattatttgaaaattctctcattttacaatgcacttcaccaatgaaacagctaatttccattttgaaaattaaaagaaaacagcacagagaagttaaatgcggtgtagcaaagttatggggtctgcttgagggcactaacctcaacagattattcctcctctccttagaataaccatgaaaatacaaatttacttagcacatttttgctttttaagtagctggttcattttctgaatttctcacattcagagttccagtcattattgttacatcatgtttgcagaaaccttgtcttatttagtgtctatttgcatataaccctgaaaacattattatttgaaaacttttctatatctcaaattaatatacattttcataacctacctttgtattaagacttgcaattttatcaatctattatttcttagaaacaatttactagcttagaatagaaagcaatgttatcgtcatataattttcatgtacaaatgccacaaataaattgaatgtttaaagc

SEQ ID NO: 409264 - DNA, 3171 bp, Homo sapiens
acttgcttgctggttttgcttgcatctgatgagtagaaattcagcctattctttgttttggaaatacaaaagatataataatgatatatgaagaagatgctgaggaatgggctctgtacttgacagaagtatttttacatgttgtgaaaagggaagccatcctgttatatcgcttggagaatttctcttttcggcatttggagttgctgaacttaacgtcttacaaatgtaaacttttgatattatcaaatagcctgcttagagacctaactccaaagaaatgtcagtttctggaaaagatacttcattcaccaaaaagtgtagttactttgctttgtggagtgaagagttcagatcagctctatgaattactaaatatctctcaaagcagatgggagatctcaactgaacaggaacttgaagactacatctctgtaatccagagtatcatattcaaagattctgaagactactttgaggtcaacattccaacagacctacgagcaaaacattctggggaaataagtgagagaaaggaaattgaagaactatcagaagcttcaagaaacaccataccactagcagtggtgcttcccactgaaattccatgtgagaatcctggtgaaatattcataattttgagagatgaagtaattggtgatactgtagaggttgaatttacatcaagtaataagcgcattagaacacggccagccctttggaataagaaagtctggtgcatgaaagctttagagtttcctgctggttcagtccatgtcaatgtctactgtgatggaatcgttaaagctacaaccaaaattaagtactacccaacagcaaaggcaaaggaatgcctattcagaatggcagattcaggagagagtttgtgccagaatagcattgaagaacttgatggtgtccttacatccatattcaaacatgagataccatattatgagttccagtctcttcaaactgaaatttgttctcaaaacaaatatactcatttcaaagaacttccaactcttctccactgtgcagcaaaatttggcttaaagaacctggctattcatttgcttcaatgttcaggagcaacctgggcatctaagatgaaaaatatggagggttcagaccccgcacatattgctgaaaggcatggtcacaaagaactcaagaaaatcttcgaagacttttcaatccaagaaattgacataaataatgagcaagaaaatgattatgaagaggatattgcctcattttccacatatattccttccacacagaacccagcatttcatcatgaaagcaggaagacatacgggcagagtgcagatggagctgaggcaaatgaaatggaaggggaaggaaaacagaatggatcaggcatggagaccaaacacagcccactagaggttggcagtgagagttctgaagaccagtatgatgacttgtatgtgttcattcctggtgctgatccagaaaataattcacaagagccactcatgagcagcagacctcctctccccccgccgcgacctgtagctaatgccttccaactggaaagacctcacttcaccttaccagggacaatggtggaaggccaaatggaaagaagtcaaaactggggtcatcctggtgttagacaagaaacaggagatgaacccaaaggagaaaaagagaagaaagaagaggaaaaagagcaggaggaggaagaagacccatatacttttgctgagattgatgacagtgaatatgacatgatattggccaatctgagtataaagaaaaaaactgggagtcggtctttcattataaatagacctcctgcccccacaccccgacccacaagtatacctccaaaagaggaaactacaccttacatagctcaagtgtttcaacaaaagacagccagaagacaatctgatgatgacaagttccgtggtcttcctaagaaacaagacagagctcggatagagagtccagccttttctactctcaggggctgtctaactgatggtcaggaagaactcatcctcctgcaggagaaagtaaagaatgggaaaatgtctatggatgaagctctggagaaatttaaacactggcagatgggaaaaagtggcctggaaatgattcagcaggagaaattacgacaactacgagactgcattattgggaaaaggccagaagaagaaaatgtctataataaactcaccattgtgcaccatccaggtggtaaggaaactgcccacaatgaaaataagttttataatgtacacttcagcaataagcttcctgctcgaccccaagttgaaaaggaatttggtttctgttgcaagaaagatcattaaagaaggttattataatgaaactcacgaatctacggacattttgctttcagggtgaagcaagcttgaatttggattgcctgctctctttaaagcgaattcatactatgacagcagaaacaaaacttcagatttcagaatttgttattggcaaaatttattctcattatacctgcttcatatgggtatattactattaaaacagaataccatagagtaattgcattatttgaaaattctctcattttacaatgcacttcaccaatgaaacagctaatttccattttgaaaattaaaagaaaacagcacagagaagttaaatgcggtgtagcaaagttatggggtctgcttgagggcactaacctcaacagattattcctcctctccttagaataaccatgaaaatacaaatttacttagcacatttttgctttttaagtagctggttcattttctgaatttctcacattcagagttccagtcattattgttacatcatgtttgcagaaaccttgtcttatttagtgtctatttgcatataaccctgaaaacattattatttgaaaacttttctatatctcaaattaatatacattttcataacctacctttgtattaagacttgcaattttatcaatctattatttcttagaaacaatttactagcttagaatagaaagcaatgttatcgtcatataattttcatgtacaaatgccacaaataaattgaatgtttaaagctatgtctgagtttttaaagtaaatttataagaattagccaataaaattgcttctcggccttttggctaagatcaagtggagtatt

SEQ ID NO: 409265 - DNA, 3414 bp, Homo sapiens
tgagacctggccgcagcctccgcgggtggcaagcgggctggggagagccgagggccaaaggaagagaaaatcgcggggagtctctggccgggagagtccaggtagcgctcggcgggcagcagtgcgcaggcccctcggcttcaaccgccacaatgctgccagcagcgccaggcaaggggcttgggagcccggaccccgccccctgcggcccagcgcccccaggaaatacaaaagatataataatgatatatgaagaagatgctgaggaatgggctctgtacttgacagaagtatttttacatgttgtgaaaagggaagccatcctgttatatcgcttggagaatttctcttttcggcatttggagttgctgaacttaacgtcttacaaatgtaaacttttgatattatcaaatagcctgcttagagacctaactccaaagaaatgtcagtttctggaaaagatacttcattcaccaaaaagtgtagttactttgctttgtggagtgaagagttcagatcagctctatgaattactaaatatctctcaaagcagatgggagatctcaactgaacaggaacttgaagactacatctctgtaatccagagtatcatattcaaagattctgaagactactttgaggtcaacattccaacagacctacgagcaaaacattctggggaaataagtgagagaaaggaaattgaagaactatcagaagcttcaagaaacaccataccactagcagtggtgcttcccactgaaattccatgtgagaatcctggtgaaatattcataattttgagagatgaagtaattggtgatactgtagaggttgaatttacatcaagtaataagcgcattagaacacggccagccctttggaataagaaagtctggtgcatgaaagctttagagtttcctgctggttcagtccatgtcaatgtctactgtgatggaatcgttaaagctacaaccaaaattaagtactacccaacagcaaaggcaaaggaatgcctattcagaatggcagattcaggagagagtttgtgccagaatagcattgaagaacttgatggtgtccttacatccatattcaaacatgagataccatattatgagttccagtctcttcaaactgaaatttgttctcaaaacaaatatactcatttcaaagaacttccaactcttctccactgtgcagcaaaatttggcttaaagaacctggctattcatttgcttcaatgttcaggagcaacctgggcatctaagatgaaaaatatggagggttcagaccccgcacatattgctgaaaggcatggtcacaaagaactcaagaaaatcttcgaagacttttcaatccaagaaattgacataaataatgagcaagaaaatgattatgaagaggatattgcctcattttccacatatattccttccacacagaacccagcatttcatcatgaaagcaggaagacatacgggcagagtgcagatggagctgaggcaaatgaaatggaaggggaaggaaaacagaatggatcaggcatggagaccaaacacagcccactagaggttggcagtgagagttctgaagaccagtatgatgacttgtatgtgttcattcctggtgctgatccagaaaataattcacaagagccactcatgagcagcagacctcctctccccccgccgcgacctgtagctaatgccttccaactggaaagacctcacttcaccttaccagggggtgacatataaattattctcctggagtcacgagctcttctctaatactgtttcctacggcacttgactaagccaccttgggaagctcaaaaaagtgacagatggacaccaataatgttgcatgtaacagaagagtaaacaccatgtaaatatttcataaacagggacaatggtggaaggccaaatggaaagaagtcaaaactggggtcatcctggtgttagacaagaaacaggagatgaacccaaaggagaaaaagagaagaaagaagaggaaaaagagcaggaggaggaagaagacccatatacttttgctgagattgatgacagtgaatatgacatgatattggccaatctgagtataaagaaaaaaactgggagtcggtctttcattataaatagacctcctgcccccacaccccgacccacaagtatacctccaaaagaggaaactacaccttacatagctcaagtgtttcaacaaaagacagccagaagacaatctgatgatgacaagttccgtggtcttcctaagaaacaagacagagctcggatagagagtccagccttttctactctcaggggctgtctaactgatggtcaggaagaactcatcctcctgcaggagaaagtaaagaatgggaaaatgtctatggatgaagctctggagaaatttaaacactggcagatgggaaaaagtggcctggaaatgattcagcaggagaaattacgacaactacgagactgcattattgggaaaaggccagaagaagaaaatgtctataataaactcaccattgtgcaccatccaggtggtaaggaaactgcccacaatgaaaataagttttataatgtacacttcagcaataagcttcctgctcgaccccaagttgaaaaggaatttggtttctgttgcaagaaagatcattaaagaaggttattataatgaaactcacgaatctacggacattttgctttcagggtgaagcaagcttgaatttggattgcctgctctctttaaagcgaattcatactatgacagcagaaacaaaacttcagatttcagaatttgttattggcaaaatttattctcattatacctgcttcatatgggtatattactattaaaacagaataccatagagtaattgcattatttgaaaattctctcattttacaatgcacttcaccaatgaaacagctaatttccattttgaaaattaaaagaaaacagcacagagaagttaaatgcggtgtagcaaagttatggggtctgcttgagggcactaacctcaacagattattcctcctctccttagaataaccatgaaaatacaaatttacttagcacatttttgctttttaagtagctggttcattttctgaatttctcacattcagagttccagtcattattgttacatcatgtttgcagaaaccttgtcttatttagtgtctatttgcatataaccctgaaaacattattatttgaaaacttttctatatctcaaattaatatacattttcataacctacctttgtattaagacttgcaattttatcaatctattatttcttagaaacaatttactagcttagaatagaaagcaatgttatcgtcatataattttcatgtacaaatgccacaaataaattgaatgtttaaagc

SEQ ID NO: 409266 - DNA, 553 bp, Homo sapiens
gagtgaagtaactgactggacatcccaaagttaggtggtcctgagagccaggtgctgacagctgcctcaccttaagagtctcctttcgttatggcatctggaaagatctcacatggcaggcctgcttctagttccttcttcctagtgtgtctgaggaaatccaatctctcccactccagcccgcctactcattgaacatggctgctatctctgtcttctggaaacacggctccaatcctgcaacaactctatacaagagctcccagtggttcttaaccttggctgagcaacagacccatttgggaagatttttaaaaatctagcttatgagatacctcagatcaatcaatccctggcagtgggtctgctaaacatcagatacagacaaacaactgcatagatctccaactagattgaagaacaggaccctccagagagcttccaagaagacaccaacctaggcatgggtttatgttcctgacaaagaataaggattgttatgaagaatgttctattttgaattgtgaaaataattatttaaagctgtacaaaa

SEQ ID NO: 409267 - DNA, 822 bp, Homo sapiens
gtggaacaatcgtgcggtcagctccacctgccacaacccttcctgaaagatccaggcccacagaaaagccaggatcctgtctttaaagactgctctgctctcccacctcatcctgtgtccaataaccgcaccttccaacagcgtttctaaccctgttctctccaagcgtggcctgcagcacctctccaggcctctgtgctgacagctgcctcaccttaagagtctcctttcgttatggcatctggaaagatctcacatggcaggcctgcttctagttccttcttcctagtgtgtctgaggaaatccaatctctcccactccagcccgcctactcattgaacatggctgctatctctgtcttctggaaacacggctccaatcctgcaacaactctatacaagagctcccagtgaaagctttcactagaccttgatggcactatggtcattatcttgtcaaaactgtggtggatttgaagagctagtgatgaagaatggaggtttcctgtcctagaaataaccaaaggcccaggcttggaggtggcagaaaaagtggcacttaaggttaaatttcctggataaaatcagatcagccgtgtaatcaccctgctacaataaaaggagctcagtgtgctttatggcaaccacaccagtcaagggctctctctggcaccaagggagccataagggccccctgccaagtggagctgagggatgctcgaggccagggtctggaccttctcactataaaaagaatagtgaagtatacagatatttacctactgagttatgtttgggctgataaaaatgctcagatgtcctt

SEQ ID NO: 409268 - DNA, 455 bp, Homo sapiens
gtggaacaatcgtgcggtcagctccacctgccacaacccttcctgaaagatccaggcccacagaaaagccaggatcctgtctttaaagactgctctgctctcccacctcatcctgtgtccaataaccgcaccttccaacagcgtttctaaccctgttctctccaagcgtggcctgcagcacctctccaggcctctgtgagtagacaccatctttctccaccttgttcttacccaagcccacatatttattcccagaatcctagccttcatttctgttgtcattattttttagctggcaggaagagagggaaggaagataaggtaggaaaaggcaaaagaaaagcatttttcccatttgcctcagtcaaatgattgcattaaacagctcttcaagccgagttgacattttcttcccaaaaatctccaattgaatttttctccctgggtcaactcat

SEQ ID NO: 409269 - DNA, 1162 bp, Homo sapiens
gtggaacaatcgtgcggtcagctccacctgccacaacccttcctgaaagatccaggcccacagaaaagccaggatcctgtctttaaagactgctctgctctcccacctcatcctgtgtccaataaccgcaccttccaacagcgtttctaaccctgttctctccaagcgtggcctgcagcacctctccaggcctctgtgctgacagctgcctcaccttaagagtctcctttcgttatggcatctggaaagatctcacatggcaggcctgcttctagttccttcttcctagtgtgtctgaggaaatccaatctctcccactccagcccgcctactcattgaacatggctgctatctctgtcttctggaaacacggctccaatcctgcaacaactctatacaagagctcccagtgaaagctttcactagaccttgatggcactatggtcattatcttgtcaaaactgtggtggatttgaagagctagtgatgaagaatggaggtttcctgtcctagaaataaccaaaggcccaggcttggaggtggcagaaaaagtggcacttaagttactagcccagtatttggaatttgccaaagctatattcctcagaatttacttcaagagctcctttgtatcggcggagaatgaagaacggagaagaggaggaggaggttgaaagaaacttaagagatgtggcaactaattgcaacgtgtagattgtatttagctcatgattcacacaaactagatatttgttattaaagaattatggttgtttttggtgtgatattagtattgtgctcacatttcttaagaatctatctttagagataggtgctgaaattcttgcagatgaaatgacattatcatctgagatgtgcttcaaaaacagttaaaggagatatcgataagatggccttgaattcacaattgctgaagatgggtataggccacatggagttttattataatcttttctctccttttatattgtttgtagttttccattataagttaaaatgaagaaaataagtcaaccaacatgaagcggtcagtgagattcttacggacatcccagctttgcctcttatccgcctgacatagtcatggaactagaaagacaagcacaatttgccaagcatcagagtggcatcttgaaactgc

SEQ ID NO: 409270 - DNA, 1167 bp, Homo sapiens
aatgactcttcccctcatcagctatgtgacaagaagtcactaaacttttctatatctcggcttctttattaataaaatgagaggtgggattaggttacctccaaggttttaacattctttgatcttatacaaatgccagtgaagaagcatttttatttttaataacactttcctcttcagatggccaagttattgtgattgaaggcattccaggaaacaggaaacagtggcggcatgaagctccaggaactttaatgagtgttttggcagcagcacatctaacgagtagctcattttctgccgatgaagaatttgcaatgggaacattaaaacaatggctacccaaagaagaagatgaagggaaggtagaaatggtctctggcattgaagtagatgaggaacaactagaaccaagatctgatgatgatgatacaaattttgaagaatctgaagatgagttgagagatgaagtagtagaatacttagaaaaactcgctactttcaaaggggaagaaaaaacagaagaggcctccagtacctctaaggactctagaaagtcaagagaaagagaggggataagtatgcagaaatctgaagaattaagggagggcttggagaatatttctactacatctaatgaccacatttgtattactgatgaagaccaaggaacatcaacaaccagtcaaaatatacaagtgtgattattgtactttttcttaagtaataagttagtgtctattacctatagtatttatttgggtacaagtcataaatgctcatttactgtaagggttttctagtaatctcaaggatttattaatttttctttcaatttaggaagtagaacttttgaatatagccattaatatttttactttaaagtttctattaagaaatcttaggccgggcagtctcatcactttgggaggccaaggcaggcagatcatgaggtcaggagtttgagaccagtccaaccaacatggtgaaaccccgtctctactaaaaatacaaaattagctgggcatggtggtgcatgcctgtaatcccagttacttgggaggctgaggcaggagaatcacctgaacccaggagatggaagttgcaagtgagccgagattgtgccactgcactccagcctgggcaacaagagcgaaactctgtctc

SEQ ID NO: 409271 - DNA, 1098 bp, Homo sapiens
ggctttagaatttcaccatatgaattttgggagagaggagcacagttcagcccataactaacacacgacggaatgaagttgataatagtgagaccttgttggtacaagactatgtaacataacctgcgcttctcaacaaagaattgcttttctgacttctgcactcaatagcaagacaaatctctcctctgccttctccttatcagactactcaacatgaaggcaataagaatgaagacctctatgtataattgacttccacttaataaataaggttacttggtacactggtcgacaaaaccttgaaatgttgatgtttaagggctgttgattgctggcagcaaagaagtccaactgtgctggtacccgagatagcgtctccacattttcttccaggatcatcacctttgttctaaatagctcccacatagtgtgaacagaagtcatatgttttagattttctgccttggcacccaggaaaccagtatgattgagtaaacatattaaacttcctctgcatttccagcctgaacagatgttgagtacaagctgatccacctacgttcaacctgagagagtccacatccacagactgtttcatttccctttttcaatttacatagaggcatagattcttgctggcatatacaaatgcgccatttaaggcaatcaaaaatggttccacatctcatctgatttccacaattgttgctgtaacgatggactactgaggagagagacaatttctctggcacatcttcccacgttttagcaacatgttcatggagagccaatattcagtaattacagcccaattcctcacaatttcacaattcgctaacaatatgcattttcacaatgtaaagctgattttcctttaaccaaatcaaacatgaaaagatagctgcatgcaatgggcaatctagatcattagaagattgatgtaaaattagaggacactgagactggaatagattgcaaacttcagggagctcagaaaacttgtaaactctacattttgaggaaatatgttgtcgatgcttttgcaactctatgcagtaacttaacaaataaagccttaaagtaacttaactacga

SEQ ID NO: 409272 - DNA, 407 bp, Homo sapiens
gtctgagaatatttctaggagcatttcaccagtagaaaacaaaaattctaacaacagttaagctaatgaataaaggctgtggcattgatccacaatgaagacagctaaagccctgaagcagccttttctgaagtgtggacttctgattagagtctttcacttgcaccagtgttcattctcaatgaggggacttcaggtagtaactaagcatcatacggtgtagcttaaatggaacacacatgcaaacatacacacttgtgagtgtgtgtgcccatgctgtagtattttaaactatgggcaacataacagtagtatttaccagggtccagtcacttgagacttcccttctggaattctgtcatacacccccacctcctgcaataaaatagtagcatcggcaaaaaaaa

SEQ ID NO: 409273 - DNA, 487 bp, Homo sapiens
gcactccagcctgggtgacagagcgagactccatctcaaaaaaaaacccaaaaaacctgtggcttctgccttgtcgtctgtccctgggattactccctctgggagaaagcaggtgtcatgtcaaggggacacccaaacagctctgtggagagttcagtgccatgaggaactaagatctcctcccacagccgtgcagccgtgtcgggaacttgagggtgaatccccaagcacagtgaaatcttcggatgacagcagccccagcagcatcttgattgccgcctcgtgagtgatcctaaaacagaaactttcagctaatttgcctcctcatttctgacccacacaaactgagattcaaaaacgtgttgcttgtgttaagccctcaagttctggggtaatttgttacacaacaatagcaggaagaaaaggagaagtatcactctttttgctgcacaaatgtgaaaactcacaataaagagaagggagaaag

SEQ ID NO: 409274 - DNA, 590 bp, Homo sapiens
tgattttggccaaagcataagaaaggaagaggtggacctcctctatatataatatgtgaagcaaataagataactggattatagctaaaagagtagcaagacatagacagagtctgtctacataacagtttttaaaagaagcacaaagacaggctggacatggtggcccacacctgtaatcccaatactttgggaggacaaggtaggaggatcacttgaggccaagagtttgagaccagccttgggcagcatattgaggccccatctctacaataaacaaacagatttttaaaatttagctaggaatgtagtggggtgtgcctgtagtctcagcctcctaaagaattgggattatagtcatgagccactgtgaccggctacaattttcaagtctacaatatattattattgactgtagaaaccatattgtacaatagctcttcataacttactcctcctgtctaatggaaactttgtaccctttgaccatcatctcctccccattctcccaccaatccccaatctggtgtgaattttctgaattgatacctatattgatccagggttaaataaacaaagtataatactat

SEQ ID NO: 409275 - DNA, 808 bp, Homo sapiens
cgtagtccgactagcagcagccgctgctccccggtggttcagagccgcgcgagctgagcgtttcgcctacaaaagcatcttcggatcggtttcccaccgccgaatgttgcttgagccaatgtgactggctctaggaggaaataaatcacatctgtcaaaagagcctcgagtcgaaggataggagaaacctcgaatttggtgggtgctgaccaaggcaccatgcaaggggttaactttgctttagggggtgacctggctggctgctgcagttgccgttaacagccaccgaatggatgagactccagatccacctcctcctgcgttcctcaaaacaggaagatggagaactacggagagctacttcccagaggggccgatggcaagcactcccttcaaggaaactggggaagttgcccgattttgatcgtttccatccaaacacccaccagacaatatatacatacacatttctaaattaacagcattggcaaaaactgaaaatacttgtatttaaagttgatgacagtatgaaaacaagaaatccgtccgggcgcggtgggtcacgcctgtaaccccagcactgatcacaaggtcaggagttcgagactagcctggctaacatggtgaaacccccttctctacaaaaattggctgggcgtagtggcgcgtgcctgtattcccagctacttgggaggctgaggcaggagaatagcttgagcccgggaggtggaggttgccgtgagcagaaatggcaccactgcactccagcctgggcgacagagtaagactctgtccccgcccccctcca

SEQ ID NO: 409276 - DNA, 514 bp, Homo sapiens
ctgaatgttctcccaaggggtactgtaaaggggacatgagagaagggatgatacagctcgataaccggtttccttcaccttccttcaggcccagcctgcagcctgcaagcaccggatgagtggacgtggctgagcagccatgagaaagatgtggggctctccggtgactgtagacccagcataaatcaacagttcaaggtgctcatccccaaagccatggtgagaccttagctgctgtaataaaagtgtagtgccaaagtaagggcaatgacagtcttgcttggttttatgctggagctcaactctgggccacactcttttgtgggggtgggtggtaattatcttttttaaacaagacactggctatatacagtcaagtgtgcaaggcttaagtatacaactcatgtaattttcccacatttatatacctatgtagacattcaaatgaagatactaaacatttccagcccccaagaaaacttccttaaattccctcctgggaatctggcagaga

SEQ ID NO: 409277 - DNA, 1301 bp, Homo sapiens
aactttttcattttctcagactaaaaactctgtccctattaaacactaactcccctttctctcctcccccagcccctggcaaccacattctcctttctgtctatgcgaattggactactccgggggccaccgatgactggagtcatgctgtgttgtctctttgcgactggaatcctgtctctttaacatccttggatctgtccctcctctcccttctcacggcactgcctcttatgatctcagtgagtacagtggtctccaaactagtcccctgcctcagttctccctccttcctatcctcactcaactcagcctccaaatgatcttggtgaaaatcagtcctcatgctactcccaagctgaaaactccaactgcttcccaagctccaactcctaagctccaactgcttcccaagttccaactgcttcccatggatggatagagagcatgtctttaaagcgcacctcaccacacaggctcccggcacccctggttgggataatgcccccctctgctcccacacctctgtaggaagctctaaagaagcagcgctgcccctgcctagcggaggagactgggactccccacatctctctgtgttcccagattgagccgggcaagatcacatctgacatctgcacatctcagcgcccagcccctgcctggctcagagtgaagtgtcttccaatccattgaaatttctagtcccggggtctcgaggacactagggccactgtgcaatggcagaaggagcattgccatagaagtcagggggcctggttacaagtcctgactttagttgaggacctgccatatgaccttgagcaaactgctgtacttctctggatctcagtttctacaacctaattcactgggcccagcctgcagcctgcaagcaccggatgagtggacgtggctgagcagccatgagaaagatgtggggctctccggtgactgtagacccagcataaatcaacagttcaaggtgctcatccccaaagccatggtgagaccttagctgctgtaataaaagtgtagtgccaaagtaagggcaatgacagtcttgcttggttttatgctggagctcaactctgggccacactcttttgtgggggtgggtggtaattatcttttttaaacaagacactggctatatacagtcaagtgtgcaaggcttaagtatacaactcatgtaattttcccacatttatatacctatgtagacattcaaatgaagatactaaacatttccagcccccaagaaaacttccttaaattccctcctgggaatctggcagaga

SEQ ID NO: 409278 - DNA, 377 bp, Homo sapiens
ctcacggcatctggcacatggtactacataagcatgtgctgaactagatgaagaaagaagacagtggtgaaaagatctgagccacagcagaagccccaagtcgcctagaggcaatcaaagcgagagtgggatgtcatgatgtgacaatgagttatgacccatgagccctccttcctacaatgctcagtaatctcaaagctgaaacagcactatgccagagatgaaaaatcgacatttctgtctggatcctaagatctgaaagtggaaaagtaatacaaggcagtgaggagtctagaaaataggtctcctcaaaatgggtaaaggatctggaaatgttgaatctggagaagaaaaatctaagggaagaaacaaaaaat

SEQ ID NO: 409279 - DNA, 315 bp, Homo sapiens
cacaattaaataaccatcaacctgccctcactgtgcctgaacttaaaagtcaataacacctgagcatcaataggctattgactatgcaattttactttataccatatatgggtatctgatgttcctgggaaactaactgcaaatgtggtgtaaataaagactaatcatttcaactccattaaatgtagggaagctacaagagcagatttaaaacgttgtgaactgcaaaatgagatggcacccctctacatttacgttagtagagggcttctgtttagagtaatcatagatctggttatttagatactttcccaa

SEQ ID NO: 409280 - DNA, 1061 bp, Homo sapiens
ccccataccgcgaactttgtagctggtgccttcggaatatgatggcaaatcaccttgtaaagcctgataatagaaattgcaagaggccaagagaattggagtctccagtgccagatagtccacagctgtcctctcttggaaaatcagattcatctttctctgaaatttccggactattttataaagatgaagccttggagaaagatttaaatgatgtgagcaaggaaattaatctaatgttgtctacctatgcaaagcttttaagtgagagagcagcagtagatgcatcttacattgatgagatagatgaactcttcaaagaagccaatgctattgaaaactttctaatacaaaaaagagagttcctgcgacagaggtttacagtgattgcaaacacattacacagataaaatatatacttgaaataagctgagaatttaacctattattgttataatgaaagaatgacatttatgctttgaaagctctcgagttgttaaagaaaatgtatatctcgaatagagaaggggaaactccttgaatttctaggtttaaaaaggaacttttaaattccttaatgttaatattaatgttcatgttaatgtcctaagctggccattaacatgaactacgtcacttttcttttgagggtcaaatatttagtgcattttatagaagtgtaaattatttaaatcttatgtggattcttttattttttccttaaacttcttagtgtttctgaaacttctaaaaaaggattcagttaatttataatgtttaataatattatacttttaggatattttgtttaaatatcagatagttttggagataattttgaaattttttttatggtcaggattataaaagaagattaaaaccttagaggtgatttttccagtttcttagaatataatgacataactgtgtgctatttccatttgattattttcactattagttattatgtatgactaataaaagctctcggcttaaaattattttcttgtggtaaaagtagtaaaataaaaaccagaaattactcaccagaaaaaaaatga

SEQ ID NO: 409281 - DNA, 1158 bp, Homo sapiens
ttcactccctcgcgttcgctgacgaggaaggtccccataccgcgaagtacattggccttggggtggggctggagggatgggcgcctgtgagaatgtgacggactgtgacacaaggaaggctggtgccttcggaatatgatggcaaatcaccttgtaaagcctgataatagaaattgcaagaggccaagagaattggagtctccagtgccagatagtccacagctgtcctctcttggaaaatcagattcatctttctctgaaatttccggactattttataaagatgaagccttggagaaagatttaaatgatgtgagcaaggaaattaatctaatgttgtctacctatgcaaagcttttaagtgagagagcagcagtagatgcatcttacattgatgagatagatgaactcttcaaagaagccaatgctattgaaaactttctaatacaaaaaagagagttcctgcgacagaggtttacagtgattgcaaacacattacacagataaaatatatacttgaaataagctgagaatttaacctattattgttataatgaaagaatgacatttatgctttgaaagctctcgagttgttaaagaaaatgtatatctcgaatagagaaggggaaactccttgaatttctaggtttaaaaaggaacttttaaattccttaatgttaatattaatgttcatgttaatgtcctaagctggccattaacatgaactacgtcacttttcttttgagggtcaaatatttagtgcattttatagaagtgtaaattatttaaatcttatgtggattcttttattttttccttaaacttcttagtgtttctgaaacttctaaaaaaggattcagttaatttataatgtttaataatattatacttttaggatattttgtttaaatatcagatagttttggagataattttgaaattttttttatggtcaggattataaaagaagattaaaaccttagaggtgatttttccagtttcttagaatataatgacataactgtgtgctatttccatttgattattttcactattagttattatgtatgactaataaaagctctcggcttaaaattattttcttgtggtaaaagtagtaaaataaaaaccagaaattactcaccagaaaaaaaatga

SEQ ID NO: 409282 - DNA, 467 bp, Homo sapiens
tcaggtgggaggcagaagaaatagacaaactcctaaggccttttcccatcaaagtctgctttgttcaaaggtccatttccctttattagcctgcactcttaggctatggctgtaaacagaataaacagtacaactgaggctactatccaagtagttcatttctaaaactcctgctttcattgcaaatgtctcagtgctttttgccctaaattatacatatactatcataattttatattacatttcattttccatgtatagatagacagacttatgttaactaaggagttcatctaagattataacgtattctaaaaacaaaaaaagattataatgtattctgtttgctatgcttggtaatgaagaacaaggcattgaattacaaagttcctaaagtcattgacatggcaagatgaattccattctggtcagtaaaaagagagtttatttttctaaggtcctgaaaa

SEQ ID NO: 409283 - DNA, 512 bp, Homo sapiens
gggtaaaattgaatccatttcaccaataaattaagtaattaatcctttaaaacagatgctagatgttgtaccagcataattatatccagtgtacttacacagtcttgaatacattaagaaaatactgtttgtttagaagagtttcaaaacatttgagagggaggaaggcactcttccattgacccttagtgtgtgctttagttccatttggggttgactgttttgtgttgctgcgtgatgcctctagtacaaggccaaggcctccatgcctcatgcgtcctgctcccctcctctgccatccctcttccagcattaaccagtccatgtttgttaatcaaccacctccatataccacatccagcaaagctccctgagtgactcacagtcacaaacaaccagggcacggatctttcctctgtgtgcttccaggttcttctgaggacaacctgagtttagtatgcctaccacgaagtgaagatgatgactgtgatgatgatgatgatgatgcccag

SEQ ID NO: 409284 - DNA, 3224 bp, Homo sapiens
caacgctcagcgaaattgactgccccactgtcatctgcctctcaatttggtactctgtaactctgtgaccaccaagaagcctttttccgtcccccacaaagctctttttggaaaattccctacgggagctgaattttaagcccatttactttataggaagaaacagaaaggcagcatgtcagctgaaacaccaatcacattgaatatcgatcctcaggatctgcaggtccaaacattcaccgtggagaagctactggagcctctcataatccaggttaccacacttgtaaactgtccccagaacccttccagcaggaaaaaaggacgttcgaaaagagccagtgtccttctagcttctgtggaggaagcaacttggaatttattagacaagggagagaagattgcccaggaagctacagttttaaaggatgagcttacggcttcacttgaggaagttcgcaaagaaagtgaagctctgaaagtatcagctgagagatttacagatgacccctgttttctcccaaaaagggaggctgtggttcaagctgcccgtgccttgctggctgcggtgacgagactccttatccttgcggacatgattgatgtcatgtgcctcttgcaacatgtgtcagcttttcaaaggacatttgagtctctcaaaaatgttgccaacaaatctgacctccagaaaacctaccagaagcttggaaaggagctggaaaatttggattatttagccttcaaacgtcagcaggacttaaaatctccaaatcagagagatgaaattgcaggagcccgagcttcactgaaggagaactctcccctcttgcattcaatttgttcagcttgtttggagcattctgatgttgcttccctcaaagcaagcaaggacacagtttgtgaagaaattcagaatgctctcaatgtaatttcaaatgcttcacaagggatccagaatatgacaaccccaccagaacctcaggcagcaaccctgggaagtgcccttgatgagctggagaatttaattgtcctgaatccactcacagtaactgaggaggaaatacgaccatcactagagaaacgccttgaagccattatcagtggggctgctctgctggcggattcttcatgtacgagggacttacaccgagagcggattatcgcagaatgcaacgccattcgccaggctcttcaggatctgctttcagagtacatgaacaacgctggaaaaaaagaaaggagtaataccctgaatattgctttagacaacatgtgtaagaagacaagagaccttcgcagacagctccgcaaggctattatagatcatgtgtcagactctttcctggatacgacagtccctcttttggttctcattgaagctgctaagaatggccgggaaaaggaaataaaagaatatgctgcgatatttcatgaacacaccagcaggcttgtagaggtggcaaatcttgcttgttccatgtcaacaaatgaagatggaattaaaattgtcaaaattgcagccaatcatttggaaaccttgtgtccacagattattaatgctgcacttgctttggctgcaagacccaaaagtcaagcggtcaaaaacaccatggaaatgtacaagcgtacatgggagaatcatatacatgtcctcactgaagccgtagatgacattacaagcattgatgacttccttgctgtatctgaaagccatatcttggaagatgtcaacaagtgtatcatagccttaagagaccaggatgctgataatttagaccgtgctgcgggtgctatcagaggccgggcagcaagagttgctcacatcgtcacgggtgaaatggacagttacgagccaggggcttacacggaaggtgtaatgagaaatgttaacttccttacaagtactgtaattcctgaatttgtaacacaagtgaatgttgccttggaagccttaagcaaaagctcattgaatgtgttggatgataatcaatttgtggacatctcaaagaagatctatgatacaattcatgatatcagatgttcagtcatgatgattcggaccccagaggaactggaggatgtttctgaccttgaagaggaacacgaggtccgcagtcacaccagcattcagaccgaagggaaaactgatagggctaagatgactcaactgcctgaggcagaaaaagaaaagattgctgagcaagttgctgatttcaagaaagtaaagagtaagctggatgctgagattgagatatgggatgatacaagcaacgacatcattgttctggccaagaacatgtgtatgatcatgatggagatgacagacttcactaggggcaaaggaccactaaagcatacaactgatgtgatctatgcagcgaaaatgatatcagaatcaggatcaaggatggatgtccttgctcggcagattgctaatcagtgcccagatccatcttgtaaacaggacttgttggcctacctggaacagattaagttctactcccaccaactgaaaatctgcagtcaagttaaagctgagatccagaacctgggaggagagctcatcatgtcagctttggacagtgtcacatccctgatccaagcagccaaaaatttaatgaatgctgtagtgcaaacagtgaaaatgtcttacattgcctcaaccaagatcatccgaatccagagtcctgctgggccccggcacccagttgtgatgtggagaatgaaggctcctgcaaaaaaacccttgattaaaagagagaagccagaggaaacgtgtgcagctgtcagacgaggctcagcaaagaaaaaaatccatccattgcaagtcatgagtgaatttagaggaagacaaatctactgaaaccactattctacatatagtgcctatatgacaaaatcctgcctaaccacactgctttattttacacttaagaagttctgtaatttcactaagttttggtgtttaactcacaaataacataaaatattgggcgctaaatcaacaaaagcaatatatatttgggatcatatcactgtcatttctgtatggtcagcacctaatagttaaggaatatttgcttgttgaatgaatgaaattatcacgtgtcattcagcgtttcccatcatagagattatctactattcgttaccaaataaacacagttgttagcgacaagttacgcccttcttattacggtgactagttaactatgggtatttaa

SEQ ID NO: 409285 - DNA, 3211 bp, Homo sapiens
caacgctcagcgaaattgactgccccactgtcatctgcctctcaatttggtactctgtaactctgtgaccaccaagaagcctttttccgtcccccacaaagctctttttggaaaattccctacgggagctgaattttaagcccatttactttataggaagaaacagaaaggcagcatgtcagctgaaacaccaatcacattgaatatcgatcctcaggatctgcaggtccaaacattcaccgtggagaagctactggagcctctcataatccaggttaccacacttgtaaactgtccccagaacccttccagcaggaaaaaaggacgttcgaaaagagccagtgtccttctagcttctgtggaggaagcaacttggaatttattagacaagggagagaagattgcccaggaagctacagttttaaaggatgagcttacggcttcacttgaggaagttcgcaaagaaagtgaagctctgaaagtatcagctgagagatttacagatgacccctgttttctcccaaaaagggaggctgtggttcaagctgcccgtgccttgctggctgcggtgacgagactccttatccttgcggacatgattgatgtcatgtgcctcttgcaacatgtgtcagcttttcaaaggacatttgagtctctcaaaaatgttgccaacaaatctgacctccagaaaacctaccagaagcttggaaaggagctggaaaatttggattatttagccttcaaacgtcagcaggacttaaaatctccaaatcagagagatgaaattgcaggagcccgagcttcactgaaggagaactctcccctcttgcattcaatttgttcagcttgtttggagcattctgatgttgcttccctcaaagcaagcaaggacacagtttgtgaagaaattcagaatgctctcaatgtaatttcaaatgcttcacaagggatccagaatatgacaaccccaccagaacctcaggcagcaaccctgggaagtgcccttgatgagctggagaatttaattgtcctgaatccactcacagtaactgaggaggaaatacgaccatcactagagaaacgccttgaagccattatcagtggggctgctctgctggcggattcttcatgtacgagggacttacaccgagagcggattatcgcagaatgcaacgccattcgccaggctcttcaggatctgctttcagagtacatgaacaacgctggaaaaaaagaaaggagtaataccctgaatattgctttagacaacatgtgtaagaagacaagagaccttcgcagacagctccgcaaggctattatagatcatgtgtcagactctttcctggatacgacagtccctcttttggttctcattgaagctgctaagaatggccgggaaaaggaaataaaagaatatgctgcgatatttcatgaacacaccagcaggcttgtagaggtggcaaatcttgcttgttccatgtcaacaaatgaagatggaattaaaattgtcaaaattgcagccaatcatttggaaaccttgtgtccacagattattaatgctgcacttgctttggctgcaagacccaaaagtcaagcggtcaaaaacaccatggaaatgtacaagcgtacatgggagaatcatatacatgtcctcactgaagccgtagatgacattacaagcattgatgacttccttgctgtatctgaaagccatatcttggaagatgtcaacaagtgtatcatagccttaagagaccaggatgctgataatttagaccgtgctgcgggtgctatcagaggccgggcagcaagagttgctcacatcgtcacgggtgaaatggacagttacgagccaggggcttacacggaaggtgtaatgagaaatgttaacttccttacaagtactgtaattcctgaatttgtaacacaagtgaatgttgccttggaagccttaagcaaaagctcattgaatgtgttggatgataatcaatttgtggacatctcaaagaagatctatgatacaattcatgatatcagatgttcagtcatgatgattcggaccccagaggaactggaggatgtttctgaccttgaagaggaacacgaggtccgcagtcacaccagcattcagaccgaagggaaaactgatagggctaagatgactcaactgcctgaggcagaaaaagaaaagattgctgagcaagttgctgatttcaagaaagtaaagagtaagctggatgctgagattgagatatgggatgatacaagcaacgacatcattgttctggccaagaacatgtgtatgatcatgatggagatgacagacttcactaggggcaaaggaccactaaagcatacaactgatgtgatctatgcagcgaaaatgatatcagaatcaggatcaaggatggatgtccttgctcggcagattgctaatcagtgcccagatccatcttgtaaacaggacttgttggcctacctggaacagattaagttctactcccaccaactgaaaatctgcagtcaagttaaagctgagatccagaacctgggaggagagctcatcatgtcagctttggacagtgtcacatccctgatccaagcagccaaaaatttaatgaatgctgtagtgcaaacagtgaaaatgtcttacattgcctcaaccaagatcatccgaatccagagtcctgctgggccccggcacccagttgtgatgtggagaatgaaggctcctgcaaaaaaacccttgattaaaagagagaagccagaggaaacgtgtgcagctgtcagacgaggctcagcaaagaaaaaaatccatccattgcaagtcatgagtgaatttagaggaagacaaatctactgaaaccactattctacatatagtgcctatatgacaaaatcctgcctaaccacactgctttattttacacttaagaagttctgtaatttcactaagttttggtgtttaactcacaaataacataaaatattgggcgctaaatcaacaaaagcaatatatatttgggatcatatcactgtcatttctgtatggtcagcacctaatagttaaggaatatttgcttgttgaatgaatgaaattatcacgtgtcattcagcgtttcccatcatagagattatctactattcgttaccaaataaacacagtcggcaagatttttttttttttttttatttatgtctgtattttata

SEQ ID NO: 409286 - DNA, 3542 bp, Homo sapiens
caacgctcagcgaaattgactgccccactgtcatctgcctctcaatttggtactctgtaactctgtgaccaccaagaagcctttttccgtcccccacaaagctctttttggaaaattccctacgggagctgaattttaagcccatttactttataggaagaaacagaaaggcagcatgtcagctgaaacaccaatcacattgaatatcgatcctcaggatctgcaggtccaaacattcaccgtggagaagctactggagcctctcataatccaggttaccacacttgtaaactgtccccagaacccttccagcaggaaaaaaggacgttcgaaaagagccagtgtccttctagcttctgtggaggaagcaacttggaatttattagacaagggagagaagattgcccaggaagctacagttttaaaggatgagcttacggcttcacttgaggaagttcgcaaagaaagtgaagctctgaaagtatcagctgagagatttacagatgacccctgttttctcccaaaaagggaggctgtggttcaagctgcccgtgccttgctggctgcggtgacgagactccttatccttgcggacatgattgatgtcatgtgcctcttgcaacatgtgtcagcttttcaaaggacatttgagtctctcaaaaatgttgccaacaaatctgacctccagaaaacctaccagaagcttggaaaggagctggaaaatttggattatttagccttcaaacgtcagcaggacttaaaatctccaaatcagagagatgaaattgcaggagcccgagcttcactgaaggagaactctcccctcttgcattcaatttgttcagcttgtttggagcattctgatgttgcttccctcaaagcaagcaaggacacagtttgtgaagaaattcagaatgctctcaatgtaatttcaaatgcttcacaagggatccagaatatgacaaccccaccagaacctcaggcagcaaccctgggaagtgcccttgatgagctggagaatttaattgtcctgaatccactcacagtaactgaggaggaaatacgaccatcactagagaaacgccttgaagccattatcagtggggctgctctgctggcggattcttcatgtacgagggacttacaccgagagcggattatcgcagaatgcaacgccattcgccaggctcttcaggatctgctttcagagtacatgaacaacgctggaaaaaaagaaaggagtaataccctgaatattgctttagacaacatgtgtaagaagacaagagaccttcgcagacagctccgcaaggctattatagatcatgtgtcagactctttcctggatacgacagtccctcttttggttctcattgaagctgctaagaatggccgggaaaaggaaataaaagaatatgctgcgatatttcatgaacacaccagcaggcttgtagaggtggcaaatcttgcttgttccatgtcaacaaatgaagatggaattaaaattgtcaaaattgcagccaatcatttggaaaccttgtgtccacagattattaatgctgcacttgctttggctgcaagacccaaaagtcaagcggtcaaaaacaccatggaaatgtacaagcgtacatgggagaatcatatacatgtcctcactgaagccgtagatgacattacaagcattgatgacttccttgctgtatctgaaagccatatcttggaagatgtcaacaagtgtatcatagccttaagagaccaggatgctgataatttagaccgtgctgcgggtgctatcagaggccgggcagcaagagttgctcacatcgtcacgggtgaaatggacagttacgagccaggggcttacacggaaggtgtaatgagaaatgttaacttccttacaagtactgtaattcctgaatttgtaacacaagtgaatgttgccttggaagccttaagcaaaagctcattgaatgtgttggatgataatcaatttgtggacatctcaaagaagatctatgatacaattcatgatatcagatgttcagtcatgatgattcggaccccagaggaactggaggatgtttctgaccttgaagaggaacacgaggtccgcagtcacaccagcattcagaccgaagggaaaactgatagggctaagatgactcaactgcctgaggcagaaaaagaaaagattgctgagcaagttgctgatttcaagaaagtaaagagtaagctggatgctgagattgagatatgggatgatacaagcaacgacatcattgttctggccaagaacatgtgtatgatcatgatggagatgacagacttcactaggggcaaaggaccactaaagcatacaactgatgtgatctatgcagcgaaaatgatatcagaatcaggatcaaggatggatgtccttgctcggcagattgctaatcagtgcccagatccatcttgtaaacaggacttgttggcctacctggaacagattaagttctactcccaccaactgaaaatctgcagtcaagttaaagctgagatccagaacctgggaggagagctcatcatgtcagctttggacagtgtcacatccctgatccaagcagccaaaaatttaatgaatgctgtagtgcaaacagtgaaaatgtcttacattgcctcaaccaagatcatccgaatccagagtcctgctgggccccggcacccagttgtgatgtggagaatgaaggctcctgcaaaaaaacccttgattaaaagagagaagccagaggaaacgtgtgcagctgtcagacgaggctcagcaaagaaaaaaatccatccattgcaagtcatgagtgaatttagaggaagacaaatctactgaaaccactattctacatatagtgcctatatgacaaaatcctgcctaaccacactgctttattttacacttaagaagttctgtaatttcactaagttttggtgtttaactcacaaataacataaaatattgggcgctaaatcaacaaaagcaatatatatttgggatcatatcactgtcatttctgtatggtcagcacctaatagttaaggaatatttgcttgttgaatgaatgaaattatcacgtgtcattcagcgtttcccatcatagagattatctactattcgttaccaaataaacacagtgtaaaagggggggcctcctagggccccttttttttttagaaatatgttgaggggccctatctccccccctttttggagaatttaaaccccaaaaaaagaggggcccaaaggggggttttaaaaaagaaaaaaaaggttttttaaaaaaattttttccccctttaaacccccccgctttttttttggattaaggcgggccccccccgggggaagatgggttttcccccaaaaaaaccaccttttaatctctagatagctgtactcattgtcaacttattaggctaatatccattataaactaatcaaatttgaatagttaggctacttgctggattttgaaggtcaaccttgtttattaataaaatgctttcttaac

SEQ ID NO: 409287 - DNA, 3204 bp, Homo sapiens
caacgctcagcgaaattgactgccccactgtcatctgcctctcaatttggtactctgtaactctgtgaccaccaagaagcctttttccgtcccccacaaagctctttttggaaaattccctacgggagctgaattttaagcccatttactttataggaagaaacagaaaggcagcatgtcagctgaaacaccaatcacattgaatatcgatcctcaggatctgcaggtccaaacattcaccgtggagaagctactggagcctctcataatccaggttaccacacttgtaaactgtccccagaacccttccagcaggaaaaaaggacgttcgaaaagagccagtgtccttctagcttctgtggaggaagcaacttggaatttattagacaagggagagaagattgcccaggaagctacagttttaaaggatgagcttacggcttcacttgaggaagttcgcaaagaaagtgaagctctgaaagtatcagctgagagatttacagatgacccctgttttctcccaaaaagggaggctgtggttcaagctgcccgtgccttgctggctgcggtgacgagactccttatccttgcggacatgattgatgtcatgtgcctcttgcaacatgtgtcagcttttcaaaggacatttgagtctctcaaaaatgttgccaacaaatctgacctccagaaaacctaccagaagcttggaaaggagctggaaaatttggattatttagccttcaaacgtcagcaggacttaaaatctccaaatcagagagatgaaattgcaggagcccgagcttcactgaaggagaactctcccctcttgcattcaatttgttcagcttgtttggagcattctgatgttgcttccctcaaagcaagcaaggacacagtttgtgaagaaattcagaatgctctcaatgtaatttcaaatgcttcacaagggatccagaatatgacaaccccaccagaacctcaggcagcaaccctgggaagtgcccttgatgagctggagaatttaattgtcctgaatccactcacagtaactgaggaggaaatacgaccatcactagagaaacgccttgaagccattatcagtggggctgctctgctggcggattcttcatgtacgagggacttacaccgagagcggattatcgcagaatgcaacgccattcgccaggctcttcaggatctgctttcagagtacatgaacaacgctggaaaaaaagaaaggagtaataccctgaatattgctttagacaacatgtgtaagaagacaagagaccttcgcagacagctccgcaaggctattatagatcatgtgtcagactctttcctggatacgacagtccctcttttggttctcattgaagctgctaagaatggccgggaaaaggaaataaaagaatatgctgcgatatttcatgaacacaccagcaggcttgtagaggtggcaaatcttgcttgttccatgtcaacaaatgaagatggaattaaaattgtcaaaattgcagccaatcatttggaaaccttgtgtccacagattattaatgctgcacttgctttggctgcaagacccaaaagtcaagcggtcaaaaacaccatggaaatgtacaagcgtacatgggagaatcatatacatgtcctcactgaagccgtagatgacattacaagcattgatgacttccttgctgtatctgaaagccatatcttggaagatgtcaacaagtgtatcatagccttaagagaccaggatgctgataatttagaccgtgctgcgggtgctatcagaggccgggcagcaagagttgctcacatcgtcacgggtgaaatggacagttacgagccaggggcttacacggaaggtgtaatgagaaatgttaacttccttacaagtactgtaattcctgaatttgtaacacaagtgaatgttgccttggaagccttaagcaaaagctcattgaatgtgttggatgataatcaatttgtggacatctcaaagaagatctatgatacaattcatgatatcagatgttcagtcatgatgattcggaccccagaggaactggaggatgtttctgaccttgaagaggaacacgaggtccgcagtcacaccagcattcagaccgaagggaaaactgatagggctaagatgactcaactgcctgaggcagaaaaagaaaagattgctgagcaagttgctgatttcaagaaagtaaagagtaagctggatgctgagattgagatatgggatgatacaagcaacgacatcattgttctggccaagaacatgtgtatgatcatgatggagatgacagacttcactaggggcaaaggaccactaaagcatacaactgatgtgatctatgcagcgaaaatgatatcagaatcaggatcaaggatggatgtccttgctcggcagattgctaatcagtgcccagatccatcttgtaaacaggacttgttggcctacctggaacagattaagttctactcccaccaactgaaaatctgcagtcaagttaaagctgagatccagaacctgggaggagagctcatcatgtcagctttggacagtgtcacatccctgatccaagcagccaaaaatttaatgaatgctgtagtgcaaacagtgaaaatgtcttacattgcctcaaccaagatcatccgaatccagagtcctgctgggccccggcacccagttgtgatgtggagaatgaaggctcctgcaaaaaaacccttgattaaaagagagaagccagaggaaacgtgtgcagctgtcagacgaggctcagcaaagaaaaaaatccatccattgcaagtcatgagtgaatttagaggaagacaaatctactgaaaccactattctacatatagtgcctatatgacaaaatcctgcctaaccacactgctttattttacacttaagaagttctgtaatttcactaagttttggtgtttaactcacaaataacataaaatattgggcgctaaatcaacaaaagcaatatatatttgggatcatatcactgtcatttctgtatggtcagcacctaatagttaaggaatatttgcttgttgaatgaatgaaattatcacgtgtcattcagcgtttcccatcatagagattatctactattcgttaccaaataaacacagtaaataaaaaatacaaatggccctcgttggccctcacgt

SEQ ID NO: 409288 - DNA, 910 bp, Homo sapiens
  misc_feature (121)..(121): n is a, c, g, or t
  misc_feature (123)..(123): n is a, c, g, or t
actggaagtccagataatttttggcaaatagagcatatcacaaataaagtgcttcaacagccagtgtattgaaccacaagttctgaacctaagtgcggatgacttttttatttacccccgntncagtgcccagatccatcttgtaaacaggacttgttggcctacctggaacagattaagttctactcccaccaactgaaaatctgcagtcaagttaaagctgagatccagaacctgggaggagagctcatcatgtcagctttggacagtgtcacatccctgatccaagcagccaaaaatttaatgaatgctgtagtgcaaacagtgaaaatgtcttacattgcctcaaccaagatcatccgaatccagagtcctgctgggccccggcacccagttgtgatgtggagaatgaaggctcctgcaaaaaaacccttgattaaaagagagaagccagaggaaacgtgtgcagctgtcagacgaggctcagcaaagaaaaaaatccatccattgcaagtcatgagtgaatttagaggaagacaaatctactgaaaccactattctacatatagtgcctatatgacaaaatcctgcctaaccacactgctttattttacacttaagaagttctgtaatttcactaagttttggtgtttaactcacaaataacataaaatattgggcgctaaatcaacaaaagcaatatatatttgggatcatatcactgtcatttctgtatggtcagcacctaatagttaaggaatatttgcttgttgaatgaatgaaattatcacgtgtcattcagcgtttcccatcatagagattatctactattcgttaccaaataaacacagttgttagcgacaagttacgcccttcttattacggtgactagttaactatgggtatttaa

SEQ ID NO: 409289 - DNA, 1229 bp, Homo sapiens
atataagcaggaaagcttatttataacttgaagggcctcattatctgactgagtagtctgtctcttttttgatagattttcttttccatctttgtggtcagactaatacaccttctgtctacttccaatttactgtaaactgggtcatggaattcaggctaagatgactcaactgcctgaggcagaaaaagaaaagattgctgagcaagttgctgatttcaagaaagtaaagagtaagctggatgctgagattgagatatgggatgatacaagcaacgacatcattgttctggccaagaacatgtgtatgatcatgatggagatgacagacttcactaggggcaaaggaccactaaagcatacaactgatgtgatctatgcagcgaaaatgatatcagaatcaggatcaaggatggatgtccttgctcggcagattgctaatcagtgcccagatccatcttgtaaacaggacttgttggcctacctggaacagattaagttctactcccaccaactgaaaatctgcagtcaagttaaagctgagatccagaacctgggaggagagctcatcatgtcagctttggacagtgtcacatccctgatccaagcagccaaaaatttaatgaatgctgtagtgcaaacagtgaaaatgtcttacattgcctcaaccaagatcatccgaatccagagtcctgctgggccccggcacccagttgtgatgtggagaatgaaggctcctgcaaaaaaacccttgattaaaagagagaagccagaggaaacgtgtgcagctgtcagacgaggctcagcaaagaaaaaaatccatccattgcaagtcatgagtgaatttagaggaagacaaatctactgaaaccactattctacatatagtgcctatatgacaaaatcctgcctaaccacactgctttattttacacttaagaagttctgtaatttcactaagttttggtgtttaactcacaaataacataaaatattgggcgctaaatcaacaaaagcaatatatatttgggatcatatcactgtcatttctgtatggtcagcacctaatagttaaggaatatttgcttgttgaatgaatgaaattatcacgtgtcattcagcgtttcccatcatagagattatctactattcgttaccaaataaacacagttgttagcgacaagttacgcccttcttattacggtgactagttaactatgggtatttaa

SEQ ID NO: 409290 - DNA, 3202 bp, Homo sapiens
agcgggcttttcaggctgtttgcttacagatgcatcataagccaaattgtgagccatgatagtggcactgaatttctaaatacaagaaattgcttagacaattggtttagtatctgtatatgggcaatactctgtcctgcagtagaaggcagcatgtcagctgaaacaccaatcacattgaatatcgatcctcaggatctgcaggtccaaacattcaccgtggagaagctactggagcctctcataatccaggttaccacacttgtaaactgtccccagaacccttccagcaggaaaaaaggacgttcgaaaagagccagtgtccttctagcttctgtggaggaagcaacttggaatttattagacaagggagagaagattgcccaggaagctacagttttaaaggatgagcttacggcttcacttgaggaagttcgcaaagaaagtgaagctctgaaagtatcagctgagagatttacagatgacccctgttttctcccaaaaagggaggctgtggttcaagctgcccgtgccttgctggctgcggtgacgagactccttatccttgcggacatgattgatgtcatgtgcctcttgcaacatgtgtcagcttttcaaaggacatttgagtctctcaaaaatgttgccaacaaatctgacctccagaaaacctaccagaagcttggaaaggagctggaaaatttggattatttagccttcaaacgtcagcaggacttaaaatctccaaatcagagagatgaaattgcaggagcccgagcttcactgaaggagaactctcccctcttgcattcaatttgttcagcttgtttggagcattctgatgttgcttccctcaaagcaagcaaggacacagtttgtgaagaaattcagaatgctctcaatgtaatttcaaatgcttcacaagggatccagaatatgacaaccccaccagaacctcaggcagcaaccctgggaagtgcccttgatgagctggagaatttaattgtcctgaatccactcacagtaactgaggaggaaatacgaccatcactagagaaacgccttgaagccattatcagtggggctgctctgctggcggattcttcatgtacgagggacttacaccgagagcggattatcgcagaatgcaacgccattcgccaggctcttcaggatctgctttcagagtacatgaacaacgctggaaaaaaagaaaggagtaataccctgaatattgctttagacaacatgtgtaagaagacaagagaccttcgcagacagctccgcaaggctattatagatcatgtgtcagactctttcctggatacgacagtccctcttttggttctcattgaagctgctaagaatggccgggaaaaggaaataaaagaatatgctgcgatatttcatgaacacaccagcaggcttgtagaggtggcaaatcttgcttgttccatgtcaacaaatgaagatggaattaaaattgtcaaaattgcagccaatcatttggaaaccttgtgtccacagattattaatgctgcacttgctttggctgcaagacccaaaagtcaagcggtcaaaaacaccatggaaatgtacaagcgtacatgggagaatcatatacatgtcctcactgaagccgtagatgacattacaagcattgatgacttccttgctgtatctgaaagccatatcttggaagatgtcaacaagtgtatcatagccttaagagaccaggatgctgataatttagaccgtgctgcgggtgctatcagaggccgggcagcaagagttgctcacatcgtcacgggtgaaatggacagttacgagccaggggcttacacggaaggtgtaatgagaaatgttaacttccttacaagtactgtaattcctgaatttgtaacacaagtgaatgttgccttggaagccttaagcaaaagctcattgaatgtgttggatgataatcaatttgtggacatctcaaagaagatctatgatacaattcatgatatcagatgttcagtcatgatgattcggaccccagaggaactggaggatgtttctgaccttgaagaggaacacgaggtccgcagtcacaccagcattcagaccgaagggaaaactgatagggctaagatgactcaactgcctgaggcagaaaaagaaaagattgctgagcaagttgctgatttcaagaaagtaaagagtaagctggatgctgagattgagatatgggatgatacaagcaacgacatcattgttctggccaagaacatgtgtatgatcatgatggagatgacagacttcactaggggcaaaggaccactaaagcatacaactgatgtgatctatgcagcgaaaatgatatcagaatcaggatcaaggatggatgtccttgctcggcagattgctaatcagtgcccagatccatcttgtaaacaggacttgttggcctacctggaacagattaagttctactcccaccaactgaaaatctgcagtcaagttaaagctgagatccagaacctgggaggagagctcatcatgtcagctttggacagtgtcacatccctgatccaagcagccaaaaatttaatgaatgctgtagtgcaaacagtgaaaatgtcttacattgcctcaaccaagatcatccgaatccagagtcctgctgggccccggcacccagttgtgatgtggagaatgaaggctcctgcaaaaaaacccttgattaaaagagagaagccagaggaaacgtgtgcagctgtcagacgaggctcagcaaagaaaaaaatccatccattgcaagtcatgagtgaatttagaggaagacaaatctactgaaaccactattctacatatagtgcctatatgacaaaatcctgcctaaccacactgctttattttacacttaagaagttctgtaatttcactaagttttggtgtttaactcacaaataacataaaatattgggcgctaaatcaacaaaagcaatatatatttgggatcatatcactgtcatttctgtatggtcagcacctaatagttaaggaatatttgcttgttgaatgaatgaaattatcacgtgtcattcagcgtttcccatcatagagattatctactattcgttaccaaataaacacagttgttagcgacaagttacgcccttcttattacggtgactagttaactatgggtatttaa

SEQ ID NO: 409291 - DNA, 663 bp, Homo sapiens
  misc_feature (24)..(24): n is a, c, g, or t
  misc_feature (53)..(53): n is a, c, g, or t
tcgatatagaaaaaggggaagaanccttgctggagacgatctcttaattctcncaccgctacagctggacgagtgtcagccaaaaatttaatgaatgctgtagtgcaaacagtgaaaatgtcttacattgcctcaaccaagatcatccgaatccagagtcccagttgtgatgtggagaatgaaggctcctgcaaaaaaacccttgattaaaagagagaagccagaggaaacgtgtgcagctaaagaaaaaaatccatccattgcaagtcatgagtgaatttagaggaagacaaatctactgaaaccactattctacatatagtgcctatatgacaaaatcctgcctaaccacactgctttattttacacttaagaagttctgtaatttcactaagttttggtgtttaactcacaaataacataaaatattgggcgctaaatcaacaaaagcaatatatatttgggatcatatcactgtcatttctgtatggtcagcacctaatagttaaggaatatttgcttgttgaatgaatgaaattatcacgtgtcattcagcgtttcccatcatagagattatctactattcgttaccaaataaacacagttgttagcgacaagttacgcccttcttattacggtgactagttaactatgggtatttaa

SEQ ID NO: 409292 - DNA, 3210 bp, Homo sapiens
caacgctcagcgaaattgactgccccactgtcatctgcctctcaatttggtactctgtaactctgtgaccaccaagaagcctttttccgtcccccacaaagctctttttggaaaattccctacgggagctgaattttaagcccatttactttataggaagaaacagaaaggcagcatgtcagctgaaacaccaatcacattgaatatcgatcctcaggatctgcaggtccaaacattcaccgtggagaagctactggagcctctcataatccaggttaccacacttgtaaactgtccccagaacccttccagcaggaaaaaaggacgttcgaaaagagccagtgtccttctagcttctgtggaggaagcaacttggaatttattagacaagggagagaagattgcccaggaagctacagttttaaaggatgagcttacggcttcacttgaggaagttcgcaaagaaagtgaagctctgaaagtatcagctgagagatttacagatgacccctgttttctcccaaaaagggaggctgtggttcaagctgcccgtgccttgctggctgcggtgacgagactccttatccttgcggacatgattgatgtcatgtgcctcttgcaacatgtgtcagcttttcaaaggacatttgagtctctcaaaaatgttgccaacaaatctgacctccagaaaacctaccagaagcttggaaaggagctggaaaatttggattatttagccttcaaacgtcagcaggacttaaaatctccaaatcagagagatgaaattgcaggagcccgagcttcactgaaggagaactctcccctcttgcattcaatttgttcagcttgtttggagcattctgatgttgcttccctcaaagcaagcaaggacacagtttgtgaagaaattcagaatgctctcaatgtaatttcaaatgcttcacaagggatccagaatatgacaaccccaccagaacctcaggcagcaaccctgggaagtgcccttgatgagctggagaatttaattgtcctgaatccactcacagtaactgaggaggaaatacgaccatcactagagaaacgccttgaagccattatcagtggggctgctctgctggcggattcttcatgtacgagggacttacaccgagagcggattatcgcagaatgcaacgccattcgccaggctcttcaggatctgctttcagagtacatgaacaacgctggaaaaaaagaaaggagtaataccctgaatattgctttagacaacatgtgtaagaagacaagagaccttcgcagacagctccgcaaggctattatagatcatgtgtcagactctttcctggatacgacagtccctcttttggttctcattgaagctgctaagaatggccgggaaaaggaaataaaagaatatgctgcgatatttcatgaacacaccagcaggcttgtagaggtggcaaatcttgcttgttccatgtcaacaaatgaagatggaattaaaattgtcaaaattgcagccaatcatttggaaaccttgtgtccacagattattaatgctgcacttgctttggctgcaagacccaaaagtcaagcggtcaaaaacaccatggaaatgtacaagcgtacatgggagaatcatatacatgtcctcactgaagccgtagatgacattacaagcattgatgacttccttgctgtatctgaaagccatatcttggaagatgtcaacaagtgtatcatagccttaagagaccaggatgctgataatttagaccgtgctgcgggtgctatcagaggccgggcagcaagagttgctcacatcgtcacgggtgaaatggacagttacgagccaggggcttacacggaaggtgtaatgagaaatgttaacttccttacaagtactgtaattcctgaatttgtaacacaagtgaatgttgccttggaagccttaagcaaaagctcattgaatgtgttggatgataatcaatttgtggacatctcaaagaagatctatgatacaattcatgatatcagatgttcagtcatgatgattcggaccccagaggaactggaggatgtttctgaccttgaagaggaacacgaggtccgcagtcacaccagcattcagaccgaagggaaaactgatagggctaagatgactcaactgcctgaggcagaaaaagaaaagattgctgagcaagttgctgatttcaagaaagtaaagagtaagctggatgctgagattgagatatgggatgatacaagcaacgacatcattgttctggccaagaacatgtgtatgatcatgatggagatgacagacttcactaggggcaaaggaccactaaagcatacaactgatgtgatctatgcagcgaaaatgatatcagaatcaggatcaaggatggatgtccttgctcggcagattgctaatcagtgcccagatccatcttgtaaacaggacttgttggcctacctggaacagattaagttctactcccaccaactgaaaatctgcagtcaagttaaagctgagatccagaacctgggaggagagctcatcatgtcagctttggacagtgtcacatccctgatccaagcagccaaaaatttaatgaatgctgtagtgcaaacagtgaaaatgtcttacattgcctcaaccaagatcatccgaatccagagtcctgctgggccccggcacccagttgtgatgtggagaatgaaggctcctgcaaaaaaacccttgattaaaagagagaagccagaggaaacgtgtgcagctgtcagacgaggctcagcaaagaaaaaaatccatccattgcaagtcatgagtgaatttagaggaagacaaatctactgaaaccactattctacatatagtgcctatatgacaaaatcctgcctaaccacactgctttattttacacttaagaagttctgtaatttcactaagttttggtgtttaactcacaaataacataaaatattgggcgctaaatcaacaaaagcaatatatatttgggatcatatcactgtcatttctgtatggtcagcacctaatagttaaggaatatttgcttgttgaatgaatgaaattatcacgtgtcattcagcgtttcccatcatagagattatctactattcgttaccaaataaacacagatcggccgtttttgttttttcgacatgcgaattaaagtattagaa

SEQ ID NO: 409293 - DNA, 3218 bp, Homo sapiens
  misc_feature (3181)..(3181): n is a, c, g, or t
caacgctcagcgaaattgactgccccactgtcatctgcctctcaatttggtactctgtaactctgtgaccaccaagaagcctttttccgtcccccacaaagctctttttggaaaattccctacgggagctgaattttaagcccatttactttataggaagaaacagaaaggcagcatgtcagctgaaacaccaatcacattgaatatcgatcctcaggatctgcaggtccaaacattcaccgtggagaagctactggagcctctcataatccaggttaccacacttgtaaactgtccccagaacccttccagcaggaaaaaaggacgttcgaaaagagccagtgtccttctagcttctgtggaggaagcaacttggaatttattagacaagggagagaagattgcccaggaagctacagttttaaaggatgagcttacggcttcacttgaggaagttcgcaaagaaagtgaagctctgaaagtatcagctgagagatttacagatgacccctgttttctcccaaaaagggaggctgtggttcaagctgcccgtgccttgctggctgcggtgacgagactccttatccttgcggacatgattgatgtcatgtgcctcttgcaacatgtgtcagcttttcaaaggacatttgagtctctcaaaaatgttgccaacaaatctgacctccagaaaacctaccagaagcttggaaaggagctggaaaatttggattatttagccttcaaacgtcagcaggacttaaaatctccaaatcagagagatgaaattgcaggagcccgagcttcactgaaggagaactctcccctcttgcattcaatttgttcagcttgtttggagcattctgatgttgcttccctcaaagcaagcaaggacacagtttgtgaagaaattcagaatgctctcaatgtaatttcaaatgcttcacaagggatccagaatatgacaaccccaccagaacctcaggcagcaaccctgggaagtgcccttgatgagctggagaatttaattgtcctgaatccactcacagtaactgaggaggaaatacgaccatcactagagaaacgccttgaagccattatcagtggggctgctctgctggcggattcttcatgtacgagggacttacaccgagagcggattatcgcagaatgcaacgccattcgccaggctcttcaggatctgctttcagagtacatgaacaacgctggaaaaaaagaaaggagtaataccctgaatattgctttagacaacatgtgtaagaagacaagagaccttcgcagacagctccgcaaggctattatagatcatgtgtcagactctttcctggatacgacagtccctcttttggttctcattgaagctgctaagaatggccgggaaaaggaaataaaagaatatgctgcgatatttcatgaacacaccagcaggcttgtagaggtggcaaatcttgcttgttccatgtcaacaaatgaagatggaattaaaattgtcaaaattgcagccaatcatttggaaaccttgtgtccacagattattaatgctgcacttgctttggctgcaagacccaaaagtcaagcggtcaaaaacaccatggaaatgtacaagcgtacatgggagaatcatatacatgtcctcactgaagccgtagatgacattacaagcattgatgacttccttgctgtatctgaaagccatatcttggaagatgtcaacaagtgtatcatagccttaagagaccaggatgctgataatttagaccgtgctgcgggtgctatcagaggccgggcagcaagagttgctcacatcgtcacgggtgaaatggacagttacgagccaggggcttacacggaaggtgtaatgagaaatgttaacttccttacaagtactgtaattcctgaatttgtaacacaagtgaatgttgccttggaagccttaagcaaaagctcattgaatgtgttggatgataatcaatttgtggacatctcaaagaagatctatgatacaattcatgatatcagatgttcagtcatgatgattcggaccccagaggaactggaggatgtttctgaccttgaagaggaacacgaggtccgcagtcacaccagcattcagaccgaagggaaaactgatagggctaagatgactcaactgcctgaggcagaaaaagaaaagattgctgagcaagttgctgatttcaagaaagtaaagagtaagctggatgctgagattgagatatgggatgatacaagcaacgacatcattgttctggccaagaacatgtgtatgatcatgatggagatgacagacttcactaggggcaaaggaccactaaagcatacaactgatgtgatctatgcagcgaaaatgatatcagaatcaggatcaaggatggatgtccttgctcggcagattgctaatcagtgcccagatccatcttgtaaacaggacttgttggcctacctggaacagattaagttctactcccaccaactgaaaatctgcagtcaagttaaagctgagatccagaacctgggaggagagctcatcatgtcagctttggacagtgtcacatccctgatccaagcagccaaaaatttaatgaatgctgtagtgcaaacagtgaaaatgtcttacattgcctcaaccaagatcatccgaatccagagtcctgctgggccccggcacccagttgtgatgtggagaatgaaggctcctgcaaaaaaacccttgattaaaagagagaagccagaggaaacgtgtgcagctgtcagacgaggctcagcaaagaaaaaaatccatccattgcaagtcatgagtgaatttagaggaagacaaatctactgaaaccactattctacatatagtgcctatatgacaaaatcctgcctaaccacactgctttattttacacttaagaagttctgtaatttcactaagttttggtgtttaactcacaaataacataaaatattgggcgctaaatcaacaaaagcaatatatatttgggatcatatcactgtcatttctgtatggtcagcacctaatagttaaggaatatttgcttgttgaatgaatgaaattatcacgtgtcattcagcgtttcccatcatagagattatctactattcgttaccaaataaacacagtttcgcccgaaagcgngccttcttttttcttcccgcccctcccgccctgatta

SEQ ID NO: 409294 - DNA, 3276 bp, Homo sapiens
agcgggcttttcaggctgtttgcttacagatgcatcataagccaaattgtgagccatgatagtggcactgaatttctaaatacaagaaattgcttagacaattggtttagtatctgtatatgggcaatactctgtcctgcagtagctgaatcgctgagaaaagagaccatgtttctacttttagaaggagaatgaaatcaacgcaaaggagagagaaacaaggcagcatgtcagctgaaacaccaatcacattgaatatcgatcctcaggatctgcaggtccaaacattcaccgtggagaagctactggagcctctcataatccaggttaccacacttgtaaactgtccccagaacccttccagcaggaaaaaaggacgttcgaaaagagccagtgtccttctagcttctgtggaggaagcaacttggaatttattagacaagggagagaagattgcccaggaagctacagttttaaaggatgagcttacggcttcacttgaggaagttcgcaaagaaagtgaagctctgaaagtatcagctgagagatttacagatgacccctgttttctcccaaaaagggaggctgtggttcaagctgcccgtgccttgctggctgcggtgacgagactccttatccttgcggacatgattgatgtcatgtgcctcttgcaacatgtgtcagcttttcaaaggacatttgagtctctcaaaaatgttgccaacaaatctgacctccagaaaacctaccagaagcttggaaaggagctggaaaatttggattatttagccttcaaacgtcagcaggacttaaaatctccaaatcagagagatgaaattgcaggagcccgagcttcactgaaggagaactctcccctcttgcattcaatttgttcagcttgtttggagcattctgatgttgcttccctcaaagcaagcaaggacacagtttgtgaagaaattcagaatgctctcaatgtaatttcaaatgcttcacaagggatccagaatatgacaaccccaccagaacctcaggcagcaaccctgggaagtgcccttgatgagctggagaatttaattgtcctgaatccactcacagtaactgaggaggaaatacgaccatcactagagaaacgccttgaagccattatcagtggggctgctctgctggcggattcttcatgtacgagggacttacaccgagagcggattatcgcagaatgcaacgccattcgccaggctcttcaggatctgctttcagagtacatgaacaacgctggaaaaaaagaaaggagtaataccctgaatattgctttagacaacatgtgtaagaagacaagagaccttcgcagacagctccgcaaggctattatagatcatgtgtcagactctttcctggatacgacagtccctcttttggttctcattgaagctgctaagaatggccgggaaaaggaaataaaagaatatgctgcgatatttcatgaacacaccagcaggcttgtagaggtggcaaatcttgcttgttccatgtcaacaaatgaagatggaattaaaattgtcaaaattgcagccaatcatttggaaaccttgtgtccacagattattaatgctgcacttgctttggctgcaagacccaaaagtcaagcggtcaaaaacaccatggaaatgtacaagcgtacatgggagaatcatatacatgtcctcactgaagccgtagatgacattacaagcattgatgacttccttgctgtatctgaaagccatatcttggaagatgtcaacaagtgtatcatagccttaagagaccaggatgctgataatttagaccgtgctgcgggtgctatcagaggccgggcagcaagagttgctcacatcgtcacgggtgaaatggacagttacgagccaggggcttacacggaaggtgtaatgagaaatgttaacttccttacaagtactgtaattcctgaatttgtaacacaagtgaatgttgccttggaagccttaagcaaaagctcattgaatgtgttggatgataatcaatttgtggacatctcaaagaagatctatgatacaattcatgatatcagatgttcagtcatgatgattcggaccccagaggaactggaggatgtttctgaccttgaagaggaacacgaggtccgcagtcacaccagcattcagaccgaagggaaaactgatagggctaagatgactcaactgcctgaggcagaaaaagaaaagattgctgagcaagttgctgatttcaagaaagtaaagagtaagctggatgctgagattgagatatgggatgatacaagcaacgacatcattgttctggccaagaacatgtgtatgatcatgatggagatgacagacttcactaggggcaaaggaccactaaagcatacaactgatgtgatctatgcagcgaaaatgatatcagaatcaggatcaaggatggatgtccttgctcggcagattgctaatcagtgcccagatccatcttgtaaacaggacttgttggcctacctggaacagattaagttctactcccaccaactgaaaatctgcagtcaagttaaagctgagatccagaacctgggaggagagctcatcatgtcagctttggacagtgtcacatccctgatccaagcagccaaaaatttaatgaatgctgtagtgcaaacagtgaaaatgtcttacattgcctcaaccaagatcatccgaatccagagtcctgctgggccccggcacccagttgtgatgtggagaatgaaggctcctgcaaaaaaacccttgattaaaagagagaagccagaggaaacgtgtgcagctgtcagacgaggctcagcaaagaaaaaaatccatccattgcaagtcatgagtgaatttagaggaagacaaatctactgaaaccactattctacatatagtgcctatatgacaaaatcctgcctaaccacactgctttattttacacttaagaagttctgtaatttcactaagttttggtgtttaactcacaaataacataaaatattgggcgctaaatcaacaaaagcaatatatatttgggatcatatcactgtcatttctgtatggtcagcacctaatagttaaggaatatttgcttgttgaatgaatgaaattatcacgtgtcattcagcgtttcccatcatagagattatctactattcgttaccaaataaacacagttgttagcgacaagttacgcccttcttattacggtgactagttaactatgggtatttaa

SEQ ID NO: 409295 - DNA, 826 bp, Homo sapiens
  misc_feature (24)..(24): n is a, c, g, or t
  misc_feature (28)..(28): n is a, c, g, or t
gttctaaggtacagtgactctctnatanaaccaccgatccagtgcccagatccatcttgtaaacaggacttgttggcctacctggaacagattaagttctactcccaccaactgaaaatctgcagtcaagttaaagctgagatccagaacctgggaggagagctcatcatgtcagctttggacagtgtcacatccctgatccaagcagccaaaaatttaatgaatgctgtagtgcaaacagtgaaaatgtcttacattgcctcaaccaagatcatccgaatccagagtcctgctgggccccggcacccagttgtgatgtggagaatgaaggctcctgcaaaaaaacccttgattaaaagagagaagccagaggaaacgtgtgcagctgtcagacgaggctcagcaaagaaaaaaatccatccattgcaagtcatgagtgaatttagaggaagacaaatctactgaaaccactattctacatatagtgcctatatgacaaaatcctgcctaaccacactgctttattttacacttaagaagttctgtaatttcactaagttttggtgtttaactcacaaataacataaaatattgggcgctaaatcaacaaaagcaatatatatttgggatcatatcactgtcatttctgtatggtcagcacctaatagttaaggaatatttgcttgttgaatgaatgaaattatcacgtgtcattcagcgtttcccatcatagagattatctactattcgttaccaaataaacacagttgttagcgacaagttacgcccttcttattacggtgactagttaactatgggtatttaa

SEQ ID NO: 409296 - DNA, 1615 bp, Homo sapiens
agcgggcttttcaggctgtttgcttacagatgcatcataagccaaattgtgagccatgatagtggcactgaatttctaaatacaagaaattgcttagacaattggtttagtatctgtatatgggcaatactctgtcctgcagtagctgaatcgctgagaaaagagaccatgtttctacttttagaaggagaatgaaatcaacgcaaaggagagagaaacaaggcagcatgtcagctgaaacaccaatcacattgaatatcgatcctcaggatctgcaggtccaaacattcaccgtggagaagctactggagcctctcataatccaggttaccacacttgtaaactgtccccagaacccttccagcaggaaaaaaggacgttcgaaaagagccagtgtccttctagcttctgtggaggaagcaacttggaatttattagacaagggagagaagattgcccaggaagctacagttttaaaggatgagcttacggcttcacttgaggaagttcgcaaagaaagtgaagctctgaaagtatcagctgagagatttacagatgacccctgttttctcccaaaaagggaggctgtggttcaagctgcccgtgccttgctggctgcggtgacgagactccttatccttgcggacatgattgatgtcatgtgcctcttgcaacatgtgtcagcttttcaaaggacatttgagtctctcaaaaatgttgccaacaaatctgacctccagaaaacctaccagaagcttggaaaggagctggaaaatttggattatttagccttcaaacgtcagcaggacttaaaatctccaaatcagagagatgaaattgcaggagcccgagcttcactgaaggagaactctcccctcttgcattcaatttgttcagcttgtttggagcattctgatgttgcttccctcaaagcaagcaaggacacagtttgtgaagaaattcagaatgctctcaatgtaatttcaaatgcttcacaagggatccagaatatgacaaccccaccagaacctcaggcagcaaccctgggaagtgcccttgatgagctggagaatttaattgtcctgaatccactcacagtaactgaggaggaaatacgaccatcactagagaaacgccttgaagccattatcagtggggctgctctgctggcggattcttcatgtacgagggacttacaccgagagcggattatcgcagaatgcaacgccattcgccaggctcttcaggatctgctttcagagtacatgaacaacgctggaaaaaaagaaaggagtaataccctgaatattgctttagacaacatgtgtaagaagacaagagaccttcgcagacagctccgcaaggctattatagatcatgtgtcagactctttcctggatacgacagtccctcttttggttctcattgaagctgctaagaatggccgggaaaaggaaataaaagaatatgctgcgatatttcatgaacacaccagcaggcttgtagaggtaagcatgctagaactgtaactcactaaagtccaggagaatgaggctcccattctccatttatggttgaattgtacctaaataaaaacttttgacaccgtgttcca

SEQ ID NO: 409297 - DNA, 433 bp, Homo sapiens
gtcggccaggacctcgccctggggtgactgagggcagggacactggctttgtgtgactgtgagaaggaggcacctgtgggctctggaggggtgatctctccaggatcaagacgcccaaggccagtgcattaagaatacagaaaataggctgggtgcggtggctcacgcctataatcccagcactttgggaggctgaagtgggcagatcacctgaggtcaagagatcgagaccatcctggccaacatggtgaaaccctctctccactaaaaatacaaaaattagccaggaatggtggcgggcgcctgtagtcccagctacttgggaggctgaggcaggagaatcgcttgaacccgggaggtggaggctgcagtgagccaggatcgcgccactgcactccagcctgggcaacaagagcgaaactccatctcaaaa

SEQ ID NO: 409298 - DNA, 917 bp, Homo sapiens
ctggcacctatccacagcctgaaccttggagaacacctccctttcatatgacttctgcaaagggcgtgtttcagctcacagggacaaagagtcactgcaccagagaaccagaaagagttacagacacggctcacaggcttaagcgtcttgctgtaggtcatacggcaggttaatgacaacactggggcaagaacacaggttacgctcgtcctggggaaggctcccacaccaagctacacacttctgcaatgctgttccagatgtgaaaatccgctaagacaaataggtcacaaaaacaccatgggagacgatgatgtcttttcctttttgttatcttgataaagcttcatacatgggacaaaaggaggaactagcccaccaagcaggtttaaagggagtgtcggacacaaaaatgacatgccccatattgcagtctagaaggaacaacacggtgaattgtctactgcagaacacttcactctgtctcgattactacatggtgaattgaagttccagtagagagggagttgagctgatactgaggagataaatacccatcactgtatacatctacttcttggaatttgcaagggaaccagtcaacagatttttcaagccttataagtttatctgcctgagaagttcaccagctacataacatcctggactctggagcccaagagatgtgtagtttccattttggagccattttctttgataaataagtagtgaggctgccattcttgtcaaagttgaggaccacaaccttactcatgaaactgaaagattgtttgttatgaggagttctgtttgagccatacaagcaatatatcctttttaaagaaatgtatccggaatcttaggtgttcattgctccaagccatgtgcagaataaaaagaaaacaaaaaacaaaaaa

SEQ ID NO: 409299 - DNA, 1612 bp, Homo sapiens
aaccagggagccacacaggctccttggagtaagagtgtgagaaactggatgaagacagctgtattcttttggaagcgttcgagattggtctgtctctaccaactaaaaacttctagcttaagtgcagagatttaaggagatcaacaaaaactcagtctagacatattatgaggctgggagggtatcaacagacttgagttcttgtcagcaagatcacctgcttttaatattgtcctcagggtctgagcacatctggaagtgaggtcaatcaagttagaccccaaaaacttttgtgacaacagtgaagaggggaaaataaacacaccacaaacatgaacctcaaccccccgacatctgctcttcagatcgagggcaaaggcagccatattatggctagaaatgtaagctgctttctagtcaggcacacccctcatcccagaagagtctgccacatcaaaggcttgaataacattccaatctgtactgtgaatgatgatgagaatgcatttggaacattgtgggaagttggccagtctaactacttagagaagaacaggataccatttgccaattgcagttaccccccgagcactgcagtccagaagagccctgtaagaggaatgtcgccagccccaaacggtgccaaagtgcctccacggcctcattctgagcccagtagaaaaattaaagagtgcttcaaaacttccagtgagaatcccttagtaattaaaaaggaagaaattaaggccaaaagaccaccatcacctccaaaggcatgctctactcctggctcctgttcttcagggatgacaagtaccaagaatgatgtgaaagcaaacaccatttgcataccaaactatctggatcaggaaataaaaatcctggcaaagctctgtagcattttgcatactgattctctggcagaagttttacagtggctgcttcatgcaacttcaaaagaaaaagagtgggtctcagctttgattcattctgagcttgccgagataaacctgttaactcatcacagaagaaacacctcaatggaaccagcagcagagactgggaagccacccacagttaaatcaccacccacagttaaattgcccccaaattttactgcaaaatcaaaagtgctgaccagagatacagaaggggatcaaccaaccagagtgtcaagtcaaggatctgaagaaaacaaggaagtaccaaaagaggctgagcacaagcctccactacttataagaagaaataatatgaaaatacctgttgcagaatatttcagcaaaccaaattctcctcccaggcctaacactcaggagagtggatcagcaaaaccagtgtcagcaaggagtatacaagaatacaacctctgtccccaaagagcatgttatccttcaacacaccggaggtagaagttctagactgggtgaattctttcatgaatatgagcttcacatttacatcatcaaattatttttcaaatgaatatttttggtattgaggaatcaagtggtcctctttatggtggcacatgtaaatctaaaaatacctgtatgtaatgctacaaataaatattactggaaatgatatttccatttgtagttaatacgat

SEQ ID NO: 409300 - DNA, 1530 bp, Homo sapiens
aaccagggagccacacaggctccttggagtaagagtgtgagaaactggatgaagacagctgtattcttttggaagcgttcgagattggtctgtctctaccaactaaaaacttctagcttaagtgcagagatttaaggagatcaacaaaaactcagtctagacatattatgaggctgggagggtatcaacagacttgagttcttgtcagcaagatcacctgcttttaatattgtcctcagggtctgagcacatctggaagtgaggtcaatcaagttagaccccaaaaacttttgtgacaacagtgaagaggggaaaataaacacaccacaaacatgaacctcaaccccccgacatctgctcttcagatcgagggcaaaggcagccatattatggctagaaatgtaagctgctttctagtcaggcacacccctcatcccagaagagtctgccacatcaaaggcttgaataacattccaatctgtactgtgaatgatgatgagaatgcatttggaacattgtgggaagttggccagtctaactacttagagaagaacaggataccatttgccaattgcagttaccccccgagcactgcagtccagaagagccctgtaagaggaatgtcgccagccccaaacggtgccaaagtgcctccacggcctcattctgagcccagtagaaaaattaaagagtgcttcaaaacttccagtgagaatcccttagtaattaaaaaggaagaaattaaggccaaaagaccaccatcacctccaaaggcatgctctactcctggctcctgttcttcagggatgacaagtaccaagaatgatgtgaaagcaaacaccatttgcataccaaactatctggatcaggaaataaaaaaaaagagtgggtctcagctttgattcattctgagcttgccgagataaacctgttaactcatcacagaagaaacacctcaatggaaccagcagcagagactgggaagccacccacagttaaatcaccacccacagttaaattgcccccaaattttactgcaaaatcaaaagtgctgaccagagatacagaaggggatcaaccaaccagagtgtcaagtcaaggatctgaagaaaacaaggaagtaccaaaagaggctgagcacaagcctccactacttataagaagaaataatatgaaaatacctgttgcagaatatttcagcaaaccaaattctcctcccaggcctaacactcaggagagtggatcagcaaaaccagtgtcagcaaggagtatacaagaatacaacctctgtccccaaagagcatgttatccttcaacacaccggaggtagaagttctagactgggtgaattctttcatgaatatgagcttcacatttacatcatcaaattatttttcaaatgaatatttttggtattgaggaatcaagtggtcctctttatggtggcacatgtaaatctaaaaatacctgtatgtaatgctacaaataaatattactggaaatgatatttccatttgtagttaatacgat

SEQ ID NO: 409301 - DNA, 291 bp, Homo sapiens
ataatgacaaaagtagctctcatatctcctgataccaccattgctcctactgctcattcaaaatattcatttcaagacaggcttctccccaggaacctggactctgcaggttaataacaggatctctgtagcatcaccacctttacttcctttgtccaacctagctaaatctggtgtaattctagcctgtctctctcattttttgatatcttggatccatatcagccatgtccaatagaacttcatgtgataatgggaagattctatatctaagctgactaataaagtagc

SEQ ID NO: 409302 - DNA, 471 bp, Homo sapiens
ttccagcttgttctgaagatagcctgtttttaagatgctcactgagacacaaagatgaagaagaagaagatgatgatgacatccacataacagctcggatagaaagtgacttgacgctggagagtctaagtgatgaagagattcatccagggtgaagcccttctgtggagctgaccagggtgctgacccaaagggcaggccagcgcgtgctgcagggtccccagctttgcccctggaggtctcaatcctctctacattctgaggaaaactcttggtcccagcagagagaaaaagtccaaggctgcttcccacccaccgccagcactaggtttggcctgtaccatccaggacccagtgcttctgggcctggcatttctcctttggcaagagagtgagaagagacgtgactgtgctccacgagcagaaagtgccattcccacttgaaataaagagactgagtgcatttaatca

SEQ ID NO: 409303 - DNA, 218 bp, Homo sapiens
ctcacctggggcagcgtaggtgtgcatgacattgtgctccaccagcacctgggccaccgaggggtctggaaccgggaaggactcgttgtacggaggctggaactggtggagggcctgctccccatccccaaaggtccacctgccggggcggtgggacgcaccatggcagcgtcctcgggcagcatgaagcagagcagaaggcagaggtgaaggtggag

SEQ ID NO: 409304 - DNA, 189 bp, Homo sapiens
ggttgtgatgagccaagattgcaccattgcactctggtctgggcaacaagagcaaaactccatctcaaaagaaaaaaaaaagtgtgtagcacctcaccccccctctctcggtcctgctcctgccatgtaagacgcctactcccaatttgccttccgccatgagtaaaagctccctgggcctccccagaa

SEQ ID NO: 409305 - DNA, 180 bp, Homo sapiens
agacaggaactcagctataatttctttaagctattttattaatagttcttcacccaaatttcaatataggttttgaaagtctcatcttgccaatagtgaaagtagtttcagttttaaatgggcacttttaaaaacctttttaaaaacttaaatcatcaggggaggggaatttcaaataca

SEQ ID NO: 409306 - DNA, 494 bp, Homo sapiens
cacccgagcgccggcccgcgccacgcccccgcgaggcgtcctctcctgcttggccttggtcttagggctgactgacagtaaggactccttagatgaagcccgacagaaaattttcgacatccgggaagagtacagaaacaaattgctggaagctgagcacctaaagctggaaactctggctgctcaggaagcagccatgaagctggagacagaaaagatgaccccagctcctgacacacagaaaaaaaagaaaggaaagaaaaagtaaccaggggatgtccaatactaccctgcttctggagagaaaaaatctatttgtaatgatctttaactgcctgctgttaagatattaggccaaatgaaaatagaaatttctctttcttagaaatattttaatgctaacttgttagttttcctcagaaagctagtatttgaagccatttgagtttaagatgctctaatttcaataaaatagcttccaaatatttaataaa

SEQ ID NO: 409307 - DNA, 1572 bp, Homo sapiens
atcacactgccgaaattccaacggcatcgcactgtgcggcctcttctgaggttcctctctcattgggcagggatgtgttcttcctcggtctcatcattgcatctctagcactagtgggagatgtcaataagtgtttaatgaatgaatgcatgaacatgccacaccagtgacctcagcttatggtgaaagacacgaggagttaattaacttaggaagcccagactcccacactattagtgagggacaaaaatcttcagtaacttccaaaacaacaaggaaaggcaaagaaaagtcttctgagaaagaaaagacagccaaagaaaaacaagcacctcgctttgagcctcagatatccactgttcaccctcaacaagaagacccaaataaaccctactggattttgaggttggtcactgaacacaatgaatcagaattatttgaagtgaaaaaggatacagaaagggcagatgaaatccgagccatgaaacaagcctgggagacaactgagccaggaagagcaatcaaggcttctcaggctcgtttgcattaccttagcgggttcattaagaaaacatctgatgctgagagtccgcctatatctgaaagccaaactaaaccaaaagaagaagtagaaacagctgcacgtggcgtaaaagaaccaaactcaaagaattctgcaggttcagagagcaaagagatgacacaaacaggatcagggagtgcggtgtggaagaagtggcaattgaccaaaggcttgagggatgtggcaaaatccacgagtagcgaaagtggaggagtgtcttcaccagggaaagaagagcgcgagcagagcacacggaaggaaaacattcaaacaggacctcgtacacgatctccaacaattttggaaacatctccacgacttattcgaaaagcactagaatttatggatttaagtcaatatgttcggaaaacagatacagatcctctgctgcaaacagatgaattgaatcagcagcaggcaatgcaaaaggcggaagaaattcatcagtttcgacagcataggaccagagtccttagcattcgaaacattgaccaagaagagcggttgaagttaaaggatgaagtcctggatatgtataaggaaatgcaggactccttagatgaagcccgacagaaaattttcgacatccgggaagagtacagaaacaaattgctggaagctgagcacctaaagctggaaactctggctgctcaggaagcagccatgaagctggagacagaaaagatgaccccagctcctgacacacagaaaaaaaagaaaggaaagaaaaagtaaccaggggatgtccaatactaccctgcttctggagagaaaaaatctatttgtaatgatctttaactgcctgctgttaagatattaggccaaatgaaaatagaaatttctctttcttagaaatattttaatgctaacttgttagttttcctcagaaagctagtatttgaagccatttgagtttaagatgctctaatttcaataaaatagcttccaaatatttaataaaatatgtttgacactctaaaaaaaaaaaa

SEQ ID NO: 409308 - DNA, 1604 bp, Homo sapiens
atcacactgccgaaattccaacggcatcgcactgtgcggcctcttctgaggttcctctctcattgggcagggatgtgttcttcctcggtctcatcattgcatctctagcactagtgggagatgtcaataagtgtttaatgaatgaatgcatgaacatgccacaccagtgacctcagcttatggtgaaagacacgaggagttaattaacttaggaagcccagactcccacactattagtgagggacaaaaatcttcagtaacttccaaaacaacaaggaaaggcaaagaaaagtcttctgagaaagaaaagacagccaaagaaaaacaagcacctcgctttgagcctcagatatccactgttcaccctcaacaagaagacccaaataaaccctactggattttgaggttggtcactgaacacaatgaatcagaattatttgaagtgaaaaaggatacagaaagggcagatgaaatccgagccatgaaacaagcctgggagacaactgagccaggaagagcaatcaaggcttctcaggctcgtttgcattaccttagcgggttcattaagaaaacatctgatgctgagagtccgcctatatctgaaagccaaactaaaccaaaagaagaagtagaaacagctgcacgtggcgtaaaagaaccaaactcaaagaattctgcaggttcagagagcaaagagatgacacaaacaggatcagggagtgcggtgtggaagaagtggcaattgaccaaaggcttgagggatgtggcaaaatccacgagtagcgaaagtggaggagtgtcttcaccagggaaagaagagcgcgagcagagcacacggaaggaaaacattcaaacaggacctcgtacacgatctccaacaattttggaaacatctccacgacttattcgaaaagcactagaatttatggatttaagtcaatatgttcggaaaacagatacagatcctctgctgcaaacagatgaattgaatcagcagcaggcaatgcaaaaggcggaagaaattcatcagtttcgacagcataggaccagagtccttagcattcgaaacattgaccaagaagagcggttgaagttaaaggatgaagtcctggatatgtataaggaaatgcaggactccttagatgaagcccgacagaaaattttcgacatccgggaagagtacagaaacaaattgctggaagctgagcacctaaagctggaaactctggctgctcaggaagcagccatgaagctggagacagaaaagatgaccccagctcctgacacacagaaaaaaaagaaaggaaagaaaaagtaaccaggggatgtccaatactaccctgcttctggagagaaaaaatctatttgtaatgatctttaactgcctgctgttaagatattaggccaaatgaaaatagaaatttctctttcttagaaatattttaatgctaacttgttagttttcctcagaaagctagtatttgaagccatttgagtttaagatgctctaatttcaataaaatagcttccaaatatttaataaagttggggcgcccgaacgcccgccctcccccctacgggcgcccgacaacgtcgcggagaac

SEQ ID NO: 409309 - DNA, 2543 bp, Homo sapiens
  misc_feature (1088)..(1088): n is a, c, g, or t
  misc_feature (1310)..(1310): n is a, c, g, or t
  misc_feature (1781)..(1781): n is a, c, g, or t
ggcagcggcttccggccgcggcggacacttccctgggcgggactgtctcgtggcacccggtggaaccgaggagaacgtggagcgccgggagcggcgaatatggacgactacagcctggatgagttccgtcggcgctggcaggaggagctggcgcaggcccaggcgccgaagaagcggcgacggcccgaggctgccgagaggcgggctcggcggccggagaatgaaatgaatgatgtgcctttctttgatatccaactgccttacgaattggcaatcaatatatttcagtatctggacaggaaagaactaggaagatgggcacagatgaacaaacagactttggattgggtgatgctcatcagagtgatggattaaacttggaaagagagatagtcagccagaccacagcaacacaggaaaagtcacaggaagaacttccaacaacaaataatagtgtttctaaagaaatatggttagattttgaagatttctgtgtatgctttcaaaatatatatattttccacaagccaagttcatattgccttaactttcaaaaatcagaatttaagttctcagaagaacgagtgtcctactatctatttgtggatagtctaaaacctattgaactactggtttgcttttctgcattggtacgctggggggagtatggagccttaacaaaagacagtcctcccatagagcctggacttctcacagctgaaacgttttcttggaaatccctgaaaccaggcagtcttgttctgaagattcacacatatgctaccaaggctacagtggttcgtctgcctgttgggagacacatgctactcttcaacgcatactccccagtaggacactccatacacatctgcagcatggtgtcatttgtcattggggatgaacacgttgtactgcccaactttgaaccagagagctgccgatttacggaacagtctctgttgattatgaaagctattggaaatgtgattgctaatttcaaagataagggtaaactctctgcagctttgaaggatctgcaaacagctcactaccctgtccccttccatgataaagaactaactgcacancacttcagggtttttcatctttccttatggcgtttaatgaaaaaagttcaaataacaaaacctcctccaaacttcaaatttgcattccgggctatggttttggacttggagttactcaattcctccttggaagaggtttctttagtggaatggctggacgttaaatattgtatgcccacaagtgataaagagtattctgctgaggaagtagcagcagcaatnaaaattcaagccatgtggagaggaacttacgttagattgcttatgaaagccagaataccagacacaaaagaaaatatcagtgttgcagatactcttcaaaaagtttgggctgtattggaaatgaatttagaacagtatgcagtttctctcttaagactaatgtttaaaagcaagtgcaagtctttggaatcttatccatgctatcaagatgaagaaactaagattgcttttgcagattatactgtgacttatcaagaacagccaccaaattcttggtttatagtattcagagaaacatttttggttcatcaagacatgattttggttcccaaagtatatactacacttccaatctgtatcctacacattgttaataatgacacaatggagcaagtgccaaaggtgttccaaaaagtggtgccttatctttataccaagaataagaagggatacacttttgtggcggaagcntttacaggcgacacatatgtagcagcctcacgatggaaactgcgtctcatcggttcttctgctccactgccatgcctctctcgagactctccatgcaattcctttgccataaaggaaatccgagattactacatacccaatgataagaaaattttattcaggtattcggttaaagttctaacaccacaacctgctacaatacaggtacgcacatccaaaccagatgcattcatcaagctgcaggtcctagaaaatgaagaaactatggtgagctccactggaaaaggccaagctataatcccagcatttcacttcttgaagagtgagaaaggtttgagctcccagtgtaagtgtacctttatgaacaggatagttagattcataaatggatatttatgttttcatgacactttaaaaatgaaaataaagtagcaagtaaccacttaaattatgaaacttcatagtacagtaaaatattacaagtatagcatttgcatgtcaaattaggctccgaaaatcattataggtttattttaaagccttttcatcttggagaaaaatttactttcctattatatgagccttcttaataagaagtcaaatttttattattttgaaagaatatttttacttttttaaattcgtaattcattattttcagaaaatattgtacttactaaaattaacaaaaactaaagttactacttgcaatatattattctcaatgagttattaaataaataaaataattttggaaataat

SEQ ID NO: 409310 - DNA, 3374 bp, Homo sapiens
  misc_feature (1088)..(1088): n is a, c, g, or t
  misc_feature (1310)..(1310): n is a, c, g, or t
  misc_feature (1781)..(1781): n is a, c, g, or t
ggcagcggcttccggccgcggcggacacttccctgggcgggactgtctcgtggcacccggtggaaccgaggagaacgtggagcgccgggagcggcgaatatggacgactacagcctggatgagttccgtcggcgctggcaggaggagctggcgcaggcccaggcgccgaagaagcggcgacggcccgaggctgccgagaggcgggctcggcggccggagaatgaaatgaatgatgtgcctttctttgatatccaactgccttacgaattggcaatcaatatatttcagtatctggacaggaaagaactaggaagatgggcacagatgaacaaacagactttggattgggtgatgctcatcagagtgatggattaaacttggaaagagagatagtcagccagaccacagcaacacaggaaaagtcacaggaagaacttccaacaacaaataatagtgtttctaaagaaatatggttagattttgaagatttctgtgtatgctttcaaaatatatatattttccacaagccaagttcatattgccttaactttcaaaaatcagaatttaagttctcagaagaacgagtgtcctactatctatttgtggatagtctaaaacctattgaactactggtttgcttttctgcattggtacgctggggggagtatggagccttaacaaaagacagtcctcccatagagcctggacttctcacagctgaaacgttttcttggaaatccctgaaaccaggcagtcttgttctgaagattcacacatatgctaccaaggctacagtggttcgtctgcctgttgggagacacatgctactcttcaacgcatactccccagtaggacactccatacacatctgcagcatggtgtcatttgtcattggggatgaacacgttgtactgcccaactttgaaccagagagctgccgatttacggaacagtctctgttgattatgaaagctattggaaatgtgattgctaatttcaaagataagggtaaactctctgcagctttgaaggatctgcaaacagctcactaccctgtccccttccatgataaagaactaactgcacancacttcagggtttttcatctttccttatggcgtttaatgaaaaaagttcaaataacaaaacctcctccaaacttcaaatttgcattccgggctatggttttggacttggagttactcaattcctccttggaagaggtttctttagtggaatggctggacgttaaatattgtatgcccacaagtgataaagagtattctgctgaggaagtagcagcagcaatnaaaattcaagccatgtggagaggaacttacgttagattgcttatgaaagccagaataccagacacaaaagaaaatatcagtgttgcagatactcttcaaaaagtttgggctgtattggaaatgaatttagaacagtatgcagtttctctcttaagactaatgtttaaaagcaagtgcaagtctttggaatcttatccatgctatcaagatgaagaaactaagattgcttttgcagattatactgtgacttatcaagaacagccaccaaattcttggtttatagtattcagagaaacatttttggttcatcaagacatgattttggttcccaaagtatatactacacttccaatctgtatcctacacattgttaataatgacacaatggagcaagtgccaaaggtgttccaaaaagtggtgccttatctttataccaagaataagaagggatacacttttgtggcggaagcntttacaggcgacacatatgtagcagcctcacgatggaaactgcgtctcatcggttcttctgctccactgccatgcctctctcgagactctccatgcaattcctttgccataaaggaaatccgagattactacatacccaatgataagaaaattttattcaggtattcggttaaagttctaacaccacaacctgctacaatacaggtacgcacatccaaaccagatgcattcatcaagctgcaggtcctagaaaatgaagaaactatggtgagctccactggaaaaggccaagctataatcccagcatttcacttcttgaagagtgagaaaggtttgagctcccagtcttatggtgaaagacacgaggagttaattaacttaggaagcccagactcccacactattagtgagggacaaaaatcttcagtaacttccaaaacaacaaggaaaggcaaagaaaagtcttctgagaaagaaaagacagccaaagaaaaacaagcacctcgctttgagcctcagatatccactgttcaccctcaacaagaagacccaaataaaccctactggattttgaggcttctcaggctcgtttgcattaccttagcgggttcattaagaaaacatctgatgctgagagtccgcctatatctgaaagccaaactaaaccaaaagaagaagtagaaacagctgcacgtggcgtaaaagaaccaaactcaaagaattctgcaggttcagagagcaaagagatgacacaaacaggatcagggagtgcggtgtggaagaagtggcaattgaccaaaggcttgagggatgtggcaaaatccacgagtagcgaaagtggaggagtgtcttcaccagggaaagaagagcgcgagcagagcacacggaaggaaaacattcaaacaggacctcgtacacgatctccaacaattttggaaacatctccacgacttattcgaaaagcactagaatttatggatttaagtcaatatgttcggaaaacagatacagatcctctgctgcaaacagatgaattgaatcagcagcaggcaatgcaaaaggcggaagaaattcatcagtttcgacagcataggaccagagtccttagcattcgaaacattgaccaagaagagcggttgaagttaaaggatgaagtcctggatatgtataaggaaatgcaggactccttagatgaagcccgacagaaaattttcgacatccgggaagagtacagaaacaaattgctggaagctgagcacctaaagctggaaactctggctgctcaggaagcagccatgaagctggagacagaaaagatgaccccagctcctgacacacagaaaaaaaagaaaggaaagaaaaagtaaccaggggatgtccaatactaccctgcttctggagagaaaaaatctatttgtaatgatctttaactgcctgctgttaagatattaggccaaatgaaaatagaaatttctctttcttagaaatattttaatgctaacttgttagttttcctcagaaagctagtatttgaagccatttgagtttaagatgctctaatttcaataaaatagcttccaaatatttaataaa

SEQ ID NO: 409311 - DNA, 3523 bp, Homo sapiens
  misc_feature (1088)..(1088): n is a, c, g, or t
  misc_feature (1310)..(1310): n is a, c, g, or t
  misc_feature (1781)..(1781): n is a, c, g, or t
ggcagcggcttccggccgcggcggacacttccctgggcgggactgtctcgtggcacccggtggaaccgaggagaacgtggagcgccgggagcggcgaatatggacgactacagcctggatgagttccgtcggcgctggcaggaggagctggcgcaggcccaggcgccgaagaagcggcgacggcccgaggctgccgagaggcgggctcggcggccggagaatgaaatgaatgatgtgcctttctttgatatccaactgccttacgaattggcaatcaatatatttcagtatctggacaggaaagaactaggaagatgggcacagatgaacaaacagactttggattgggtgatgctcatcagagtgatggattaaacttggaaagagagatagtcagccagaccacagcaacacaggaaaagtcacaggaagaacttccaacaacaaataatagtgtttctaaagaaatatggttagattttgaagatttctgtgtatgctttcaaaatatatatattttccacaagccaagttcatattgccttaactttcaaaaatcagaatttaagttctcagaagaacgagtgtcctactatctatttgtggatagtctaaaacctattgaactactggtttgcttttctgcattggtacgctggggggagtatggagccttaacaaaagacagtcctcccatagagcctggacttctcacagctgaaacgttttcttggaaatccctgaaaccaggcagtcttgttctgaagattcacacatatgctaccaaggctacagtggttcgtctgcctgttgggagacacatgctactcttcaacgcatactccccagtaggacactccatacacatctgcagcatggtgtcatttgtcattggggatgaacacgttgtactgcccaactttgaaccagagagctgccgatttacggaacagtctctgttgattatgaaagctattggaaatgtgattgctaatttcaaagataagggtaaactctctgcagctttgaaggatctgcaaacagctcactaccctgtccccttccatgataaagaactaactgcacancacttcagggtttttcatctttccttatggcgtttaatgaaaaaagttcaaataacaaaacctcctccaaacttcaaatttgcattccgggctatggttttggacttggagttactcaattcctccttggaagaggtttctttagtggaatggctggacgttaaatattgtatgcccacaagtgataaagagtattctgctgaggaagtagcagcagcaatnaaaattcaagccatgtggagaggaacttacgttagattgcttatgaaagccagaataccagacacaaaagaaaatatcagtgttgcagatactcttcaaaaagtttgggctgtattggaaatgaatttagaacagtatgcagtttctctcttaagactaatgtttaaaagcaagtgcaagtctttggaatcttatccatgctatcaagatgaagaaactaagattgcttttgcagattatactgtgacttatcaagaacagccaccaaattcttggtttatagtattcagagaaacatttttggttcatcaagacatgattttggttcccaaagtatatactacacttccaatctgtatcctacacattgttaataatgacacaatggagcaagtgccaaaggtgttccaaaaagtggtgccttatctttataccaagaataagaagggatacacttttgtggcggaagcntttacaggcgacacatatgtagcagcctcacgatggaaactgcgtctcatcggttcttctgctccactgccatgcctctctcgagactctccatgcaattcctttgccataaaggaaatccgagattactacatacccaatgataagaaaattttattcaggtattcggttaaagttctaacaccacaacctgctacaatacaggtacgcacatccaaaccagatgcattcatcaagctgcaggtcctagaaaatgaagaaactatggtgagctccactggaaaaggccaagctataatcccagcatttcacttcttgaagagtgagaaaggtttgagctcccagtcttatggtgaaagacacgaggagttaattaacttaggaagcccagactcccacactattagtgagggacaaaaatcttcagtaacttccaaaacaacaaggaaaggcaaagaaaagtcttctgagaaagaaaagacagccaaagaaaaacaagcacctcgctttgagcctcagatatccactgttcaccctcaacaagaagacccaaataaaccctactggattttgaggttggtcactgaacacaatgaatcagaattatttgaagtgaaaaaggatacagaaagggcagatgaaatccgagccatgaaacaagcctgggagacaactgagccaggaagagcaatcaaggcttctcaggctcgtttgcattaccttagcgggttcattaagaaaacatctgatgctgagagtccgcctatatctgaaagccaaactaaaccaaaagaagaagtagaaacagctgcacgtggcgtaaaagaaccaaactcaaagaattctgcaggttcagagagcaaagagatgacacaaacaggatcagggagtgcggtgtggaagaagtggcaattgaccaaaggcttgagggatgtggcaaaatccacgagtagcgaaagtggaggagtgtcttcaccagggaaagaagagcgcgagcagagcacacggaaggaaaacattcaaacaggacctcgtacacgatctccaacaattttggaaacatctccacgacttattcgaaaagcactagaatttatggatttaagtcaatatgttcggaaaacagatacagatcctctgctgcaaacagatgaattgaatcagcagcaggcaatgcaaaaggcggaagaaattcatcagtttcgacagcataggaccagagtccttagcattcgaaacattgaccaagaagagcggttgaagttaaaggatgaagtcctggatatgtataaggaaatgcaggactccttagatgaagcccgacagaaaattttcgacatccgggaagagtacagaaacaaattgctggaagctgagcacctaaagctggaaactctggctgctcaggaagcagccatgaagctggagacagaaaagatgaccccagctcctgacacacagaaaaaaaagaaaggaaagaaaaagtaaccaggggatgtccaatactaccctgcttctggagagaaaaaatctatttgtaatgatctttaactgcctgctgttaagatattaggccaaatgaaaatagaaatttctctttcttagaaatattttaatgctaacttgttagttttcctcagaaagctagtatttgaagccatttgagtttaagatgctctaatttcaataaaatagcttccaaatatttaataaaatatgtttgacactctaaaaaaaaaaaa

SEQ ID NO: 409312 - DNA, 498 bp, Homo sapiens
  misc_feature (9)..(9): n is a, c, g, or t
  misc_feature (27)..(27): n is a, c, g, or t
tttaccggntctccgcccccccgctancccttaaccctaccccccccccccccctctagactccttagatgaagcccgacagaaaattttcgacatccgggaagagtacagaaacaaattgctggaagctgagcacctaaagctggaaactctggctgctcaggaagcagccatgaagctggagacagaaaagatgaccccagctcctgacacacagaaaaaaaagaaaggaaagaaaaagtaaccaggggatgtccaatactaccctgcttctggagagaaaaaatctatttgtaatgatctttaactgcctgctgttaagatattaggccaaatgaaaatagaaatttctctttcttagaaatattttaatgctaacttgttagttttcctcagaaagctagtatttgaagccatttgagtttaagatgctctaatttcaataaaatagcttccaaatatttaataaaatatgtttgacactctaaaaaaaaaaaa

SEQ ID NO: 409313 - DNA, 272 bp, Homo sapiens
aatggggagagtttagaacaccatggatatcgtggaaatggcactgatggggagagtttagaacaccgtggatatcatggaaatggcacccacagcgagagtttagaacaccatggatatcatggaaatggcactgacagggagagtttagaacaccgtggatatcatggaaatggatttcagaaaggcttttgtatgttagttttcagccaagtcaagaagtgagatgcatccacatctggctgcatgcttgtaattagaatctgactttc

SEQ ID NO: 409314 - DNA, 359 bp, Homo sapiens
taaattccagcaatggtagacatcactcttctcttaatgggagtgtttgaagaataaggctatctagttagagtgtgtgagtacttctctgctcacaacacatttgccaccttaagctctacttatggccatcaatgtgctgaacaatttgaaaagttttgataagaatatctttgaatatataactaaagagaaagccttcatttttatcaaagatgattttcaactgctgctcagttgagagtcataacctttaccttcatctaggtcaaacccacgtcagaacccagcagataccacatctctaattaagaaaatattgaaaaaaggttctagtaattttccctctacctgtctca

SEQ ID NO: 409315 - DNA, 842 bp, Homo sapiens
gccaaaagtaagcatttagccctggggccagagggaagacaggcctgaggagggggcaaaaaggtcatgaaggggaaacagaatcaggggccacagcctattttctgccccctcagccccctttcttccccgactctctccctactgtgtctgagctaggatgacagacttacagccccaagagtgaacccagtgggaatgggtccctccccctagcaacttcctgtggctgctgtaacaggtcaccacaagctgggggtattggaacaacacagatctcttctcttcccattctggaggccggaagtctgaaatcagtttcactgggccagaaccaaggtatggacagggccactctccctctgctccctccggaagctgcagggaaaatcccctgcctttgctgaattccagagctttgttcctttcactgtttgcattcctagtctctggcccttccaccaccttcaaagctgactgcataccatccccttctcccctctctggaggaacatggccctctgcctccctcatataagggcacctgtggttagatcactgggctgactcatatactccaggataatcaccccttctccagatcctcaacttaatcacatctgcaaagtcccttttgccatataaggtaacattcacaggttccagggattcaaacatggacatcttgaggctgtcccttatccaacctattcagagcctccaacattactggcattgagttcttgtgctccctttactctctttaaaaatggatcctctattaatgaccatatcattagaagctttggttgtaagcaacggtaatcctgactcaaacttac

SEQ ID NO: 409316 - DNA, 435 bp, Homo sapiens
caaagtctgtattagtcagggttctctataggtacagaacaaatgggatacatgtatatataaaagggagtttattagggagaattggttcacacaattacaaggcaaaggtcccatgataggctgtatgcaagctggagaagagagaagctggtagtggctcagtccaagtctgaaaacctcaaaaccaaggaagccaatgatgcaaccttcagtctgtgaccaaaggctcgagatatcccaggaagctgctggttcaagtcccagagtccaaaggctgaagaacctataatctgatgtccaagggcaggagaagcataaacaagcatccagcatgggaagaagaaagagaaccagaagactcagcaagcaaggttatcccaccttcttccacctgctttgttctagccacactggcagccaatcggatggtgc

SEQ ID NO: 409317 - DNA, 946 bp, Homo sapiens
cacacatcttagtttcttccccatcatctccactagcctgtctctctgctccttcaagaacctgctcaaaagagcacctcctctgggaagccctccctgcttcagcaatgctgagctgcctgtggttccctcttcactttgctcatctcctctgtgccctgcacacactgggccttctgctaattaactccacctcatcctttaaggctggcctcagatgttgcctcctccaggcagccttcccaggtttttccagacagggttagagcctgtcctctgggtgcctggagcaccctgtgcttttcatactcattgctacttgttattctgttctgggtcaacgtctgtctccccactagagtgcgtgttccctggaagttggagctttgtctttcttccacctagcctcagagctagtgtcgaccagccatgcaataggagttcaatttcaatgtctgtttgtttccttcatttctcccagcacaggaaagcacatagcccatctgtggaagaaaattccagaagaccctgcagtgctgtagaccttgctcccttctccaacctttacaccttgaccaatacttaccctcccatcaccatgcgccaaacacactgagacatttttctctttgagtctatgaacacactcagctctttccagccacagggcctttgcatgtgcagcttcccctgtttgaagtctttcactcagctttttagcctggctgagccttgtcaggactttcaagaagtctcagctcaaatgtcacccctcaatctaagctaagctctcttttgtttggggccccagcattttgtatattttcttcacagagcacctcacagtgtataattatctcacatattggttcacacacatctcttttcctccgataccctcactagaatgtaagcaacacgaggtcagggaaggcttcttacctgc

SEQ ID NO: 409318 - DNA, 214 bp, Homo sapiens
ggccgcacccaagagcctggcacaccaggatttgctcaatacgtattttccaagtgaatgagtgaatggattggagggaagggcccaggcatccttccctccaatccctgcccaagttggaagggctgaaatctccagccccatcctaagcccctctctcccagcagagacccgaagagacagatcccaccagtggaagggagtccccggcaag

SEQ ID NO: 409319 - DNA, 1038 bp, Homo sapiens
gtcccccactattaataaggtcattgtcagctgagttggggaggtggcgtgggtagatacaattaatttagattttttaaaaggcttttgagaatattcggagaacctaatatattttgagacctgacatttattttaaacgtgaaaagcaatttacaaaattgcacatactctataaatacacttctgttataaaaatagacacgtacggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcacctgtagtcccagctacttgggaggctgaggcaggagaatggcgtgaacccgggaggcggagcttgcagtgagccgagagcccgccactgcactccagcctgggcgacagagcgagactccgtctcaaaaaaaaaaaaaaaaaaaaaaaaaaaaaaaaagacacgtacacagacaaatgttctgacagaaatacactgagatatctacagtgcttgtctctggataggatagggtataatttaattgtttatagttaagttaatgaacttggccagacagacctgggatcaaatcccgcctctatcatgaattggctgtgaggtgtgacattgaaaaagtgatttagcctttgttcccctccaggtccttatctgtaaggtggcagttacaataatacccacctcccagggttatatgtcaatgggttaggcacagacctaggaactcagcaaatggactactatgaagtattagctttttactgtttctggttttctgatttttgtctcctgttgtgaacatacgttgcttttgtaatatgaaaaataaaaaataaaagttaaatttgttttgtttgtaagaatcagttgaggacagatgggactatttgcatggattggtgtcatgtttgaagtcagttaccagagggtttctttcaacagagtataccaaa

SEQ ID NO: 409320 - DNA, 618 bp, Homo sapiens
aaaaatataataaaaaataaataaaaaaatataaaataataattaaaataaaaaaataaaaaaaaaaaaaaaaaaaaaaaaaaaaaaaaaaaaaaaaaaaaaagacacgtacacagacaaatgttctgacagaaatacactgagatatctacagtgcttgtctctggataggatagggtataatttaattgtttatagttaagttaatgaacttggccagacagacctgggatcaaatcccgcctctatcatgaattggctgtgaggtgtgacattgaaaaagtgatttagcctttgttcccctccaggtccttatctgtaaggtggcagttacaataatacccacctcccagggttatatgtcaatgggttaggcacagacctaggaactcagcaaatggactactatgaagtattagctttttactgtttctggttttctgatttttgtctcctgttgtgaacatacgttgcttttgtaatatgaaaaataaaaaataaaagttaaatttgttttgtttgtaagaatcagttgaggacagatgggactatttgcatggattggtgtcatgtttgaagtcagttaccagagggtttctttcaacagagtataccaaa

SEQ ID NO: 409321 - DNA, 661 bp, Homo sapiens
cagtacctagacctgggtatgaaggccaagcaaaagctttggttctgggcaggatctgcagtcacatttctagattaccagctcatccaggacttgagagaccaagacccaggagaaaaggaaacctcagagaggtcttaattttcatccagaccaccttcagcccacttctactgaccacaagcttttggatcctgccctgggtctctgagcacagcagaatacaggagaatccctttcttctggagacatgatgccttatcttccctcccaaaggaccatctctgcttcaattccactgccagccacatccttgctaccaccctcttactacttcctattccagccaaactgtattagtttttaatttatttcactcagttattcttattacagtttaaatatagaaaatacaaaatatggatatttattttatttcttattatacaagcatatccatgttatctttgatattgctacttggtccacacaggtggataaggtaccatatttaccatctgaccctttatagaaaaagttagctgacccctcgtctaaactatgaagacagaaacatctgtttttttccttattgtagtcccacaacaggtgcaaatgtgtcctaaatgaatatcattaagtgaataaatgatggaaaaat

SEQ ID NO: 409322 - DNA, 759 bp, Homo sapiens
caatgaatgagagttcctattgtttcacctgctcgccatcatttggtgttttcagagtttgaaatttgggccattataatggagtatctgtctcttggcttcctgagaatctgtcgtgattaaatagtgaatgaaagaaactgaatggaattttctgtaccattgtgcccagaattggttccttccggtgggttctttgtctcgctgacttcaagaatgaagctgtggatcctcgtgagaacagagaaaaactgttttctgaaaagcaattctgcaaaaacattgacattaacaaaaaacacacctgcttggaaaagaggataacatgttggacaatggttaaattatatttactttgatatgtctctggaggttaaatcaatacctgtatgaagcttgaagttcacatttattatggagggcacttgtaaaagtgtatctgaagcctgtaagaggcagaaggactcagtcatatgctgccttctgtgcctgatgttttcttttgactctagggagagacgtgaacatacagtctgttattgtagtttatgcacaaagactcaaataagaaagatgtgggtgtatgtataagaaaaggtttagaaagcttggcatattttctatgaatgttaagaacttgtattactgtaattctgtaagtctaaatgcaatcgaaggacacaaacatctctatgtataatgagattaactgaaacataattgaacaaaactggaaataaagaaaaatctatcaaataa

SEQ ID NO: 409323 - DNA, 1042 bp, Homo sapiens
attatcttatcaaatttaaagaaagaggctatatataagaaaacagtacatattctatatgagaaaggcagggcttgctcttgctcaaggcctgtttctaggccatgagacatctttctataaattagaaaaatggttctttttatggatggatccagctctgcaactagaaatcttaatgaatagatagcgctttatgtgcaggaaaatggtactggatgcatgacttgaagtacagcacacaagcttcattccatctcctttactccccttggtcaggaacctgaattttctgtaccattgtgcccagaattggttccttccggtgggttctttgtctcgctgacttcaagaatgaagctgtggatcctcgtgaccaccttcagcccacttctactgaccacaagcttttggatcctgccctgggtctctgagcacagcagaatacaggagaatccctttcttctggagacatgatgccttatcttccctcccaaaggaccatctctgcttcaattccactgccagccacatccttgctaccaccctcttactacttcctattccagccaaactgtattagtttttaatttatttcactcagttattcttattacagtttaaatatagaaaatacaaaatatggatatttattttatttcttattatacaagcatatccatgttatctttgatattgctacttggtccacacaggtggataaggtaccatatttaccatctgaccctttatagaaaaagttagctgacccctcgtctaaactatgaagacagaaacatctgtttttttccttattgtagtcccacaacaggtgcaaatgtgtcctaaatgaatatcattaagtgaataaatgatggaaaaatatgtattttcctgtattgtctaataaccagatatattcttattctttatctgtcacctatttatcctaatttcaactaacttatcttttccatgaatcattctcaactaacttcaattgggactgatttcatgaacagacttcaatcattttaacatt

SEQ ID NO: 409324 - DNA, 904 bp, Homo sapiens
caatgaatgagagttcctattgtttcacctgctcgccatcatttggtgttttcagagtttgaaatttgggccattataatggagtatctgtctcttggcttcctgagaatctgtcgtgattaaatagtgaatgaaagaaactgaatggaattttctgtaccattgtgcccagaattggttccttccggtgggttctttgtctcgctgacttcaagaatgaagctgtggatcctcgtgaccaccttcagcccacttctactgaccacaagcttttggatcctgccctgggtctctgagcacagcagaatacaggagaatccctttcttctggagacatgatgccttatcttccctcccaaaggaccatctctgcttcaattccactgccagccacatccttgctaccaccctcttactacttcctattccagccaaactgtattagtttttaatttatttcactcagttattcttattacagtttaaatatagaaaatacaaaatatggatatttattttatttcttattatacaagcatatccatgttatctttgatattgctacttggtccacacaggtggataaggtaccatatttaccatctgaccctttatagaaaaagttagctgacccctcgtctaaactatgaagacagaaacatctgtttttttccttattgtagtcccacaacaggtgcaaatgtgtcctaaatgaatatcattaagtgaataaatgatggaaaaatatgtattttcctgtattgtctaataaccagatatattcttattctttatctgtcacctatttatcctaatttcaactaacttatcttttccatgaatcattctcaactaacttcaattgggactgatttcatgaacagacttcaatcattttaacatt

SEQ ID NO: 409325 - DNA, 509 bp, Homo sapiens
aaaagctgctataaacaccattgtgcagtgtttgtgtgcacatacaatttcaagtcatatgagtaaatatcaagtagcatgattgctggtttgcacggtaaaagtatatttagttttgcaagaaattaccaaaatgtcttccaaaatggctgtaccattttttgttcccaacagcaatgaatgagagttcctattgtttcacctgctcgccatcatttggtgttttcagagtttgaaatttgggccattataatgggtatgtagtgatatcttaatattgttttaatttgcatttccctaatgatgtatgatattgtatatgtttatttgtcaacttggactttctttggtgagatatctgtttagatcttttgtctattttttaaaatatcaggttgttcctttcttcttattgagttttgagagtttttgtatattttggataacagacctttatcagatatatcttttacaaatagtttccctcagtttgtcaagccttcattttt

SEQ ID NO: 409326 - DNA, 345 bp, Homo sapiens
atggctctgctccatccccctagaaagccccccaagagcccctgatgccctcggggaaaggcgtctgaccctacttgctcctctgccactccagctccattggatacaggctgcacgtttacggtgatggaaggcctctgggggttcccaactgaccctaaatctgatgcgggggaggtaactccaggttaagtagaaagaacactggccaggattttaaagacctggattccagtcctggctctgctggtgtgtggccgggggcaaataagcatcacttttcccatctgtataacagatagattaaaactcatgatcctctggggctctcaaagctccacattc

SEQ ID NO: 409327 - DNA, 1397 bp, Homo sapiens
ttaaaaagacatgcatctacaggggcaaacagaagagaatatgacaacaagactttgaaagctggatagaaggactagtggcaaatgactaagacctggaaaagctgaaccctaaaaaaggcagtaagaaaagcctagaagcaacctacactgcacctcagtaaggttgatggtttgcccacaaagaaattttggaattctacttctctaaggacaaatacacacagatgcatatacaaggatatttactggagcattgtttataacagaaaaataccaaaaacatcctgaaatgattgaatacaaggaattggttaaataatttatatctactcaaccagtagaataccataaaatggtgacatagaaatgaagacaggttacctgattgatggctcccaacatctcagccctactggccactcgtgctgcacactggctaagaaactttatactcttctccagcttcttaatgatttcctgtgcctggttgtcatcttcacacagaggtgttaaagactgtatagaaaacagcatattaaaagatatctaacacaagcattcagcgagtgattctgacactgactaagttgcaaatgtggatgacattctaatctcagttatttcggtggaagatgaaaagaagcagcaaagatcaataatgaatgatactgatatattattatcttttttgggtactgggtagatatacgcaggtgatcacaaatcttttatgtctattcttgatcccttttttctttacttcccaaatttgccacatctttcttctacagctaataggatgggctgcaattaattggtaatggtaaagagattatgcttacaaaagaggtgaatgtatcatataaggagcataggttggaattttaagaaacgtaaccaaacatattggaattaaaaatgtctctgacggtatgactgggctggctaggtgaatatacattcattgccttatgaattttcctctcaatcctgtgccctttacacaatatgatgcccttcctgatgaacatccttctcaccagagtacagacaggattaagtgaataacagatttggaagcagacatgacactgctcattacctgtgtgattgtgagcaaatttctaaaactttcccaaatctaaagcaacatgaattataagagatacaacgattttgtatatcattaagaaagaaaaggctgtcaataaaaccattaggcaccaccgactgtaaattgcatcataattttagaaatgttcaaaaaaaatcaacctttctgatttgctgtttccttatctgtccagtggggacaatcacgtatcctctccagaaatactgtcatatgataggtaagagatgcacaactgcctgttgcacattcgtgctcaatg

SEQ ID NO: 409328 - DNA, 537 bp, Homo sapiens
ttaaaaagacatgcatctacaggggcaaacagaagagaatatgacaacaagactttgaaagctggatagaaggactagtggcaaatgactaagacctggaaaagctgaaccctaaaaaaggcagtaagaaaagcctagaagcaacctacactgcacctcagtaaggttgatggtgggtatgtgaacagaagaaatggttgaaagtctgtgtaaaaaaaaaaaaaaaagattaggtccagagactccttccttactgtggccagcacagcaattttccctccactattttggtgaaagactacatacagttggatatctagagagagttaacttgaggttctgtggattgggaaagaacagatagttgatgatggatctatcatgctgaaaacaacagatttaagcaacaacttatatgcatattgaatattgagatccagccttattcctccttccagcctccaaacactggcagccagagttacaccctcaaggcaggcagttggaaggtttttctctggggattctaatattcta

SEQ ID NO: 409329 - DNA, 1246 bp, Homo sapiens
agcaacacattcaggcaaagggatgcgagaaaactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatgtttcgaacaaacaagaaggccaaaatttggcgtgatacattcctagtggaaagagggtaattattggttcctggggtgcttctgggaaccagtcctagtgggcagctttccctgctgagtattttttttctccttatttttgtttactaagcatgcagatttcgtaaacctagtcacaagattgaatggtttgctgcttattctgtagtggtcaatagagtaataattgctggatcagaattgtaaagaataaccctcaagttggttaattggtacaaaaacacagttagatagaagttatagaatttgatagtatagttgggacattatcgttaacaataatttatgtatatcttaaaatagctagaagtgaagaattgcaaagttcccaacacaaggaaaagataaatgagatgatgaatatcccaattatcttgatttgatcattacacattgtagactggtatccatatatcacacgtacccccaaaatatgtataattgtgatatatcaatttttaaaataccaaaaaagcaagagaatgacgactccacattccccaaaaagaataaattctcataagcttggaccaaagcctttatcatgggtgtagatttactgttgcatttctcagtgctggtttctaatcagaccagtggattgagtttctctaccatcctccccacgttcttctctaagctgcctccaagcctcacccggcacccttcttcctacttcctacttcttttccttgtgtgcctttcctagttttaaatagataaatgtatgccattgtaattatttccattgtcacttctgggtttccccttttggttcattaatacccattgccttgtttttctctgtacataaattaggagagaga

SEQ ID NO: 409330 - DNA, 370 bp, Homo sapiens
tactactactactaaattcgcggccgcgtcgacgataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttt

SEQ ID NO: 409331 - DNA, 105 bp, Homo sapiens
tcaagcttctaacgatgtacggggacatgatacttttatagaacaattctggcttcaggaaagtctagaagcaatatttcttcaaataaaaggtgtttaaacttt

SEQ ID NO: 409332 - DNA, 5696 bp, Homo sapiens
ggagttctcagacctccagtttcagccctgccctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcagggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttt

SEQ ID NO: 409333 - DNA, 4337 bp, Homo sapiens
ggccattccaatggaacagacagggtaaggaccaatctggactgtgttatcttttccaggtgcaagtatgtgctatggaactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttt

SEQ ID NO: 409334 - DNA, 2115 bp, Homo sapiens
  misc_feature (51)..(51): n is a, c, g, or t
tgtggtactgctggagtacagtggtgcagtctcagctcactgcaactccgncctctcgggttcaagcgattctcctgcctcagcctcccgagaagctggaattacaggcatgcgccaccacgcccagctaattttgtatttttagtaaagatggtgtttctccatgttggtcaggctggtctcgaactcccgacctcaggtgatccgcccacctcggcctcccaaagtgctggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttt

SEQ ID NO: 409335 - DNA, 1704 bp, Homo sapiens
ttgaggatcccctgctcttccgtgcccatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttt

SEQ ID NO: 409336 - DNA, 1655 bp, Homo sapiens
agtgcgatccccgggctgcaggaattcggcaatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaattttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttt

SEQ ID NO: 409337 - DNA, 2781 bp, Homo sapiens
ggagttctcagacctccagtttcagccctgccctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcagggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagagggtaattattggttcctggggtgcttctgggaaccagtcctagtgggcagctttccctgctgagtattttttttctccttatttttgtttactaagcatgcagatttcgtaaacctagtcacaagattgaatggtttgctgcttattctgtagtggtcaatagagtaataattgctggatcagaattgtaaagaataaccctcaagttggttaattggtacaaaaacacagttagatagaagttatagaatttgatagtatagttgggacattatcgttaacaataatttatgtatatcttaaaatagctagaagtgaagaattgcaaagttcccaacacaaggaaaagataaatgagatgatgaatatcccaattatcttgatttgatcattacacattgtagactggtatccatatatcacacgtacccccaaaatatgtataattgtgatatatcaatttttaaaataccaaaaaagcaagagaatgacgactccacattccccaaaaagaataaattctcataagcttggaccaaagcctttatcatgggtgtagatttactgttgcatttctcagtgctggtttctaatcagaccagtggattgagtttctctaccatcctccccacgttcttctctaagctgcctccaagcctcacccggcacccttcttcctacttcctacttcttttccttgtgtgcctttcctagttttaaatagataaatgtatgccattgtaattatttccattgtcacttctgggtttccccttttggttcattaatacccattgccttgtttttctctgtacataaattaggagagaga

SEQ ID NO: 409338 - DNA, 2724 bp, Homo sapiens
  misc_feature (2652)..(2653): n is a, c, g, or t
  misc_feature (2655)..(2655): n is a, c, g, or t
  misc_feature (2657)..(2658): n is a, c, g, or t
  misc_feature (2660)..(2660): n is a, c, g, or t
  misc_feature (2665)..(2665): n is a, c, g, or t
  misc_feature (2677)..(2677): n is a, c, g, or t
  misc_feature (2687)..(2687): n is a, c, g, or t
ggagttctcagacctccagtttcagccctgccctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcagggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagaganngnanntntgcangataaaattaanaatttaaaanaagtgaggggattatgaagctttgccataaatgcaag

SEQ ID NO: 409339 - DNA, 348 bp, Homo sapiens
ggatctcagccatcaccgtgtgcccctttacagagtcccacagatcgttctcaacattgacttggcccccacgatcctggatattgctgggctcgacacacctcctgatgtggacggcaagtctgtcctcaaacttctggacccagaaaagccaggtaacaggtgtgtcattgttcctcctctcagccagccccaaatacactgagctccagctggtgcccagagccagccagcagctgaagacatggaggcagaatatgccttgcccacaaggatcaccccaagctgagcatttctcagctgcttgtgaatagcatattgatggagatgcactcatggtctgtggga

SEQ ID NO: 409340 - DNA, 5582 bp, Homo sapiens
ggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttt

SEQ ID NO: 409341 - DNA, 4198 bp, Homo sapiens
ggctgcatcttgcctggtgatgtggtcagaatacaggggtgcaggcatctctccagcctgaccctggcaagagtcagttaatcttgctcagtgccattgctgtgatcacacacccacccttgccacacaactacccatgcctaggagaccagatgagagggtgagaagagttgaaggccaatgagtcactgctgtagaaaaagcagccctaagtgccaccttcccctggcattggatctcagccatcaccgtgtgcccctttacagagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttt

SEQ ID NO: 409342 - DNA, 4836 bp, Homo sapiens
ggagttctcagacctccagtttcagccctgccctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcagggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaaca

SEQ ID NO: 409343 - DNA, 4191 bp, Homo sapiens
ggagttctcagacctccagtttcagccctgccctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcagggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaac

SEQ ID NO: 409344 - DNA, 2739 bp, Homo sapiens
  misc_feature (2652)..(2653): n is a, c, g, or t
  misc_feature (2655)..(2655): n is a, c, g, or t
  misc_feature (2657)..(2658): n is a, c, g, or t
  misc_feature (2660)..(2660): n is a, c, g, or t
  misc_feature (2665)..(2665): n is a, c, g, or t
  misc_feature (2677)..(2677): n is a, c, g, or t
  misc_feature (2687)..(2687): n is a, c, g, or t
  misc_feature (2710)..(2710): n is a, c, g, or t
  misc_feature (2725)..(2725): n is a, c, g, or t
ggagttctcagacctccagtttcagccctgccctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcagggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagaganngnanntntgcangataaaattaanaatttaaaanaagtgagcttggacctttggacngggatccttttaatngacttgaggcttcc

SEQ ID NO: 409345 - DNA, 408 bp, Homo sapiens
aaaaaagaaaaaagaaaaaaactaaggcagcagctcttaataaataacacctggagcagaatcggtaaactgctttcacgttggcttttgcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaagtaagccacgcttttgtgaccatctcaatggtggcctaggcctgtgggaataaacaatagagagacgaaagggttgctccttctacattttagatatt

SEQ ID NO: 409346 - DNA, 467 bp, Homo sapiens
attcccaaagtacaggcctgaaccactgtgcctgccgagatcttacagatactatctctaaggactatctcctcaccaccaacttgccatgtgttgacccaaagtaggggaagggttagagagagggtcaaaaagtccgtcaactaccgccttccatgtgaaccaagaggacattgatgtgagtagaaaaaagaatgaagaaagcctgtttaatctatgggcaccatcaaaagaattaaatttgtattacagaatttctacaaggagaagagaaacaaaatgacagaaagcttatttaaaatatagaggctgaaaacttcccaaatctagggaacaatgtaaacatccaggtatataaagctcaaaagtcttcaattcattcaccctaaagaagacctcaccaaaacatagtatgattgacctgtcaaaaatcaaagacactcagaaataaagccacaaacctacaa

SEQ ID NO: 409347 - DNA, 439 bp, Homo sapiens
atgcctcatcacaggatgcctggataaggaaagtgcaacccaaattaagttcagcagggtgaagtaaagttcatgaatccagaagatggactgacaaaacctttccaaccagttggttcccattcccctccaccatccgaccctaaggctacagatcaactatatacaacatcatagaaagtgggtctacaacaaaggatgacagtccgagagtcttgcagaagagactatgccagacactcttgactactgatacctcaagaaactgactcatggacacaaactttggagtataagcgacatcccttaagcaacaggctagactacaccaaaggattcagtcgagatttctgggaccctttgtgaagcagacaacccaagatctagtggaacacaatgtaatgactgaatgaattaatgaaagaaatctaactctaaa

SEQ ID NO: 409348 - DNA, 497 bp, Homo sapiens
cttgcagccaatgaggactgtttcagataagcatattttcattttcactgggagtctgttctttcttagtatctcatacacagtagtatctgggtcttcaaaacaggctgtgtcgttcttattccagcttgagcctggatccaggtgtttggagaatttgggttttcagcagctttttactgaagcatttggccttctaagtgcattgctatatgtcaccagtggtagcttgagtttttttgtcttgtgatttctttcccaaagctataaaagtggcctgtaatcaatagtaaagtcttgtcaatagcatgtttctgaattcattttaggaatagtttgtatcaaggaatcattttcccacttctttggttcaatgttctcttgtttcaagtcaaggaaacagaatgataccagtaagaaagcaaacactccctagcggttcagtctcatattgaaatgactctgctgttgaaaatgccagtgtggctctataggaa

SEQ ID NO: 409349 - DNA, 431 bp, Homo sapiens
gtcttggctcactgcaacctctgcctcctgggttcaagcgattcccctgccttagcctcccaagtagctaagactacaggcatgcgccaccatgcctggctaatatatatatatattttttgtagttttagtagagacggggtttcaccacgttggccaggctggtctcgaactccagacctcaaatgatctgcccgccttggcttcccaaagtgctgggattacaggcattagccactgtgcctggccaacaatatatattaaataagcacacatacaacaaaagtaggtgttggtaagcttacaaaaatgtgaccagtagcttgctgaaacctaactttttatttgttcatggaactttctagaccgtaactacactgaataatgagaatctgctgtaatctttttaggtgctgtagatgagccattgg

SEQ ID NO: 409350 - DNA, 357 bp, Homo sapiens
aagttgcgaaaggtttatgtgaaaaaataataataaaataaaataaataaaagtgaactgtagctagaaagtccaataacaaatcttttgggaagatctttgtgctatactacatctctcttgtatcttttaatctcttttctgctgaggcaggcagatcacgaggtcaggagatcgagaccatcctggctaacacagtgaaaccccatctctactaaaaatacaaaaaattagccgggcgtggtggcagccgcctatagtcccagctactcaggaagctgaggcaggagaatggcgtgaacccgggaggcagagcttgcagtgagctgagattgtgccactgcactccagcctggg

SEQ ID NO: 409351 - DNA, 388 bp, Homo sapiens
cacagggggcagggacaccctgggggagagacccacgggggacaccccgtggaacccaggtagtgcctcattgagtcttcacctcaccccgtgagatgaggccacacatgagcttcccaatccacccaagagaaaacagtcccaggcaggtgggagacaggctgagacacccagagagcagacagcaagctggggttccaatcctaggattagtgtccatttccagaacccctgctgttcctaccacagtggccccaagttctccaggcacaagtctcctatggtcacctgttacagtgccacagggtggtcagtgctctgataaaaccatggcctgcaccaggaaggacaatgctgacccgagccacatctctgatggccatttgtc

SEQ ID NO: 409352 - DNA, 1201 bp, Homo sapiens
agacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtgagcagctctgtggtttgcctccccagatggcgggtccccgctcgcaccccgtggacaccgggcactggccactcctacatccccagctccacacggcctgcacacctgtgtttccatggaaatgccaccgtgtctgctcccaggcctcccactagtcaggaccagcttcagccacttcttttctctgagtggtgggacaactgcagccagagactctctcccctcccaccatgggcccctctgcccatgtttcctcccaggaagagcgggcagagtggcccagccccaggcagtgcttcctgagcagaccacccggactgtctttcctccacccgcccatggagaaagagcacgcccggccccgccctgtgctcacctctgcctggctcagtgaccttctcaggcattctgccctcctgggcccctctctccctgaaggggctttgtggcatctctggaagagcagggtgtgctgcactcatgggcctggtctcactccttggacttgtcaccttgtgacatttggcttatcagcatttgagaaggctctgctgggtctccatggtgggggtctctcaccttcttgaccctctctccatcattcagctgccagcccaggcttcacacccaagctggctcagcagccgagcctggcaccgagggtccctgcaggctccctgggcagggagagggccaaggacaattgggagggcagcaggcagcccgcagatggtggccatgtggcacgctgctgagacgacactaccaataaaccaaactgccacgcacacactgcaggctcacacccgcaaaactggtc

SEQ ID NO: 409353 - DNA, 455 bp, Homo sapiens
aaggaccataggatagaagtgattacaggccactaccccatccctccatgaccactggaggaaaatgaactctgcttgtgctgcttcttcatctccagggtaacctatgaggatcctcaggctgtcggaggacttgcttctgcactagacaatcgaaaacagagttcagaaggggtaggtctttaaccctgtttttctgcctggagtcttctggagggaaagtcaggtggtttggcaaagctggctgggtaattcagcagaaactggcttgcacagggggcagggacaccctgggggagagacccacgggggacaccccgtggaacccaggtagtgcctcattgagtcttcacctcaccccgtgagatgaggccacacatgagcttcccaatccacccaagagaaaacagtcccaggcaggtgggagacaggctgagacacccagagagcagaca

SEQ ID NO: 409354 - DNA, 1261 bp, Homo sapiens
agacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtgagcagctctgtggtttgcctccccagatggcgggtccccgctcgcaccccgtggacaccgggcactggccactcctacatccccagctccacacggcctgcacacctgtgtttccatggaaatgccaccgtgtctgctcccaggcctcccactagtcaggaccagcttcagccacttcttttctctgagtggtgggacaactgcagccagagactctctcccctcccaccatgggcccctctgcccatgtttcctcccaggaagagcgggcagagtggcccagccccaggcagtgcttcctgagcagaccacccggactgtctttcctccacccgcccatggagaaagagcacgcccggccccgccctgtgctcacctctgcctggctcagtgaccttctcaggcattctgccctcctgggcccctctctccctgaaggggctttgtggcatctctggaagagcagggtgtgctgcactcatgggcctggtctcactccttggacttgtcaccttgtgacatttggcttatcagcatttgagaaggctctgctgggtctccatggtgggggtctctcaccttcttgaccctctctccatcattcagctgccagcccaggcttcacacccaagctggctcagcagccgagcctggcaccgagggtccctgcaggctccctgggcagggagagggccaaggacaattgggagggcagcaggcagcccgcagatggtggccatgtggcacgctgctgagacgacactaccaataaaccaaactgccacgcacacactgcaggctcacacccgcaaaactggtc

SEQ ID NO: 409355 - DNA, 871 bp, Homo sapiens
agacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtgagcagctctgtggtttgcctccccagatggcgggtccccgctcgcaccccgtggacaccgggcactggccactcctacatccccagctccacacggcctgcacacctgtgtttccatggaaatgccaccgtgtctgctcccaggcctcccactagtcaggaccagcttcagccacttcttttctctgagtggtgggacaactgcagccagagactctctcccctcccaccatgggcccctctgcccatgtttcctcccaggaagagcgggcagagtggcccagctccctgggcagggagagggccaaggacaattgggagggcagcaggcagcccgcagatggtggccatgtggcacgctgctgagacgacactaccaataaaccaaactgccacgcacacactgcaggctcacacccgcaaaactggtc

SEQ ID NO: 409356 - DNA, 356 bp, Homo sapiens
cactcgttgttctacccccagcctttaaagtatggccttctgaaaacctgaccctgggagacctgggagcctcaactttgtgcagactccaaatgagactcaccatgatgcgccagaaatctcacacctctaatccacaaaagggagaagcttcatggtttaaatgccattgtctctaagagactgaaatcactggatctgtggcaaaccagggcagggtggcctttgccacaatgtacctggactgaatttgtggagatcaatttggtgttggactttgtgatggttttaatattcctcccttcccttgagtgtggactggatttatagtagtaaatctcttctaatgactaaaa

SEQ ID NO: 409357 - DNA, 493 bp, Homo sapiens
gagagaatgcaccagattccttctgaacgccgcctgccgcgtgcacggctacaactctatttccagccatgctgtggcaagcagttccgggcgggcttcagctccctttgcaccaccagcacctcgcctcctgtcagcatgaggcagttttcattttctgcccaggggttccgcagcgccccaacacaaggttggcagaagcgggctcagccggaggacttgtggagggaagttgcttccactgagccagcctcaatctggggtgcacaggcgccaccaggtgaatgcttctgccaggccgtcatctgacccataaggtccctctgtgcactgcttggaaggtcctggcaggctgagccccagccacccacggcagtgacctaataatgcaccgttatcttggctcttctgctctctcttgtttcccactcctgttcgtccctcatttctggtccctagaatgacttccaaaataaactccctgtacacaaac

SEQ ID NO: 409358 - DNA, 921 bp, Homo sapiens
gtggacattgcctccatgtttcagcagcagagctacgatatcttttcggccttgcttggctgcttcatgcattgctgaccatcgcttgacacagggctggtctaggctagtgttatgtttgatcagagtcgacaccatgtcataggagccctttttcacagcttgaaaatgattgttaaaaacaacattaagggattctgaatagcaaatctcaaagaagaccatagattcaagaacaaactgaggaagtgccatgaataatccattttcctataaaacctaagaagacttggcatgggttccacaacaaaggtgctgattaagctacagaagccccaagtatttagctggccacagaccatccaggtagacaataaatgtcctggcctccgttgccccaaggtgtggtggcattgtgacaaaatctgaactaatgggacatgagtggaagggccgtgtgcactgtcccggtcatctttttaaattgaagatgcttgcctagggcttcctctttagtccttcctgctgcctggaaaatggcgacgttgggagcaactttggaagcacactgtaatgttgatacagccaccctcacaaccctgggccattctgcaatgtgtgagagagaaatgacttctttctctttaaaaaaaaaaaaaaaaacacaacaaaaatcctgcacacatgcaagcactgatcagcactagtcagaccaaacaagaaagagggggggggggcgccaacaaaagtttaccccgcgggggggcccaatacagcggcggacacgcttttgtggacgaaggggccccaaagaaggccccattataagagaggcgagggcgggcgttaaacacgtcggcgtgagacaccgcgtgggaccttgtggagagacccttccggggggcaacttgggcacccccg

SEQ ID NO: 409359 - DNA, 592 bp, Homo sapiens
gtggacattgcctccatgtttcagcagcagagctacgatatcttttcggccttgcttggctgcttcatgcattgctgaccatcgcttgacacagggctggtctaggctagtgttatgtttgatcagagtcgacaccatgtcataggagccctttttcacagcttgaaaatgattgttaaaaacaacagaagaagagacagatttggatctcactcgtagagtttatggcctagagaagaagcctatgctgccttctatttaaagagagactcaaagtctgggcctgtactgggaaacgtagaagaagatatgaggccacatggaacattctggggtaaccaggaggcagaacgcagaaaggatctaaagccaaggcaaggaaagcagctcccaatgtggtaatgggaggatgaagacgaactttgcctacttcatttgggagcaggcaagccatccctgcaggagatgcccgtttttctccctctccttgtctaaagtagaacctgttgacaaatgcctctctctgaattgcccaactgtcactggcagctctaattacagtgaattacctcatgctagctggtgttattgc

SEQ ID NO: 409360 - DNA, 641 bp, Homo sapiens
gtggacattgcctccatgtttcagcagcagagctacgatatcttttcggccttgcttggctgcttcatgcattgctgaccatcgcttgacacagggctggtctaggctagtgttatgtttgatcagagtcgacaccatgtcataggagccctttttcacagcttgaaaatgattgttaaaaacaacattaagggattctgaatagcaaatctcaaagaagaccatagattcaagaacaaactgaggaagtgccatgaataatccattttcctataaaacctaagaagacttggcatgggttccacaacaaaggtgctgattaaggtaacccaggaaaagtccctattccccagatgtgtggctgatgaggatgtatatgagcacctccaggatattaacttcatggagactttagtcctctctcgaccttaccacttagtttttaaaatatattacttcctaatattaattctatttcaactctgataactcagtgatagagttcctttcctacactttagatattgctagcatagagaatgaaaccaacatggaactttgaaatgcatgtaaatgtttactgctctgttgtaggccttaagcattaaagaaaaatttaaatgaggccaaaagaaaacaag

SEQ ID NO: 409361 - DNA, 1541 bp, Homo sapiens
ggcgtggactttgctccagcagcctgtcccagtgaggacagggacacagtactcggccacaccatggggcgcccactgcacctcgtcctgctcagtgcctccctggctggcctcctgctgctcggggaaagtctgttcatccgcagggagcaggccaacaacatcctggcgagggtcacgagggccaattcctttcttgaagagatgaagaaaggacacctcgaaagagagtgcatggaagagacctgctcatacgaagaggcccgcgaggtctttgaggacagcgacaagacgaatgaattctggaataaatacaaagatggcgaccagtgtgagaccagtccttgccagaaccagggcaaatgtaaagacggcctcggggaatacacctgcacctgtttagaaggattcgaaggcaaaaactgtgaattattcacacggaagctctgcagcctggacaacggggactgtgaccagttctgccacgaggaacagaactctgtggtgtgctcctgcgcccgcgggtacaccctggctgacaacggcaaggcctgcattcccacagggccctacccctgtgggaaacagaccctggaacgcaggaagaggtcagtggcccaggccaccagcagcagcggggaggcccctgacagcatcacatggaagccatatgatgcagccgacctggaccccaccgagaaccccttcgacctgcttgacttcaaccagacgcagcctgagaggggcgacaacaacctcaccaggatcgtgggaggccaggaatgcaaggacggggagtgtccctggcaggccctgctcatcaatgaggaaaacgagggtttctgtggtggaactattctgagcgagttctacatcctaacggcagcccactgtctctaccaagccaagagattcaaggtgagggtaggggaccggaacacggagcaggaggagggcggtgaggcggtgcacgaggtggaggtggtcatcaagcacaaccggttcacaaaggagacctatgacttcgacatcgccgtgctccggctcaagacccccatcaccttccgcatgaacgtggcgcctgcctgcctccccgagcgtgactgggccgagtccacgctgatgacgcagaagacggggattgtgagcggcttcgggcgcacccacgagaagggccggcagtccaccaggctcaagatgctggaggtgccctacgtggaccgcaacagctgcaagctgtccagcagcttcatcatcacccagaacatgttctgtgccggctacgacaccaagcaggaggatgcctgccagggggacagcgggggcccgcacgtcacccgcttcaaggacacctacttcgtgacaggcatcgtcagctggggagagggctgtgcccgtaaggggaagtacgggatctacaccaaggtcaccgccttcctcaagtggatcgacaggtccatgaaaaccaggggcttgcccaaggccaagagccatgccccggaggtcataacgtcctctccattaaagtgagatcccactca

SEQ ID NO: 409362 - DNA, 1895 bp, Homo sapiens
ggcgtggactttgctccagcagcctgtcccagtgaggacagggacacagtactcggccacaccatggggcgcccactgcacctcgtcctgctcagtgcctccctggctggcctcctgctgctcggggaaagtctgttcatccgcagggagcaggccaacaacatcctggcgagggtcacgagggccaattcctttcttgaagagatgaagaaaggacacctcgaaagagagtgcatggaagagacctgctcatacgaagaggcccgcgaggtctttgaggacagcgacaagacgaatgaattctggaataaatacaaagatggcgaccagtgtgagaccagtccttgccagaaccagggcaaatgtaaagacggcctcggggaatacacctgcacctgtttagaaggattcgaaggcaaaaactgtgaattattcacacggaagctctgcagcctggacaacggggactgtgaccagttctgccacgaggaacagaactctgtggtgtgctcctgcgcccgcgggtacaccctggctgacaacggcaaggcctgcattcccacagggccctacccctgtgggaaacagaccctggaacgcaggaagaggtcagtggcccaggccaccagcagcagcggggaggcccctgacagcatcacatggaagccatatgatgcagccgacctggaccccaccgagaaccccttcgacctgcttgacttcaaccagacgcagcctgagaggggcgacaacaacctcaccaggatcgtgggaggccaggaatgcaaggacggggagtgtccctggcaggccctgctcatcaatgaggaaaacgagggtttctgtggtggaactattctgagcgagttctacatcctaacggcagcccactgtctctaccaagccaagagattcaaggtgagggtaggggaccggaacacggagcaggaggagggcggtgaggcggtgcacgaggtggaggtggtcatcaagcacaaccggttcacaaaggagacctatgacttcgacatcgccgtgctccggctcaagacccccatcaccttccgcatgaacgtggcgcctgcctgcctccccgagcgtgactgggccgagtccacgctgatgacgcagaagacggggattgtgagcggcttcgggcgcacccacgagaagggccggcagtccaccaggctcaagatgctggaggtgccctacgtggaccgcaacagctgcaagctgtccagcagcttcatcatcacccagaacatgttctgtgccggctacgacaccaagcaggaggatgcctgccagggggacagcgggggcccgcacgtcacccgcttcaaggacacctacttcgtgacaggcatcgtcagctggggagagggctgtgcccgtaaggggaagtacgggatctacaccaaggtcaccgccttcctcaagtggatcgacaggtccatgaaaaccaggggcttgcccaaggccaagagccatgccccggaggtcataacgtcctctccattaaagtgagatcccactcaaggcctggtttgtctctcgattgccgccttgccctggcttctcccgccctgttgaggtgggaaggtgaagtgtctgtctggaacaccagcttccgcccttcccagctaggctggggattcctccagggaatattctagtctgtgggggcaggatggaggctccagggatgatactgtgccatgactgccatgggcattcctttccccagataccttcctgcatctgggtcacgcccagaggcagatgggagcctgtgcaggccccgtggcgtcgggaggggcccacacgttggcgcagcctccccaagaccccccacttggcctggtctctcttgttcctcttgggaattggac

SEQ ID NO: 409363 - DNA, 590 bp, Homo sapiens
ggcgtggactttgctccagcagcctgtcccagtgaggacagggacacagtactcggccacaccatggggcgcccactgcacctcgtcctgctcagtgcctccctggctggcctcctgctgctcggggaaagtctgttcatccgcagggagcaggccaacaacatcctggcgagggtcacgagggccaattcctttcttgaagagatgaagaaaggacacctcgaaagagagtgcatggaagagacctgctcatacgaagaggcccgcgaggtctttgaggacagcgacaagacgaatgaattctggaataaatacaaagatggcgaccagtgtgagaccagtccttgccagaaccagggcaaatgtaaagacggcctcggggaatacacctgcacctgtttagaaggattcgaaggcaaaaactgtgaattatagggctgtgcccgtaaggggaagtacgggatctacaccaaggtcaccgccttcctcaagtggatcgacaggtccatgaaaaccaggggcttgcccaaggccaagagccatgccccggaggtcataacgtcctctccattaaagtgagatcccactca

SEQ ID NO: 409364 - DNA, 582 bp, Homo sapiens
cagtggttccctgggcagcaaggctgacaggcacttttatttgctgctttgcacttccctctatttttcaaattttcaaaagtgatcacgtgccatttttaatttaaaaaaatatatataacttccttaaaaagcaacggatgtgcgagagcatgtccctggctgagctgagcacagtcccactcgtctgtcccaggggaccggaacacggagcaggaggagggcggtgaggcggtgcacgaggtggaggtggtcatcaagcacaaccggttcacaaaggagacctatgacttcgacatcgccgtgctccggctcaagacccccatcaccttccgcatgaacgtggcgcctgcctgcctccccgagcgtgactgggccgagtccacgctgatgacgcagaagacggggattgtgagcggcttcgggcgcacccacgagaagggccggcagtccaccaggctcaagatgctggaggtgccctacgtggaccgcaacagctgcaagctgtccagcagcttcatcatcacccagaacatgttctgtgccggctacgacaccaagcaggaggatgcctgccagggg

SEQ ID NO: 409365 - DNA, 1744 bp, Homo sapiens
gctaaataccaaatgtatgaaacctcagttatgtgtgagcatgggctgattagtcattagtccatcgagatgtcttatttaaggggaaagagtgggcgattttaggtgagatggtcctgaagtaagaaccagatgcctgtaaagttcatcaatagaagcccccacggtttatgggcccggagcgagaagagggatccctgccaagcgggttgctggtttcacgcggcatggtagttaagctcgtgatctagtggtggtgatatgcatgttgactggaattattcacacggaagctctgcagcctggacaacggggactgtgaccagttctgccacgaggaacagaactctgtggtgtgctcctgcgcccgcgggtacaccctggctgacaacggcaaggcctgcattcccacagggccctacccctgtgggaaacagaccctggaacgcaggaagaggtcagtggcccaggccaccagcagcagcggggaggcccctgacagcatcacatggaagccatatgatgcagccgacctggaccccaccgagaaccccttcgacctgcttgacttcaaccagacgcagcctgagaggggcgacaacaacctcaccaggatcgtgggaggccaggaatgcaaggacggggagtgtccctggcaggccctgctcatcaatgaggaaaacgagggtttctgtggtggaactattctgagcgagttctacatcctaacggcagcccactgtctctaccaagccaagagattcaaggtgagggtaggggaccggaacacggagcaggaggagggcggtgaggcggtgcacgaggtggaggtggtcatcaagcacaaccggttcacaaaggagacctatgacttcgacatcgccgtgctccggctcaagacccccatcaccttccgcatgaacgtggcgcctgcctgcctccccgagcgtgactgggccgagtccacgctgatgacgcagaagacggggattgtgagcggcttcgggcgcacccacgagaagggccggcagtccaccaggctcaagatgctggaggtgccctacgtggaccgcaacagctgcaagctgtccagcagcttcatcatcacccagaacatgttctgtgccggctacgacaccaagcaggaggatgcctgccagggggacagcgggggcccgcacgtcacccgcttcaaggacacctacttcgtgacaggcatcgtcagctggggagagggctgtgcccgtaaggggaagtacgggatctacaccaaggtcaccgccttcctcaagtggatcgacaggtccatgaaaaccaggggcttgcccaaggccaagagccatgccccggaggtcataacgtcctctccattaaagtgagatcccactcaaggcctggtttgtctctcgattgccgccttgccctggcttctcccgccctgttgaggtgggaaggtgaagtgtctgtctggaacaccagcttccgcccttcccagctaggctggggattcctccagggaatattctagtctgtgggggcaggatggaggctccagggatgatactgtgccatgactgccatgggcattcctttccccagataccttcctgcatctgggtcacgcccagaggcagatgggagcctgtgcaggccccgtggcgtcgggaggggcccacacgttggcgcagcctccccaagaccccccacttggcctggtctctcttgttcctcttgggaattggac

SEQ ID NO: 409366 - DNA, 506 bp, Homo sapiens
tgatttgggggcttagaattttatttttggtttacaagagagtgatccgccttttgtgatctggatatggcaagggacatggcagtcagggagcataggtgagggggagcctgggtgagggtgaccagagcttttaaccctgtcctccctgccttccagtgttcatccgcagggagcaggccaacaacatcctggcgagggtcacgagggccaattcctttcttgaagagatgaagaaaggacacctcgaaagagagtgcatggaagagacctgctcatacgaagaggcccgcgaggtctttgaggacagcgacaagacggtaagggctggggatagcctggctgttggtaaggagctcaggccacagcgccctcgctggccctgctgctccgtccatccaggggggcggcctggaggaaggggcagcgtgcgcgaaggctttcaggggcggggcccagcaaatcgaggcctcggcggagtcctgcccacagggacatcagtgccg

SEQ ID NO: 409367 - DNA, 101 bp, Homo sapiens
atgggagacaactccaaaaatagtctgctgtgtgacctcatcaccaaacagcttgcttctctgaggaccatgtcaaaggcatcttcactggccacatacag

SEQ ID NO: 409368 - DNA, 481 bp, Homo sapiens
aacagggccaatccctactgcagctgccgaggacggccgtcaagtctgtctccacgctcatggtctctgccctgcagagcggctggcagatgtgcagctggaagtcatcagtgagttctgcctcagtcagctcccaagtgaggacgcagtcacctttgaagactccggaggctgagttgctgtgggaggtgtacctggtgctgtgggccgttcggaaacacctgcgccggctgtaccgcaggcaggagaggcacagacggcaccacgtccgatgccatgctgccccccgacccaacccggctcagtccctgaaactggatgcccaaagtcccctctagggggaaccccagacccttagagagtcctgacctcactcttacctggggtcccatatcagccccttcattccatgtattccagttgtaaaacaagtatcaaaatattgggaaataaatatcagatagttctgaaaaaaaaaaaa

SEQ ID NO: 409369 - DNA, 498 bp, Homo sapiens
aacgaaaaaagaaataagtataaatctgacaaaatatgtttaatgtctgatatggttcggttgtgtcccctcccaaatctcatcttgaattgtagttcccataatccccacgtgtcatgggagggaccaggtggagataattgaatcatggggggcgatttcccccatcctgttcttgtgatagtgagttagttttcacgagatctgatggttttataagaagtttcccccttcgctggacactcactctgtctcctgctgccctgtgaagagattccttctgccatgattgtaagtttcctgaggcctccccagccatgtggaactgtgagtcaattaaacctctttactttataaactgcccagtctcgggtatgtctttatcagcagtgtgagaaaggaccaatacaatatctatgtgaggagaactacaaacctcgaaataaagaatgaaataaatgaagagagaatctatgttcgttgaaggaagatgaatgt

SEQ ID NO: 409370 - DNA, 687 bp, Homo sapiens
aatttccttaaaaatagccatgaaaatgtacaaagttgtttttccatcttgccatttttaattcagtgcaaaacctctacttgattttatcttgctatttatatcacccatgcaagtatcacactacatattttgaaataataggattacaggcgtgagccaccgcgcccggcctggagtctctaatttatctcttcaaggaacctacccaaatttcttctttactccacatttcttcagcatgtatgtttttaatctgcttcaggcattttattcttcttgataattttcatgtttctcaaaggtgttctgttccaacagattaactatactattttcaagggcaaatagttatcctttatgacatttctgttttcctaacacctaacagaaatgtgctcttccatggaatagatatttaatacattatttatttgtaacatttttagttattttttaaaaaatagatgatttatttacaagtcaggaaatcctagtaaaaatgctcccatccttgtcttcaatctactactcagtttctaatgctcctcctgtagataaccactgttagttttttatcctctgttgttagtatccttccagtgttacttatgaatatataagtaaatacacatatgtatcatattcctttttttaagtaaaagttaataaattatatataaatat

SEQ ID NO: 409371 - DNA, 1220 bp, Homo sapiens
gagagttcatattaaaaaacagaattcttcttggaactctttaaagaaatgagaagctttgaaaacatcaggccctccatcctactaggcaaccttggactagagcaaagcgctctgctctttggccaggcacataccctctcctcgacacaccccactcagctcgcttgaaccctgcaggctactgagcttgcatcacctaatcttcaaaacttgcctccataccacaccacaatacactggcgcctagaaatccagggtaaagaaccttttaggatcattcccccaggtgcctcatttctgggtagaaaaatgaggtcctagcatagtagctctttcactgtttcacttcctaagtgaacttgcagaattgatgccaagaacagttttccctccattttctagtgtggagcacttgtcttttttgttgtccccatctgagcaacccagaatgatttataaacagcctttctgtttttatctctgcttccctgtggcataattgcagctaagtggcagggcacagcagttacaccgtgagtcaaggaacagaaccaggagagggacccttgtcagccctttaacttctggctttatccgggttccagcactctccagctatcctctgttatgtgtgactggaatccattcttattgacaatggagacagcagtggggggattggctattggatcagataaggttttacctctacatggaatttgagtccaaaggtaaatatattaaacatatagataagaagaaaagaaaaacgttatttaagtatctgatcagctctgcaccccagggacctccacttttgcccaggtttgagaatttgatctatagaattacctgcattctttcccgctcatccatccaatcagccacctttctcccttcaaagaagtgtcttcatttttttccttcttttgttatttttattgactgcccatcactgttattaaatccttccctctttttttgaatgaagcagcagagccttttattttgttttccttgttttgttttttgtttttgtgtttcagaaatgacagggctgtatcacagagttatttgagacggtcagttagggtaatgtttatcatttttggacagtgtgttcacacaaccttgtccaactaacaggatagcaaagaaaaaagagcagggacttaggggacagactggcagatctctattagaattctttccaagct

SEQ ID NO: 409372 - DNA, 487 bp, Homo sapiens
agtcggcccgggttgatagaagataagaagaaaagaaaaacgttatttaagtatctgatcagctctgcaccccagggacctccacttttgcccaggtttgagaatttgatctatagaattacctgcattctttcccgctcatccatccaatcagccacctttctcccttcaaagaagtgtcttcatttttttccttcttttgttatttttattgactgcccatcactgttattaaatccttccctctttttttgaatgaagcagcagagccttttattttgttttccttgttttgttttttgtttttgtgtttcagaaatgacagggctgtatcacagagttatttgagacggtcagttagggtaatgtttatcatttttggacagtgtgttcacacaaccttgtccaactaacaggatagcaaagaaaaaagagcagggacttaggggacagactggcagatctctattagaattctttccaagct

SEQ ID NO: 409373 - DNA, 438 bp, Homo sapiens
tgtgactgcaattccccagatatgatgtgacttcccacagatgtcttccaaagcccttccctgtacctggtatattcactcctacattccctggaaaattctatcctccctcccctaggaaactattacttgtccttcaagtgtcatctccccaggaagaccttctctgactcttctactactcccctctagtaacactaacacacacacacacacacacacacatacaggctccattacaccatcacagacctttacggtaggacctcaattgcacagtaattacttgtttatgcctctgcctccccccattagattatgagcacgtgaaagcagagattgttagttcactttggcagccccagtgcctagcctggcacttggttgttaataaggccttgctgaatgaaagaattaaatcattaaaaatcgcaagat

SEQ ID NO: 409374 - DNA, 473 bp, Homo sapiens
tctcctacagtatttatacatctgttcactattgttgccaggtattcttcaaaaagttctgcgcagtttctgagagaaagaggaaaatatgagtgacatacagaggttggaactcttacacattgctgatgagactgtagagtggcacaactctggaaaactcattggcagtttcttaccttatctcccggcaattccattcctaggtatttacctgagaaaagtaggagtgaggagaatgtgtcctcaaaaaacctgtgaaagaataatcacagcagccttacatataatagccaaaacctggaaacaacccaaatgcccacaaaaggagattagataaacaaattgtggtatattcatacaatagatactacccagaaataaaaaggtatgaactgcagctataaaaaacaacatgaatgaatttctaaaacactctgttgagaaaaataaatcagacacaaaaagtacaa

SEQ ID NO: 409375 - DNA, 407 bp, Homo sapiens
ttaatatacctgcctatccctttcacctcacaacagactgactgtcttgctccaacccttagcagttcccaatgtcatcatcaaggaccatcctcaccagcagtgccacaatattcaatgttcaaggcattatgtagacacaaggctgcatggttaggaagtagtaactgctcaaacaatattaaataaagaaatgtatgaatgacctgcatgacttaacctgaaatcactgagagaaaagaagccagaaactatgcttctggattgccctgatcacaactagaagttcctgccagagtgcagtgctttgaaatcacgtatggggttacaacctcagaaaacaagactcaggcttggtgtggctcaagcctgtaatcccagcactttgggaggccaaagagggcacg

SEQ ID NO: 409376 - DNA, 419 bp, Homo sapiens
tcaggttaaccctcctcaccaaggaaaaatcaggctacactttctttctctaccctcttctgaaaagaaatgaagcccggttaaccctctccacacccaaaagaaaagggaagaggcccgctaagcctggagagccacacacaggcaaagaaaagagcctggctaatctttctctcaggcaaacaaagcaggagggcttgggttaactaccctcacccccaggcagatggaaagaggagagcccaggaatagcccttctccactgaggggttgacaagggcgggtgtgagccgggaaagcaggggtctcacatgccttctccccaccatgtctgggtctagcacagggcctggcacacacctcgagcgctctataaacaccgactgaatggaggggtcagcttccatgcaggatatggg

SEQ ID NO: 409377 - DNA, 2823 bp, Homo sapiens
gccactttggaaccactttaaaccacacttaagacataaagtccctgctcagtccatccagaaaagcttacatagggatttttcattgtttctgcttttcctcatgatctcactggaagaattatggtggtttcccattatgagtcctcagatatttggaatatgagttaagttcatgagtggagagagggccaacattaaaggactagatgtgactcagggcataggtgagaagaactttaaatggagggctagtccttttgtttcaatagctatgtctggccatctcataaaaagcattcctgtgaagttaaacccctaacttgtgaatgccccatcgttagggaagcaggagtataagagagccagaggatgccattttaagtatagttccattttgagactagcaaagcacattccttgtcggtcatggcccatagtcatggggtgtttatagttgaggaaacagcctaaagatacctacagggacactcctacaacagtgcagagtccagatgtcccaatacccgtaacaatatatgctttgaagataatagctatgttttgatgtacttacacactggaatgtccaggttagtttaaatgaatactgtaataattttttttattctgcctgctcacccacacatagacccagcttagcttagttttttcatagataagacccctatataagaaaaacttaaagccagtgcattcctcctcttgttttctgagggcctcctgctcactaatggtgtagcttctaataaacttgcatctttcactgcactctgcgacacatcttaaattccttcctgaacaagatccaagaaccctcttggggtctggatcgagaccccttttccagtgacaccctgacttgcattgttagcagaaaggttagaggcactggaatagagactgaggaacagaaatcaggggtgtgaggtagagagaatcataggcataagcaagtctgatttaaacaaatatgccagacacttgagaaagaaaatgaagcagagagagagagcaataaggagaaactaaaacacattacatgcaatactcaacccactcccttccactagctcttagctgccttctgtccctttcctatttaaaataatgcagtgtttacaatcagtaatttttgctgttgggatttatctggtcaagggcacattttagaatatgaactttggagaagaaaagccagtttactctgatgcagaagctgtttaagattcagggtgtgctatgatgtgaatgtctgtcccccgcccccgccacagaattcatatgctgaaaccgaatccccagtgtgacaatattaagaggtgaggcctttgaggaaatgttaagttatgaggctggagttcttatgaatggattgatgtccttataaaagaggcccaagcttgtttgctccttttgccatgtgaggttatggaagaaggtgtcgtgtatgaagggagacaaagtttcaggtttgtgttttggtggaagtttaggttcaaatgagtcccatattgatgattaggtttcaacataggaattttggggggatacaaatattcagaccacagcaaaagccattggtagacacatcggcccttgggactatgaggaattttagattttaatgagctcattataaatcccactaatttatcttgaccaagggataaagatggatacccaggaatctccacagataagactagagctacactaggccactatcttattacacgacagcacaacatacaaaataaattgtagatgctgctaaatttgtagattaaatgcctgtatcaagaaagaactatctcaaatcaatgacagattcaaccttaaaaacttgaaaaaagacaattgaaactcaaaacaagaaggaaatagtaaagatcagagagaaattaatgatgtggaaaacagaatagcaatagagaaaaacgagtaaaaccaatacagattttttgagatcaataaaagggatataactctgtggatctagcaaaaaaaaaaaatgtgagaaaaaacaaattaccgataagttacagatgagatgacatcactagatactacatagtttatttatttatttattcatttattcatttaattatttatttttacaccccacctggagtgcattggccccatcatggctcactgaagtcttgaactcctgggctcaagcagttcactcgcttcagcctccaaggtagtttggaatatgggagtgcaccaccacaaccagcttttacagattctaaaacagtaataaggaattttatgaataatcttccaatacatttcacagttgccagtttgaaaataaacacataaaattgaacaaataagttagacaacataaatattaatggagaaaatcccatagaatctgtgaaaaaaatctggaataaatgaatttataaaatttacagggtaaataataattttttaaaaaaattatacttctgtatacaatgatcaatttgaaactgaaatttaaaagcactttttacaagagcatacaacatatacttgagacacataagatgtgcaagatatgtacattgaaaactacaaaagattgctgaggaaaattaaagatctaaataaaaggagagatacacaatgtttatggattagaacactcaatattgttaatgtgctaattcttctcaaattgataaacatatattcaatgcaatccaatcaaaatcccacgatgcttttattagaaaataacaagtgaattctaaaattgatatgaaaatacaaagcacttagaatagcaaaaaaaaaaga

SEQ ID NO: 409378 - DNA, 2769 bp, Homo sapiens
gccactttggaaccactttaaaccacacttaagacataaagtccctgctcagtccatccagaaaagcttacatagggatttttcattgtttctgcttttcctcatgatctcactggaagaattatggtggtttcccattatgagtcctcagatatttggaatatgagttaagttcatgagtggagagagggccaacattaaaggactagatgtgactcagggcataggtgagaagaactttaaatggagggctagtccttttgtttcaatagctatgtctggccatctcataaaaagcattcctgtgaagttaaacccctaacttgtgaatgccccatcgttagggaagcaggagtataagagagccagaggatgccattttaagtatagttccattttgagactagcaaagcacattccttgtcggtcatggcccatagtcatggggtgtttatagttgaggaaacagcctaaagatacctacagggacactcctacaacagtgcagagtccagatgtcccaatacccgtaacaatatatgctttgaagataatagctatgttttgatgtacttacacactggaatgtccaggttagtttaaatgaatactgtaataattttttttattctgcctgctcacccacacatagacccagcttagcttagttttttcatagataagacccctatataagataatggtgtagcttctaataaacttgcatctttcactgcactctgcgacacatcttaaattccttcctgaacaagatccaagaaccctcttggggtctggatcgagaccccttttccagtgacaccctgacttgcattgttagcagaaaggttagaggcactggaatagagactgaggaacagaaatcaggggtgtgaggtagagagaatcataggcataagcaagtctgatttaaacaaatatgccagacacttgagaaagaaaatgaagcagagagagagagcaataaggagaaactaaaacacattacatgcaatactcaacccactcccttccactagctcttagctgccttctgtccctttcctatttaaaataatgcagtgtttacaatcagtaatttttgctgttgggatttatctggtcaagggcacattttagaatatgaactttggagaagaaaagccagtttactctgatgcagaagctgtttaagattcagggtgtgctatgatgtgaatgtctgtcccccgcccccgccacagaattcatatgctgaaaccgaatccccagtgtgacaatattaagaggtgaggcctttgaggaaatgttaagttatgaggctggagttcttatgaatggattgatgtccttataaaagaggcccaagcttgtttgctccttttgccatgtgaggttatggaagaaggtgtcgtgtatgaagggagacaaagtttcaggtttgtgttttggtggaagtttaggttcaaatgagtcccatattgatgattaggtttcaacataggaattttggggggatacaaatattcagaccacagcaaaagccattggtagacacatcggcccttgggactatgaggaattttagattttaatgagctcattataaatcccactaatttatcttgaccaagggataaagatggatacccaggaatctccacagataagactagagctacactaggccactatcttattacacgacagcacaacatacaaaataaattgtagatgctgctaaatttgtagattaaatgcctgtatcaagaaagaactatctcaaatcaatgacagattcaaccttaaaaacttgaaaaaagacaattgaaactcaaaacaagaaggaaatagtaaagatcagagagaaattaatgatgtggaaaacagaatagcaatagagaaaaacgagtaaaaccaatacagattttttgagatcaataaaagggatataactctgtggatctagcaaaaaaaaaaaatgtgagaaaaaacaaattaccgataagttacagatgagatgacatcactagatactacatagtttatttatttatttattcatttattcatttaattatttatttttacaccccacctggagtgcattggccccatcatggctcactgaagtcttgaactcctgggctcaagcagttcactcgcttcagcctccaaggtagtttggaatatgggagtgcaccaccacaaccagcttttacagattctaaaacagtaataaggaattttatgaataatcttccaatacatttcacagttgccagtttgaaaataaacacataaaattgaacaaataagttagacaacataaatattaatggagaaaatcccatagaatctgtgaaaaaaatctggaataaatgaatttataaaatttacagggtaaataataattttttaaaaaaattatacttctgtatacaatgatcaatttgaaactgaaatttaaaagcactttttacaagagcatacaacatatacttgagacacataagatgtgcaagatatgtacattgaaaactacaaaagattgctgaggaaaattaaagatctaaataaaaggagagatacacaatgtttatggattagaacactcaatattgttaatgtgctaattcttctcaaattgataaacatatattcaatgcaatccaatcaaaatcccacgatgcttttattagaaaataacaagtgaattctaaaattgatatgaaaatacaaagcacttagaatagcaaaaaaaaaaga

SEQ ID NO: 409379 - DNA, 418 bp, Homo sapiens
ttctacaaaaaatgaaagtaaatgaaattgctagtattgtatatccaaaaatatgccatattgacaatgtcatacgatttgacctaacaaacccattcattgtgtatgttacttaaatctgcaatttgaactgataattcagaagaggaaggatcttttttctaatttttttgtctccaaatgttaagtcacaaaaacaaggaactattagtaacatagtattgtgagctaaaatatgtgctatatatatatatcatgagaaaccctttaaaaggttttcttttcagcaagtggattgttacagagcatttaaaataatttagaattatgtttaaaatttatctgatgacaagttctttccttttgattattttattcctttagatttgattaattctgtccaatacttgtttaacct

SEQ ID NO: 409380 - DNA, 671 bp, Homo sapiens
gttgtactgtgaagcctttattattagagacatatcagattccccaatttcaagtcataacataaatttcaagtcataacatatgtaaaatacataacatgtggtttccattaataaaatattttgtatagaaatagcaaaatatttttacacaaagtattgggtctgtcatcacttccatttgcaagggatgaagactgccaatattaagtcaggtttacaagagcatcttgggttgtaatagggaagcaataaagaggtcaagggaacagttataaaataaatgaatagaatatgttttcccaggtgccacttggggaaaaacactttgatagatcctaggaaataagaaacttaaatagatattttcaaggctaaaaaagctactgatggaggaataaatataatcatcaaacacagctattagaaaatcatattggaggctgggccaaggtgggcagatcacctgaggttgggagtttgagaccagcctgaccaacacagagaaaccccgtctctattaaaaatacaaaattagccaggtgtggtagcgcatgcttgtaatcccagcttgggaggttgagacaggagaatcgcttgaacccaggggcagaggttgcagtgagccgagatcaaaacagcctgggcaacaagagtgaaactccgtctca

SEQ ID NO: 409381 - DNA, 814 bp, Homo sapiens
tgtttattcccacctattttaaacttggtgccatgtcttggttactaagagacatgttggtcatcatcatgtctcttagtaaccaagacatccagcattttaaatactaagaaagaacttttcaggtcatttacttttgagtccagacagcttttaaatttttccattttgaaaaagtatttacatctagaatttagggctgcaggaccaagaagctttgttgatttcagtctgtaagggaaatgggttcctttgagctgaggcagtttctcctctctttggaggaggaccttctcaaaaacaaaactctccaccactgtcagttaccaggaggacctgggtcagttgtgtgttgggaagttacttgagaccagttcctttcctgagcacctaggtttttgtttgggggtgagggaggtggtggttatttttggatggtgactggaggcaagactgagactgagccttgctaaggtggctgcacagagaggaagacaagaagacagcagtggtgtcatgagaaggtctggtctcttggatcttagcaaactcagaagtgttttgtagcaaggctgcttggtataagtccaagaatggtggctacctggaggaatgggatagggtgtgttcttttcaaaggtattcagaagtcaaaattattttagatctgtgcttggtctcacaagacatggtgaattaggcccaactacttccatttagagccctgccttagactccctaaaggccctgcagctctgatctttcatgatttggtagtaatttaaaactcaaaccaaaagctaaaagctaaaaa

SEQ ID NO: 409382 - DNA, 563 bp, Homo sapiens
gaattaccccaccagctttcttgattttccagcttgcaggtggcagataatgagacttctcagcctccataatcatataatgagaatgaagacttttatgatgagccacttctactaaatgaataacagagtttcgttcttgttgcccaggctggagtgcaaaggcatggtctcagctcactgcaacctccacctggagtttaagccattctcctgcctcagcctcccaagtagctgggattacacatgtccaccactacgcccagttcatgaaacatggttagagagaagcgacttctctaaacaacccagctagtcagtgacagactagaacttcagcttcgtcatgtctggtggcaaacttcacgttcttaaacatgaagcttggatggaaaattttgaccagctaccgaaaatgacaactgtaatttcaccactggtactttattcttccacatggctccagagaatgaagaaaacgtttgcagtattccttcattgttacttctttactatattttggtgcaatacagtcatatacagatatattatttgaatgaaaa

SEQ ID NO: 409383 - DNA, 480 bp, Homo sapiens
aggccaacatccacatgaaatgtgtccatctgtttaagcatacgtgccaggcagctaaacttacagaacgaccagtcaggccccctcaggatatcttgcaggtggcagataatgagacttctcagcctccataatcatataatgagaatgaagacttttatgatgagccacttctactaaatgaatagagcagttttacaagcaccacatctgccacacacaggtagcaaataccactggaaggtccaagatccaggggcccacatctgctaagggctttcatgccgtgtcatcccatgaggaaagacagaggcaaggagagtcagatccagagaaaagtgacacatctagatacaaattctaggatcttcccgcctttcagtatcatcactgcttttccactttgacactatatgaacttctaggtttcatatgaaacattctgtattattttcagaaataaaagaagcttcatacaaa

SEQ ID NO: 409384 - DNA, 472 bp, Homo sapiens
aggccaacatccacatgaaatgtgtccatctgtttaagcatacgtgccaggcagctaaacttacagaacgaccagtcaggccccctcaggatatcttgcaggtggcagataatgagacttctcagcctccataatcatataatgagaatgaagacttttatgatgagccacttctactaaatgaatattaaacggcaaactctctgcatgactggagagggtaaagggccagaggagcagttttacaagcaccacatctgccacacacaggtagcaaataccactggaaggtccaagatccaggggcccacatctgctaagggctttcatgccgtgtcatcccatgaggaaagacagagggatcctgttctctgcaaatgcaaacagttcttttattacaaggctttttcaaggggaagagaaaactcatttggcagataaggttaaccttttaaaaaatcaagtgtgttaa

SEQ ID NO: 409385 - DNA, 1124 bp, Homo sapiens
aaacagggatctccagaacactggtggtggacacagctttcctgtcagcacacaaaagacctgttcctcttccaaaagacctctctttaccaccaccaccctcatcactcagaaaccctactgtttgttagacaggtggttgaggggacatgtcagaccctatcctcatggcaaggttaatatgttggtgttcttgacaagtaccaggctttctcagccacaaccagtggattcattcaaaatctaggtacctttatttgcctcccttcctgaacctaatgaagtgccagagtgagtgtacactttcttttctctcatctctcataaatctcttctgtcttcctttaaaaaaaacaaaagtagtagttcagaaacatccgcagaagcaggctttttagtttcttggctctctttgtcatgtccagaggcaggctgttctgtaaaatagactgccagacctcttattgcccattctcctttcttctcagcccctcacccctctttagcaattcctagagggtttaaaggactacagagctgtatggaatgaaaggtgatttctagttcagagtggatagaagaactaaagagattgtgatgggtgctctaggcagggaaaactgaacaaaaaggcagaaatgattcaggggaaaatcgggcctagaatttacactgggttgactagttatgatgggaagagaagtacttttttttagtatgcacgtagaagaatagaagatggttggagtgttaaatatgttccctagagaagggttctttgaagaaacactgcaattttgggtgttctctttcttgtttgcatatggccttacttatgtggaagattaatactgtgttataatattttctctttctgtttactgggaagattcagctgtacagattttcttttactttcaaatagaaatatttggaataatatcagtctttcttttttgtacattatgtggatatggatattcatggcagttttcagcctgttcttgtttctgttaaaaccgtatctttaacattttaatttgaataacttggtcttatctgatgcggaagactggaaactattgtgttcatgggtaaataaactacaaaatatttatggcttt

SEQ ID NO: 409386 - DNA, 359 bp, Homo sapiens
accttgatgacttaggaattaacgaatggatggatgatggatcctctgtatttccttttatgaggaagagattaatttgtacttattccaataaacccacaacagatttgtatttaggggcattcattcagtttcaaggagctgcaacagttgaatattcagtgctgtttttgtgataatatttgacattgaagattatattaaaattgatgttggtgtttgtacaggcatttttgaacattaatcaaacaatgacgggaaatattgctacaagttatgaaattaagtagttgaggaatgatacaaccaaagtaagcaatagaaactctagtttttgtctagtgggggtgggggtttgg

SEQ ID NO: 409387 - DNA, 226 bp, Homo sapiens
ttaaaccggtggaaacctgcctgaatacttcacccaacccctccatcaccctctattatgcaagctgcaacatttcaagccaactcccttatttctctggtgagccctgtcaacactgaggtaatagaactggaaaaactcatcacttcaaaaggacagtcaaatatcagaatttatttcatttggtaaaaattctatcattgccaaataaagctaatgcaaatat

SEQ ID NO: 409388 - DNA, 215 bp, Homo sapiens
agcataacagatagcctagacactatggatggaagcttggaatatcatcggatagagtggcaccatcagaggaattcctgggaagtgaaggcatgagaatttgaacagaagagacaccctactacctgtacttcctacacaagacccagtgaccacaggctcccagagagaaaatatgatcccgtgaagaaagactccaagatttatctttccat

SEQ ID NO: 409389 - DNA, 320 bp, Homo sapiens
atgtggaccctgagaccagggaggttgcgtggcatcattacatcagaaggtggttgtgctcaccccgcatcaaggttgctaagctgctgtgatggaatcctggagctgctgaaggacacctcatctctttgtgggaagcatctgcttgaggattaagggaatgcagaaaaaaagtggagtagagagatggaggaagatgactttcgaggacattgtgtgagcacctggatctaactgtgcctgaagcaaaactcaaaccctggactctcaatgtattggctctcagttccaagacccaataaattccttcttagcttaga

SEQ ID NO: 409390 - DNA, 444 bp, Homo sapiens
ctgtactccagcctgagtgagtgaggctccatttcaaaaaaaaaaagaaaagaaacatttacgatctattctccctgaagtctgctacctggaggcttcatcttcatctgcatgacaaaacactggtctctgcaaccccttattgtaactcagactttcctttctattgataactctttcaaccaattgccaatcagaaaatctttgaatctgcctgtgacttcaaagccccacctccccaccgcaaccccttccgattgtcccacctttctggaccaaaccaatgtatatcttacatgtattgatgcctatgtcttcctaaaatgtataaaaccaagttgtggccctactacctcgggcacatgttctcaggacctcctgagagtggtgttacaggccattggtcactcatatttgcctcagaataaatttcttaaaacgtga

SEQ ID NO: 409391 - DNA, 1330 bp, Homo sapiens
tgcgtgcagacctcggaggaggagtgctcgtccacgctggcagtgtgggtgaagtggcccatccatcccagcgccccagagcttgcgggccacaagagacagtttggctctgtctgccaccaggatcccagggtgtgtgatgagccctcctccgaagaccctcatgagtggccagaagacatcaccaagtggccgatctgcaccaaaaacagcgctgggaaccacaccaaccatccccacatggactgtgtcatcacaggacggccctgctgcattggcaccaagggcaggtgtgagatcacctcccgggagtactgtgacttcatgaggggctacttccatgaggaggccacgctctgctctcaggtgcactgcatggatgatgtgtgtgggctcctgccttttctcaaccccgaggtgcctgaccagttctaccgcctgtggctatccctcttcctgcacgccgggatcttgcactgcctggtgtccatctgcttccagatgactgtcctgcgggacctggagaagctggcaggctggcaccgcatagccatcatctacctgctgagtggtgtcaccggcaacctggccagtgccatcttcctgccataccgagcagaggtgggtcctgctggctcccagttcggcatcctggcctgcctcttcgtggagctcttccagagctggcagatcctggcgcggccctggcgtgccttcttcaagctgctggctgtggtgctcttcctcttcacctttgggctgctgccgtggattgacaactttgcccacatctcagggttcatcagtggcctcttcctctccttcgccttcttgccctacatcagctttggcaagttcgacctgtaccggaaacgctgccagatcatcatctttcaggtggtcttcctgggcctcctggctggcctggtggtcctcttctacgtctatcctgtccgctgtgagtggtgtgagttcctcacctgcatccccttcactgacaagttctgtgagaagtacgaactggacgctcagctccactgagctggctgcgggctccagcggccgtgtgctccagcaggccagagccagacacgacctccctgagcctcacaggcttacaggagtcacctgctccatgtggggactggcctgtttcctgaacacagacctctttcttgtgccttgttcacttctgttgaacccctcgtactgccgggcatttattatactacttcctgtcataaccttctaacttgtttcttgacgaccacctcatgtggccaataaatggactgggagcgttttagctgccattaacttgaaaaaaaat

SEQ ID NO: 409392 - DNA, 454 bp, Homo sapiens
tgcgtgcagacctcggaggaggagtgctcgtccacgctggcagtgtgggtgaagtggcccatccatcccagcgccccagagcttgcgggccacaagagacagtttggctctgtctgccaccaggatcccagggtgtgtgatgagccctcctccgaagaccctcatgagtggccagaagacatcaccaagtggccggtgagctgcagtgggggggttgttagggagccctccgtgtcatgtgggagagaatgccacaccccacccactggtgataccagagattcccatcatgggaccacctcacgttttcagaggctgtgcacctgccctttgtacagcctgtccatcaaccagcgcctgcccctctgagcaagtagatcaagagaactagatggagacttgaaaggtcaagtgacattattccagtttgatagagactcagtgtggtggcctg

SEQ ID NO: 409393 - DNA, 518 bp, Homo sapiens
agttaatggcagctaaaacgctcccagtccatttattggccacatgaggtggtcgtcaagaaacaagttagaaggttatgacaggaagtagtataataaatgcctggctggcctggtggtcctcttctacgtctatcctgtccgctgtgagtggtgtgagttcctcacctgcatccccttcactgacaagttctgtgagaagtacgaactggacgctcagctccactgagctggctgcgggctccagcggccgtgtgctccagcaggccagagccagacacgacctccctgagcctcacaggcttacaggagtcacctgctccatgtggggactggcctgtttcctgaacacagacctctttcttgtgccttgttcacttctgttgaacccctcgtactgccgggcatttattatactacttcctgtcataaccttctaacttgtttcttgacgaccacctcatgtggccaataaatggactgggagcgttttagctgccattaacttgaaaaaaaat

SEQ ID NO: 409394 - DNA, 1451 bp, Homo sapiens
tgcgtgcagacctcggaggaggagtgctcgtccacgctggcagtgtgggtgaagtggcccatccatcccagcgccccagagcttgcgggccacaagagacagtttggctctgtctgccaccaggatcccagggtgtgtgatgagccctcctccgaagaccctcatgagtggccagaagacatcaccaagtggccgatctgcaccaaaaacagcgctgggaaccacaccaaccatccccacatggactgtgtcatcacaggacggccctgctgcattggcaccaagggcaggtgtgagatcacctcccgggagtactgtgacttcatgaggggctacttccatgaggaggccacgctctgctctcaggtgcactgcatggatgatgtgtgtgggctcctgccttttctcaaccccgaggtgcctgaccagttctaccgcctgtggctatccctcttcctgcacgccgggcaagtgacactgtgggccgggtcgggggtctcagggccctcaggattggctggctgggggtggcagaaaggtcacttccctgctgaatgtctcccgacccccgcctgctactgactacaggatcttgcactgcctggtgtccatctgcttccagatgactgtcctgcgggacctggagaagctggcaggctggcaccgcatagccatcatctacctgctgagtggtgtcaccggcaacctggccagtgccatcttcctgccataccgagcagaggtgggtcctgctggctcccagttcggcatcctggcctgcctcttcgtggagctcttccagagctggcagatcctggcgcggccctggcgtgccttcttcaagctgctggctgtggtgctcttcctcttcacctttgggctgctgccgtggattgacaactttgcccacatctcagggttcatcagtggcctcttcctctccttcgccttcttgccctacatcagctttggcaagttcgacctgtaccggaaacgctgccagatcatcatctttcaggtggtcttcctgggcctcctggctggcctggtggtcctcttctacgtctatcctgtccgctgtgagtggtgtgagttcctcacctgcatccccttcactgacaagttctgtgagaagtacgaactggacgctcagctccactgagctggctgcgggctccagcggccgtgtgctccagcaggccagagccagacacgacctccctgagcctcacaggcttacaggagtcacctgctccatgtggggactggcctgtttcctgaacacagacctctttcttgtgccttgttcacttctgttgaacccctcgtactgccgggcatttattatactacttcctgtcataaccttctaacttgtttcttgacgaccacctcatgtggccaataaatggactgggagcgttttagctgccattaacttgaaaaaaaat

SEQ ID NO: 409395 - DNA, 1254 bp, Homo sapiens
  misc_feature (35)..(35): n is a, c, g, or t
  misc_feature (56)..(56): n is a, c, g, or t
agcgtcatcgtatgcgtagagaggtttggggaatntgagggcatgtgcggtttgtnttctaggcgtaggatgagggttagccgcgcaggtgcggtgaagggaggatggcggagttggtaccttttgcggttcccatcgagagtgacaaaaccttgctagtgtgggagctgagctccggacccacggccgaggctttgcatgtgagccggggccaggatggagggagggatggagaaagctgcccacccgctgactgggagttccggagtcctgcctcagaccctcacctgcctgagcctccgctgaaggactcttaattataaaggggatcccaactgacaactgacgacccccaacagatttttagagtcccggagaggtatctctccaccttcagaacgttttaccttccagtgcttcttaaagtttaggattttaagaggaaaacctgttgattaagtgggaagtgttttgaatcgcatccttcgcgaagagaggtttggggaatatgagggcatgtgcggttttgttttctgggcgtgagatttcatgcatttacttgtcccacccccacagcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaagcttcaggagctttctgaccttgaagaaagggaaaatgaagatagcatggtgccacttccgaagcaaagcctgaagttcttctgtgctttagaagtggtgttgccatcctgtgattgcaggagtcctggcattggcttggtggaggagcctatggataaggtggaggaaggaccattatcattccttatgaaaaggaagacagcccagaagcttgctattcagaaggctttgtcagatgcattccagaaactgttgattgttgttctaggtaagactgtcttgatcatccttgaagtacttcagtttcagtaagcaaataaactcattttgaaaagttaattgaataaaaatattgatatctaaagcaaaaaaaaa

SEQ ID NO: 409396 - DNA, 878 bp, Homo sapiens
  misc_feature (35)..(35): n is a, c, g, or t
  misc_feature (56)..(56): n is a, c, g, or t
agcgtcatcgtatgcgtagagaggtttggggaatntgagggcatgtgcggtttgtnttctaggcgtaggatgagggttagccgcgcaggtgcggtgaagggaggatggcggagttggtaccttttgcggttcccatcgagagtgacaaaaccttgctagtgtgggagctgagctccggacccacggccgaggctttgcatcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaagcttcaggagctttctgaccttgaagaaagggaaaatgaagatagcatggtgccacttccgaagcaaagcctgaagttcttctgtgctttagaagtggtgttgccatcctgtgattgcaggagtcctggcattggcttggtggaggagcctatggataaggtggaggaaggaccattatcattccttatgaaaaggaagacagcccagaagcttgctattcagaaggctttgtcagatgcattccagaaactgttgattgttgttctaggtaagactgtcttgatcatccttgaagtacttcagtttcagtaagcaaataaactcattttgaaaagttaattgaataaaaatattgatatctaaagcaaaaaaaaa

SEQ ID NO: 409397 - DNA, 1085 bp, Homo sapiens
  misc_feature (35)..(35): n is a, c, g, or t
  misc_feature (56)..(56): n is a, c, g, or t
agcgtcatcgtatgcgtagagaggtttggggaatntgagggcatgtgcggtttgtnttctaggcgtaggatgagggttagccgcgcaggtgcggtgaagggaggatggcggagttggtaccttttgcggttcccatcgagagtgacaaaaccttgctagtgtgggagctgagctccggacccacggccgaggctttgcatgtgagccggggccaggatggagggagggatggagaaagctgcccacccgctgactgggagttccggagtcctgcctcagaccctcacctgcctgagcctccgctgaaggactcttaattataaaggggatcccaactgacaactgacgacccccaacagatttttagagtcccggagaggtatctctccaccttcagaacgttttaccttccagtgcttcttaaagtttaggattttaagaggaaaacctgttgattaagtgggaagtgttttgaatcgcatccttcgcgaagagaggtttggggaatatgagggcatgtgcggttttgttttctgggcgtgagatttcatgcatttacttgtcccacccccacagcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaaggaccattatcattccttatgaaaaggaagacagcccagaagcttgctattcagaaggctttgtcagatgcattccagaaactgttgattgttgttctaggtaagactgtcttgatcatccttgaagtacttcagtttcagtaagcaaataaactcattttgaaaagttaattgaataaaaatattgatatctaaagcaaaaaaaaa

SEQ ID NO: 409398 - DNA, 183 bp, Homo sapiens
agtaactttcagtgttaggtatttgaaataatgcagcctgtcatatgtactctggttaccagaatgaaaaaacaaaaagagatacatacatagtaaggaaacatgaaattggaggaattgatccccatgtgtattgcagcttcatataccagtagtctctaataagtcattgctttaataaaa

SEQ ID NO: 409399 - DNA, 370 bp, Homo sapiens
caaacattgtggaagagatttcagtttgagggctagtgtctgaattatggactccttaccctactccaccacttaaaacattttagagacttttgtgaaattaacaggtcatataattaataattgttgttttatgtacatttattgaaaggccatattgaggctccattgattttttttcctgcatatttatcagtatcgaattagaaaattgaaccttcagtgttactagatggaaatctaccaaaaagtagcaaggtttacgaatggtgggatttattggtgattaaacatttttttcctgtattttataagtttcacattacatttacaatgagaaaaaaatgtaaatgtagaattaaagtcttgt

SEQ ID NO: 409400 - DNA, 387 bp, Homo sapiens
ggttaatactaagcaaccctctacatctacattatctctgcagttttcatacctggaaaataatatgagattttcatgctgttttcttattatcatgccttaaattccatattattgtggtttgagcgttcaggtttgatcctgtagattgatattcaattatgttgttaactactgtgatacattttccaagccagtttacctctccaaattttaatgtaccctacagtattaatttggaagggttcagatgctcagcaaaaaactgccttatagaaaaagtggacaataatcttatctgtatctatgttagacacacataccaacatctctaataatataataccaatctacagagaatttattttccaaggatgagtagcgtat

SEQ ID NO: 409401 - DNA, 494 bp, Homo sapiens
tggcccaggtcccagtaactccattgtcagaaacagaccccatcccttctagtggtgctgctgccttttggacacagaatccagctcacagtcccctgtgtggtccccttttggccatcctgtggcttgggtagtaagaggtaagcatttggctgaggcaagttgttcattcagaataaattcacagctgcttaaattttgtcaacaggccgagcgtgttggctcatgcctgtaatcccagcactttggaaggccgaggcaggcggatcacgaggtcaggagttcaagaccagcctaaccaacatagtgaaaccccatctctactaaaaatacaaaaattagcagggtgtggtggcgcacgcctgtaattccagctactcgggagactgggacaggagaatcgcttgaacccgggaggcggaggttgcagtgagccgagatcgcacggctgcactccagcctgggcaacagggcaagactccaactcaaaaaaa

SEQ ID NO: 409402 - DNA, 298 bp, Homo sapiens
aaaaaactaaaaaataaaaaactctaaagctatcatcatacttgatgagagactagacgctttcaccctaagattagaacaaaggaaatgtatcccctctccccactactattcagcattgtattggaagttttagctagaagaataagataagaagaggaagtaaaggtgtattgattaacaaaagcaaaacacttgtctctttacagatgacatgattgtctatgtagaaaatcccagagtcttgacaaaagtacttctggaactgttaagtgattacagtaaggatgcagattac

SEQ ID NO: 409403 - DNA, 290 bp, Homo sapiens
gagtatgctgtttgctcaggtctctcttcttcctataaaaccaccacttctgctcccatgataacacagtccattaatctgtgcatggattgattcattcatgacagcagagctctcatgatccaatgacctcttaaaggccccacttctcaatatggccacaccggggatcaagtttccaaatgagttttgttggggatattcaaaccagaggagtattgtattttattttcaatttccatgtattaattgctagtatatagaaataaagtagtttttgtatgttaatt

SEQ ID NO: 409404 - DNA, 692 bp, Homo sapiens
ctccaaaaaaaaaaaaaaaaaaggatttcagattttcaaattagaggtgatcaagctgtaataataactacaataagagatgctagatattgaatatttactgtgcgaaatcctgctttctcttcaagacccattttgtctaggaagccttctctgactccatggactaagtgttgcatccttttattccccaccccttatagctctctggttttctttgtatcacagcacttgtcacactccaagagtcttactatcatttccctcctcaactggtaataagtgcctgggggggtcaggaatgatgatttatttatccttgcatccctagggaatagcacagtgcctggctcctaacaggctatcatgctataaatgcttacaaaagaaatgaatgaacgatacctggagccatagtggagctggctagcctcctgaggcctataggaactgaaaggaaaagctgagtcctggcataatatcaaggtttggatgaaaggcccatcactctgaatcattctagcacaaattataggctttaaaaatggtttgtgaatgttaacggttttgagtttactgcactgtaagatatcttaaatttcgctcccttccctgggcccctactctttctgattgtatgttggtttgttcactcaagtgaggaagaaaggcagtttgaaaataaaccacaa

SEQ ID NO: 409405 - DNA, 93 bp, Homo sapiens
ggggcccctaggaatgcgtagaagtgtgctgaggggcggtgcccaacctggcagctggaagcatcaccagctcccattcccacaagtgagcgg

SEQ ID NO: 409406 - DNA, 448 bp, Homo sapiens
caggtgactccagccagcctcaccccaaagctccccattgcacagatgagccttctctcccatcatccacccaccagccccctgtccagccccactttcttcaattcattgatcgcagcacagcatagggaagaacatgatttattgaatcttttccatcctaaagtattaattatcaatagctgcaatataccctgacttcataggaaaacctgcacctcattctaatcaccttgttctgagcgtctcactttccttcttaggtcttgaccttaagatttcaactttactttctagccgctgcctgatcaacgtggagtgaagtgaaatgatttccccctgtatttggaagctgtacttctaaaactctgtcctagaatcacatcactctcttttaccaaccagattattgcattgcattggctcactagtaatgtatttctaccaa

SEQ ID NO: 409407 - DNA, 3238 bp, Homo sapiens
  misc_feature (872)..(872): n is a, c, g, or t
aggatggacgtggtagaggtcgcgggtagttggtgggcacaagagcgagaggacatcattatgaaatacgaaaagatcatgaaggagaagggcaagaggtcatctgaacacatccagcagatggacctggacgtaagcgggacattaaggaggcatatattcttcagggatcgatacggaaccaagagacagcaatcaaatatatgactgatggatgtttactgaaacatattctgggagacccaagtcttaccaaattcagagtcattattttggatgaagcccatgaaagaactctaactacagatatcttatttggtctattgaagaagctatttcaggagaagtctgctaataggaaggagcatttaaaagtggtgattgtgaaagtcaccatggatatccatttgaatgaaatggctggagacatcttggtttttctgactgatcaacagaggaggatatttttgccaccaccacctggaattagaaaatgtgtcatatccaccaatatttctgcaacgtctttgacaatagatggaatcagatatgtggtagatggtggctttgtgaagcagttaaatcacaaccccagattagggttggacatcctggaggtggttccaatttcaaagagcgaggcattacagcgaagtggccgagctggcaggacttcttcaggaaaatgctttcggatctatagtaaagatttttggaaccagtgtatgcctgaccatgtgatccctgaaattaagagaactagtttgacatctgtagttctgaccttaaagtgccttgccatacacgatgtcataaggtttccctatttggatccacctaatgagagacttattttagaagctcttaaacanctttaccagtgtgatgctattgacaggagtggccatgtcaccagattgggtttgtctatggtggagtttcctttgcctccacatctgacatgtgcagtaataaaagctgcttccctggattgtgaagatttactacttccaatagcagcaatgttgtctgtggaaaacgtcttcattagacctgttgatccagagtaccagaaggaagcagaacagagacatcgagaattggcagctaaagctggaggatttaatgactttgcaactttagctgtcatctttgaacaatgcaaatcaagtggagctccagcttcatggtgccaaaaacactggattcattggaggtgcttattttctgcatttcgtgtggaagctcaacttcgagaactaatcaggaagcttaaacagcaaagtgatttcccaaaagagacctttgaaggccctaaacatgaagtactacgaagatgtctttgtgcgggctatttcaaaaatgtagctcgaagatctgttgggagaacgttttgcacaatggatggtcgtggaagcccagttcacattcatccttcctcagcacttcatgaacaggaaaccaaacttgaatggatcatttttcatggggtattggttaccaccaaagtctacgcaagaattgtatgcccaatccgttatgaatgggtaagagacttgttacccaagttgcatgaatttaatgcacatgatttgagcagtgtggcccgacgtgaagtgatgaagatctactacttccaatagcagcaatgttgtttgtggaaaacgtcttcattagacctgttgatccagagtaccagaaggaagcagaacagagacatcgagaattggcagctaaagctggaggatttaatgactttgcaactttagctgtcatctttgaacaatgcaaatcaagtggagctccagcttcatggtgccaaaaacactggattcattggaggtgcttattttctgcatttcgtgtgagaagatgcaagaaggagatggacaaataaggaaaatgtaaagcagctaaaggatggaatatcgaaagacgtcttaaagaaaatgcaaagaagaaatgatgacaaatccatatttgatgcacgggctcgtttccttgagagaaagcagcagaggacccaggaccacagtgacacacgaaaggaaacaggctaaggtggtgaaccctccaattcaggaagtgggaaaaggagccaggaaatgtgcttctactttgccagttatttcagacagcactaccaagaggaggtggtcagcacttgttattggcctatgaactaaaagcaaatcaaagctcataaatcaaagctcatcagttcccataaatgcagttgtcaaagaaaagatttggttgccatagtcataagcaatgatacatgaaaccaatgaaagacagtacatgtaataatattttcctcagtacaattttgctggccttaactggtatcaaacgctgtcattgagatgttttcaaagaacattgagttgtatttaatcagcgtgtactccatttgcattgaagcattaaaaattatttttcttaaaatctctttaaggccttcttgttgctgttagaatagtgctatatatcaggtatgtgaccatttatttcagaaggctgaacataagaggtttctactcagcaatacttagatgtctaactgtttaattgctacagagctttatagatatttagagaaaagacttaatcaattagtaaataaaattgcctatgcaggattctttcttgaattaatattaatccttaaattgatttttctgggattatacaaattcctctttatataaaagtatattgtttaaaacagtagctatagccattaaccaaaggacagatgatatatatatatatgatatatatatatatataagttcttttttagctgtacctacgtacttatatcagcaccatgtatgtaggtgtgatagtactttcaaacagcgcctccacctggcctactctgttatttccacctgtttgggtagggccatttaacttccattatgccaaacttgggatgggattttcgaagcagacaacactatttcatcgtgtttcaaattggaaccttgaggctagttagtatcacactcaggccacactcagcacttgcccactcttgtttactgccttgtattctagttatttgtgtatttgtctccctcactagattatacgctccttgtgggcagggactgtgtcttttttcatctttgtatctttcatgcacctagcatagtgctttgcacatagtagtcactcagtgtttgttaaataaagctattagtgtcattaaaattcaaaagacagt

SEQ ID NO: 409408 - DNA, 1520 bp, Homo sapiens
  misc_feature (872)..(872): n is a, c, g, or t
aggatggacgtggtagaggtcgcgggtagttggtgggcacaagagcgagaggacatcattatgaaatacgaaaagatcatgaaggagaagggcaagaggtcatctgaacacatccagcagatggacctggacgtaagcgggacattaaggaggcatatattcttcagggatcgatacggaaccaagagacagcaatcaaatatatgactgatggatgtttactgaaacatattctgggagacccaagtcttaccaaattcagagtcattattttggatgaagcccatgaaagaactctaactacagatatcttatttggtctattgaagaagctatttcaggagaagtctgctaataggaaggagcatttaaaagtggtgattgtgaaagtcaccatggatatccatttgaatgaaatggctggagacatcttggtttttctgactgatcaacagaggaggatatttttgccaccaccacctggaattagaaaatgtgtcatatccaccaatatttctgcaacgtctttgacaatagatggaatcagatatgtggtagatggtggctttgtgaagcagttaaatcacaaccccagattagggttggacatcctggaggtggttccaatttcaaagagcgaggcattacagcgaagtggccgagctggcaggacttcttcaggaaaatgctttcggatctatagtaaagatttttggaaccagtgtatgcctgaccatgtgatccctgaaattaagagaactagtttgacatctgtagttctgaccttaaagtgccttgccatacacgatgtcataaggtttccctatttggatccacctaatgagagacttattttagaagctcttaaacanctttaccagtgtgatgctattgacaggagtggccatgtcaccagattgggtttgtctatggtggagtttcctttgcctccacatctgacatgtgcagtaataaaagctgcttccctggattgtgaagatttactacttccaatagcagcaatgttgtctgtggaaaacgtcttcattagacctgttgatccagagtaccagaaggaagcagaacagagacatcgagaattggcagctaaagctggaggatttaatgactttgcaactttagctgtcatctttgaacaatgcaaatcaagtggagctccagcttcatggtgccaaaaacactggattcattggaggtgcttattttctgcatttcgtgtggaagctcaacttcgagaactaatcaggaagcttaaacagtggcttccggaagttcctggtccacaacgtcaaggagctggaagtgctgctgatgtgcaacaaatcttactgtgccgagatcactcaccatgtttcctccaagaaccgcaaagccatcgtggaaagagctgcccaactggccatcaaagtcaccaaccccaatgccaggctgcgcagcaaagaaaatgagtagacagctcgtgtgcatgttttctgtttaaataaaagtaaaaactgcca

SEQ ID NO: 409409 - DNA, 105 bp, Homo sapiens
gtacaagtcggtctgcttcttggagggaggcctcttccagtgtgccctggtcaaagggtcctgggctccctaggagcacagggcagggacgggtggccaatgccc

SEQ ID NO: 409410 - DNA, 473 bp, Homo sapiens
tctgaccaacacagcaaaaccccgtctctactaaaaatgcaaaacttagccaggagtggtggcacatgcctgtaatcccagctacttgggaagctgagtcaggaaaatcacttgaacccaggaggcagaggttgcagtgagccaaaatcacaccactgcactccagcctgggtcacaaagtaagactccgttgcaaaaatataaaaataaaaacaaagcacatgttgcccagtggcttccggaagttcctggtccacaacgtcaaggagctggaagtgctgctgatgtgcaacaaatcttactgtgccgagatcactcaccatgtttcctccaagaaccgcaaagccatcgtggaaagagctgcccaactggccatcaaagtcaccaaccccaatgccaggctgcgcagcaaagaaaatgagtagacagctcgtgtgcatgttttctgtttaaataaaagtaaaaactgccaa

SEQ ID NO: 409411 - DNA, 434 bp, Homo sapiens
caagtcttcttttattttccagaaacttaacttgctttgattcttcttagatatgtggtagatggtggctttgtgaagcagttaaatcacaaccccagattagggttggacatcctggaggtggttccaatttcaaagtaagtctctatgtcaaatctttttattcaaagaacaactgattaggtaatttctagctgttttggggagacaaagtaaattacctgagaaacccacagaacattttggggaatttttgggtttttttccttttgtaggagcgaggcattacagcgaagtggccgagctggcaggacttcttcaggaaaatgctttcggatctatagtaaagatttttggaaccagtgtatgcctgaccatgtgatccctgaaattaagagaactagtttgacatctgtagttctgaccttaaagtg

SEQ ID NO: 409412 - DNA, 312 bp, Homo sapiens
ttcccagctggggagggagggagtgtcaggggctcccctggtgagagatggatcttggaagggataatagctacaattcaaggtagaagtttgcgaatgctaaataggatggtagaggaagcttgaagaacttggacgtctgatcgttggaaagaaacgtgtcttctgtagttctgcgtttagatgccagagaactgagttccagcttggtggcagtgtgacgttgggctacttcgtgaacagtgatgaacctgtttcctggttttaaaagagaatgattattataaggattaaagtctgtcaagtgcttgt

SEQ ID NO: 409413 - DNA, 1466 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (7)..(9): n is a, c, g, or t
nantncnnnatgcactcaagcagagaagaaatccacaagtactcaccagcctcctggtctgcagagaagacagaatcaatatgagcacagcaggaaaagtaatcaaatgcaaagcagctgtgctatgggagttaaagaaacccttttccattgaggaggtagaggttgcacctcctaaggctcatgaagttcgcattaagatggtggctgcaggaatctgtcgttcagatgagcatgtggttagtggcaacctggtgaccccccttcctgtgattttaggccatgaggcagccggcatcgtggaaagtgttggagaaggggtgactacagtcaaaccaggtgataaagtcatcccgctctttactcctcagtgtggaaaatgcagaatttgtaaaaacccagaaagcaactactgcttgaaaaatgatctaggcaatcctcgggggaccctgcaggatggcaccaggaggttcacctgcagcgggaagcccatccaccacttcgtcggcgtcagcaccttctcccagtacacagtggtggatgagaatgcagtggccaaaattgatgcagcctcgcccctggagaaagtctgcctcattggctgtggattttcgactggttatgggtctgcagtcaaagttgccaaggtcaccccagggtctacctgtgctgtgtttggcctgggaggggtcggcctatctgttgttatgggctgtaaagcagctggagcagccagaatcattgctgtggacatcaacaaggacaaatttgcaaaggctaaagagttgggtgccactgaatgcatcaaccctcaagactacaagaaacccattcaggaagtgctaaaggaaatgactgatggaggtgtggatttttcgtttgaagtcatcggtcggcttgacaccatgatggcttccctgttatgttgtcatgaggcatgtggcacaagtgtcattgtaggggtacctcctgattcccagaacctctcaataaaccctatgctgctactgactggacgcacgtggaaaggagctatttttggaggctttaagagtaaagaatctgtccccaaacttgtggctgactttatggctaagaagttttcactggatgcattaataacaaatattttaccttttgaaaaaataaatgaaggatttgacctgcttcgctctggaaagagtatccgtaccgtcctgacgttttgaaacaatacagatgccttcccttgtagcagttttcagcctcctctaccctacatgatctggagcaacagctaggaaatatcattaattctgctcttcagagatgttaaaaataaattacacgtgggagctttccaaagaaatggaaattgatgggaaattatttgtcaagcaaatgtttaaaatccaaatgagaactaaataaagtgttgaacatcaactggggaattgaagccaataaaccttccttcttaaccattc

SEQ ID NO: 409414 - DNA, 463 bp, Homo sapiens
accaaaaaacatgaacttcccttcacttgacttgacccaaatgcatagggatgggaatggagtggctgagaacacagagagattttcactaagtcacctcaaatgctccttggactatcacatggaagcatgtgggttgtctaaatgttaacacaatgtctcttctttcctattgcagtatccgtaccgtcctgacgttttgaaacaatacagatgccttcccttgtagcagttttcagcctcctctaccctacatgatctggagcaacagctaggaaatatcattaattctgctcttcagagatgttaaaaataaattacacgtgggagctttccaaagaaatggaaattgatgggaaattatttgtcaagcaaatgtttaaaatccaaatgagaactaaataaagtgttgaacatcaactggggaattgaagccaataaaccttccttcttaaccattcaa

SEQ ID NO: 409415 - DNA, 867 bp, Homo sapiens
ccctagattctaatgttataaacgtcaaacatcactgcccaacataaataagactcgagacttattaacataaataagtatcttgccttcttgaatgctagttaaatgcttagatttacctaactgcctaatgaatcaggttatttgttaataagattatttttcaaattatttaagacctttatgccccttccaattacttgtgatttgtaggcctgtaggattgttgcatctaatctgactggcaacagaaaatgtcatcaaatactataatatccattttgttttcttttgcactaatacaacagaacatatcatttttgttttaaacaatggttaatatattaatagggtttgttccacacttactatttatagtttttataatcaagcattgggtattaaaagagaatcctttcaacccttcatcttcgtatgcttatacaataaattgcagtgagtgttttctttgtgcttggattgatactagacacctcaagaaagtcacataaccctcaagaagtttcaacccagggaataagtttggcacctcccatgagaaaacagtttcaacggtgaacctgccagtatttacttccttatttaagattgcttttagagtttgtttaaaatagaagaagttgtggagaggggatactattgtaatgcagccctaacatggagggtgggtgttgcaaaaactgtcattggtgactaaatcttctacatacattgcaaaattctcagtggacaatgactgccccttttaaaacactgtaactcaaaatatcatatttatgaccaaatttttatgaagacaatagacaatctggaaatgaaataaagccgcagcggagccccacctgg

SEQ ID NO: 409416 - DNA, 403 bp, Homo sapiens
tgaaaaaaggaaaagatatttagattggggagaaaacaaacttcacatcaagtcctgtatttcctttaaaatgtaatacagatgaaggaaatatccatttttaggctcagggcagcagaaagtaaggaagtcctcactttaataggattctcacccaccccaaggtgtcttgcgcgtctttgacagtttacagcaatggtttctatttaaacagccttttctctgatcctgcattcagacacgcccactctaagaatctttccctttgcaccagtttgttgatgggagtggattcattgctcacatgtgtcgccatgcaaatcacttacaaactcttggatttcagagtatttttctaatgtttttaactcatacccccttctgatagacaaacaaataaata

SEQ ID NO: 409417 - DNA, 300 bp, Homo sapiens
atcctccactttcctgctagcaccttgctgcctgtaaggtagagaggtctgagcatgaaaatcctccaggtatccctggctgccctcacttgctgctggtcatcaccttccgtgtcacatttctgctcaaaacagtcaatattcagctgctgtccctggagtggctgccattgcaacacaggaatgtccctcttgtttaatgttttatgatgaaatgttggggctttaaagagttgaaaagctaagagccgtagtaaattagccatcctggaaaatagaaatgaagcctcaggtataatc

SEQ ID NO: 409418 - DNA, 410 bp, Homo sapiens
atcataaatcacatggtacatttcctaggtccttttaagactctaatgattaaccccatcctcactcccactgtaaaactcttaaaagagttttcaaattataccacaattactattaaatacctatacgtaggcaggcccatctctgtctcagaattttttttgagtatcaggataatagttattgatcaaaaggaggcctggggtccaaaatggaggacaattggaaaaacagcagaccagtatttcagcaaaaggtgcaaaacagaatggaagcactgtactaataggtagtggggtgactatgcatggtgtctcatcccagcactttgggaggcctaggcgggaggatcacttgagtccaggagtttgagaccagcctgggcaacaaaacaacaccccatctctat

SEQ ID NO: 409419 - DNA, 405 bp, Homo sapiens
tgaggcaaggtctcactctgttgcccaggcttgagtgcagtgacgcagtcatgggtaactgtagctctacttttcaggcccaagtgatcctcccacctcaggttcctgagtagctgagactacagaggtacaccactgtgcctagctaatttttaagattttttgagatggctagtaatttaatttttatttttgtagagacagagtctccgtatgttgcccaagctggtctcaaactccttggcccaagcaatcctactgccttggctgcccaaagtgcttggattacaggcacgaagcaccctgcctggcctgccaaaacaattttaactaaatgctattttatagctttcaaatccatttggaagaaaatattgggacttttaaagatgttaattgttgggt

SEQ ID NO: 409420 - DNA, 482 bp, Homo sapiens
caatttctttgcacctcagagctttcataattttgtgacttttctatcatgttcttatcttactccagctaccacgctgtcatgttttttaggttaaggtgtactttttactcctgttttggcttttcaagctatgtcatacctgcctcccagaggtacttggaaaatattggcttgacagcacatgcttatcccaaggcggaattcatctctacagtcttcacatgccccactccagccgtgtggtagcacgccttgcttgtgaccctgggatagagatggggatgttaagtaggttcctctcaaccccagcactaatttgagaggaaaaactattaaggataccgttcctttctcccttcctgtacttaaattgatgttgaaggaaattactagaatattttctccccaaaattttaaaacacaaatgctaaaaaatgtcagtctcttcattctcctgacctcagtgttttcacaggtaa

SEQ ID NO: 409421 - DNA, 253 bp, Homo sapiens
atctttttaccttttgtctgactcagaaaacatatggattaaaatagtttctcttcatgaaaataactgcataaatgggccatcttcaacttaagatagtttttaaaaaatcaaaacttcacttccaatttaattttttgaaatcaagaatgtatttcccatagaaataataatgcaaatggtaggaaatcccttccaagctaactcatgaagacattcttaaccaataaatgactgaaataatgaaaactca

SEQ ID NO: 409422 - DNA, 217 bp, Homo sapiens
cttactgcctaactcctcggaaccctcggaggttgcgcataaacaattttttcttccagaacggcccccctctccgccctgggggagccgggaggatgtgcagccccagtcctcctgctcggcggagcctcgcgcgcgcagagcctagcgcgattcgcgccctcattactactacaaagcgcgggccagaccaatcccctttctaatgcaccatttt

SEQ ID NO: 409423 - DNA, 917 bp, Homo sapiens
aatgatgacaagagtaataccttcctagtgaagatgacttttatttcaggactatattaagtttcccaacttctgtcatgatatagtccaaagagaacctggaccacgcagacatcaaacagaacatgacgctgacccattctatcagtgacgttgtgctgattgcacaggacagatgagaggctcgtatactagaagtcttgataacttgttttctagtttcacatgtccacagatgaagaaaaattgtgccccagcaaggattatacccagagcctcatccattcatacctgatttagatacttagatgatgagtaatagaaaaggtggttatcaaacctgggtcaaagttgaatcacctgaggatcttttagaacatacacagccagctggacctgccctcagctacctcatctctctctgtgacctaatgacagaaaagcacatgattctcttcacctgacttcatatatgggtccatgtcatatgatacttcaaaatctgtgattccatgaagccaagagtagctcttcaacaggaaatgaatgagtgcttcagcttctgatcccattagtaagaaaatacagtcttatgagcaatgatggagctgcatctcttaggggcatttgattcccaagagaccaaagagcaaagagaatgtcaatttaaaaaaatcaaatgtttccatgacttagctatttaactgctttaaaatgaatgaatgctgcttcaagttctttcaaataccccacatcttggcaacaacgaaaggaattaacatgaagaaaatttacaatctttcatcacatcgaacaatgtcccacatttgaaaagttcacagcacagatttctggttactgaaagaaaggaaagaccttctttggatttgaataaacagatggactttcttctcctt

SEQ ID NO: 409424 - DNA, 722 bp, Homo sapiens
ttgttatagtaaccacacagacgcacgcagcttcgcgtgtgtgccgaggaattcacgggcagtacataaactggactccctgcttcattcggagtaacaaaaacacatacagaatttaatctacggccccacctgcaatttctgcaagatcggcttgacttcttcctcttcatcagccatcatctcccggccactccacccccaactttataaccacagagacgcacgccctctctcaccgcggaaccacagcgacatctggcgttctggaggcttttctgccccagaagggctttgcttcaaaccgacttaaccatttatttccacagagatgctctacaatcacttacaacatccagaaggatatataagaaaggatgactgtctctgcagagggaaacacagaaactggggaactgtgggtgagcgaagaaaattttcactgcctgcccttttgaattttcttgccatctatatgtatcacctattcaaatataaacatttttaaataaaaaattatttgcttctacatagtctctggaaagagacacaagacactggcaagactatcgcttacaaagagcagaagtgagtggctggagcaaaaatgagtgaccagggaactggggtagacttttcactctatgccttttttgtaactttaaagtttgtaccttgtgaatatattaaacttctgaataaatcttttaaagtgtcatgta

SEQ ID NO: 409425 - DNA, 399 bp, Homo sapiens
gttatttattggatgtgataccaaaggcacagacagcaaaaggaaaaatgataaattggactacatgaaaattttaaaatattttgcatcattcaacagagtgaaagaatcattcaacagagtgaaaatgtaatccacagaatgggagaatatatttgcaaattatttatttgataagggatagatatctagaatatatagagaattcataaaacttaacaataaaacaacctcattcaaaaatggacaaaagacttgagtacacatttctccagtaagatatacaaatggccaagaagcacatgaaaatatactcagcatcactaatcatgaggaaaatgcaaatcaaaaccacaatgagataccacctcacatccatgaggatagccactatacaaa

SEQ ID NO: 409426 - DNA, 370 bp, Homo sapiens
gatctccatgacctctatggttccttagactgcactttgagaactattgacgtacagggaaaaatgctcttggtgttccagttaagcacagaataaaatctggactgtgtcagtttgtaaagatcttatgtctacttggtcatcagccaagaagggattccgaagatagaagaggaggcatcaacaccgtgaacatcatggctgagttattttgtgagagggataagcctaaagtaaaaaccttggatttgcctctgtccttgaacatgctatctggaaagagttttcttaaaagtattgttgtgaacacatccattttcccagtatagttgaatgcagggtttaataaatggaatgaatctagttttag

SEQ ID NO: 409427 - DNA, 284 bp, Homo sapiens
ctaatttaccagcttctcttgcatctgggtttgtccaaagtttggggccaatgagatgtgaatggaagttgcatgtattatttctagtttgtgccctaaaaaagaatatgtatgtgttacccttgccctcttatcctctccactggctggggtgcagatgtgatggcaggaattggggcaactactttggacccagaggcagaagccctgtgatgaggatggcagaactgctctattagccctggactgttacatgaaagataaataaacttgtatcttattca

SEQ ID NO: 409428 - DNA, 1079 bp, Homo sapiens
ggcggcacgaggggggtctgggcgcctggaggaagccagagctttggcgcaagcggcctgcgcgctgtgccaggaaagcgcttggagaaaatgtccggccccgcgacctgggacaggaagtgatggagcacggacttagtttgcctttcagttcttgtataaatagttttgagggttgtctctgaattttcactcagttgtctaccaagatgttgaatggacccagagccaaggacgtggtcttttatcagtggcacctgagactttcttccctgtggacgcaaatccattattcagcactctgggcacagctacagatctgatcagctatccattctccaaactatctcatcctctgtcccatttttctgtctctcttgtccacaaggcatatacctgagagttttcaaattcctcagagaaatttagatattctgtggctttggcattcacctaatgtgttaatctacaaaccttttttacagtgtggattttttttcatgatgtgaattcaagtggtttctaatggtctcttcataaagttgtaaaccaaaagtaaaattctaaggccccaccccatctgaatggaccccttctctgggccagggcactccaaattaacctgaaaaccgttcaggccacgacatgaagtgggggcgggtgggacatggctgactatgccctcctcccttttggaattcagggaaagccaacacagaccttaagtctaatgagaaacaccatctattctctctgaagcctgctaccccaaggcttcttctgctgataaaactttggtctccacaacctcttataacccagacattcctttctattggtaataactctcaactaattgccaatcagaacatttttaaatctacctataacccagaagcccccactttgagttgtcctgcctttctggactgaaccaatgtatatcttgaatagatttgattgatgtctcacgaccctctaaaatgcataaaaccaagttgcaccccagccacctcctgaggtctgtgtcatgggcgtggccactctatttggctcagaataaatctcttcaagtattt

SEQ ID NO: 409429 - DNA, 544 bp, Homo sapiens
tttaaattgaatccaaattttattaaggagttcaagttacatacttcaaatttctagaatggaatggaatcattttggaactggaaaaatggcaaaaacactgacatcccttaaaacttcaattttataaagaaaattcttctgcaaatcaactcagaatttcatatccagccaaataagtttcacaagtaaaggagaaataaaatcctttacagacaagcaaatgctgagggattttgttaccaccaggcctgccttacaagagctcctgaaggaagcactaaataaggaaagaaaaaactggtaccagccactgcaaaaacacaccaaaaaataaagaccattgacactatgaagaaactgcatcaactaatgtgcaaaataaccagctagcatcatgatgacacataacaatattaaccttaaatgtaaatgggcaaaatgcccaattaaaagacacagactggcaatttggataacgagtcaagacctattggtgtgctgtattcaggagacccatttcatgtgcaaagacacacatagg

SEQ ID NO: 409430 - DNA, 1030 bp, Homo sapiens
ccgagcaaggcttggggcacagaaggagccgcctgagtcttggccattgtctcactcttgctgcccgaggtcacaccagtagtagatgtcagagcaggaccggacccagatctgtccagggctgggctcggcgcctttcctttctgcccaggtgtgctggagggagatttccataggctgggtacaagatagacatatcaggggataaagaagactcctcgcctggtgtcagagatattcctgaggcctcccgaggctgggccaaccattgctgcattccagacccagcccacagcatcaccctggacatgctggcctcgccctgcttgtgccctcaactctcccctcctggcctccacctccccagatattgaagtccagccacaggtgctagagtgcctgggaaccagcctctgggtaggatgcctgaaggagggatcgttaaatgcagggacactagggggccggggctggagctatggggcctgggtaggggataaagcacctctctgggagcccagaaccccaagtggacctgctgagctaaggagaaagaagccagagagggcccaggggagtgggagccttggtctgctggccagtgtgggcgaggtacatctttgtatccccatttcacggatgagggactgaggctccaagagactaagtgatttgcccaagatctcacagcaggaagtgatggaactgggattcaaacacaagtcgtttccagctttgatgtctgctttattcctctcctagccccatagctgggacctatcccaatcccaggcccatccctaccaccatagcccctattttttttttattcctttatccatggatctttaatttgaggaaataaagttaaacttgccaaatagcagcagcatcgaaccacattgaatctgttcttcattatttacaagattctcttatctcttccaattcttatcagtgttcacatgtcatttctaccagttatgatcaagttcgcttgtgttttaggtttaccctcatttgtaattct

SEQ ID NO: 409431 - DNA, 453 bp, Homo sapiens
aaagctaaaccttaaagatgaatagcccctaaccacatgtgttgcaaatagccttcctgacctccatatgctgtacatgacatcagaatgagtcaggcaattgattgtgaattcctcaaagttttcctttttttaaactattatttttaattttaaaaagcaaatggaaaatctgtattttgatgagcttagggtgttatttttttgaaagtcagctgaaggatggttagacagcacagcgaagactgctgaatgcactgaccccccctggaatgtgatttttgttcctttttatttcaatgtgggcttttgtttttgtttttgttttggtagatcttcagtttgaatgtttggaggaatgaacatcgttgttttgtgctgaaggaaagatcttgatggtgtttctttccccaataattgacttagatattaaaatttggtgctttcaagaaa

SEQ ID NO: 409432 - DNA, 418 bp, Homo sapiens
ctatttctgtagaaaatggcattgcgatattgatggggagtgcattgaatctgtagaccactttcggtagtgtggaaattttgacaatactaattctaatccatgaacaatggatgcctttctattcatctgtgtcttctttaatttccttcagtaatgaaatttagaattttcattgtacaagtatttaacctcttttgttaagtttattcctattttattatttgtgttgctataatgaattattttcttaatttctgtagtttgttattattgtatagaaatgctattgattggctgggcatggtggctcacacctgtaatctcagcactttgggaggtcaaggtgggtggatcacttgagcccaggagttcgagaccaggctggctaacatggtgaaaccccatctctaccaaa

SEQ ID NO: 409433 - DNA, 520 bp, Homo sapiens
tttctactggtacttggtcaaagtgtcttgttcccttatgtgttggtcatcttagaatgtgtgtatgacgttcacctcaccccagctactatgtccctaatctcctcagagaactttgaggatggaggacataacttcaacgggctgctattcctgtcaggatgccatttcacattgttgttccaagtccagttggaaaactactcaaagaggtctgaaactgggacccactcttgtcaatacctgtcccactcttggaaagtactgaagtgtgcttgagggttgtgggggcagtggggatggaggagcggtaaggtaagagacttctgggagacttcttcccacttcatcacaaacaccaaaccatggtcccacccaaaggcatcagcatcacctcctgagcaaccatagaagaggagactttcaaccaagcttgcctggacaaggcaaggatgaaatcaggcttcagaggttgcaaaactgtcacctggcagagtaacattcagtctgttaatgtatt

SEQ ID NO: 409434 - DNA, 143 bp, Homo sapiens
cgcccaggcacggcgcaggctcaccacgcagggaacacgcctctcgcccaggcacggcgcaggctcaccacgcagggaacacgcctctcgcccaggcacggcgcaggctcaccacgcagggaacacgcctctcgcccacagcg

SEQ ID NO: 409435 - DNA, 473 bp, Homo sapiens
actgattcccaggactctttctagacctcctgaatcaagagctctatatttttagaacaagcctccaaagacactcttatgtacaccattgggctaggtcagtagttctcaatttggctgtacattcaaatcaatttctgggttcctcccaggggttctgatttaactgggttgggatgggctcctatgttttagaacttcccaggtgattcaaatgtacagtcaaggcacatttggcgaaacactggactaggtgatttctaaattctttccagatgtaaaattctgcccccagcagcatttttttagttcagcaaatatttattgacttgtctcctcctttcagggctctgggtcagccagggtgtgagggtcaagaaaagactgggctcaaataggcggccttgagttcgtatcctgactcattcatgctgactaccaggataacctttgagaagtccccaaaccaagag

SEQ ID NO: 409436 - DNA, 390 bp, Homo sapiens
gcaaggctgaggtgaacctctggccttccagttgaggtacaggggtcctttgctggccccagatgtggacagtatcctctcgaatgcccaccactgggaacccttaagtccctcaaggtcttggtctgtcacccaggctggagtgcagtggtccagtcatggctcactgcagcctcaacctcctaaactcaagtgatcctctcgcctcagcttccctagtagctgggactgaagtcttgcttcaccctacccagctaatttaaaaaaaaatttttttgtagagacagcatcttgccatgttgcccaggctggtctcgaactcctggattcatactatcctcccacctcggcctcccaaagtattgagattacaagcatgaaccattgcat

SEQ ID NO: 409437 - DNA, 384 bp, Homo sapiens
gaagggtgggactgggagagctgcgccctgcggtccccacccggcctctccccgggggtgtggccgccgtctgttcggtcacagccaggctgcggcctaagttgaggtacaggggtcctttgctggccccagatgtggacagtatcctctcgaatgcccaccactgggaacccttaagtccctcaagatctttcctcagcctcggccagtcctatctcagcagtagtggccggtgttaagtatggtgcctagaaaattacagactattccagaccaggaaggaaagttgacttcatcttcagatactcaggctccagcctggagacatctcatctctcctctgtcactccttccccattattaaagtttgtggatgttccttag

SEQ ID NO: 409438 - DNA, 493 bp, Homo sapiens
cgggaatataaaccagcgtcctcaaggcaaaaattgccattgaaaagaaaaaagaaaagctgaaagctcaatgtttactttaggaacaaggatctaatggggtcagcgattttagctgtggaacaccaataaagaaatatagacatagaaaagcaagtcctgaaatttatggtatatctataaagacaaagcgaaccagagacttcagctaattctactactacaggcagcaaatctggatggttttgcccttggtttttctatcttataaaaactacagtagcaggtttagaagaaattgaatggaatcatttttttttctttgcctttataaacaaaagggtgcttggcaggggaaaaggtagctgggaaaatattccgtaacagagagaactcctgtattgtgatatatccttccttcagtttttggacatagaaaaaggtaactatagaaaaaaggcagaacgtaaattaaagttgttttagaaaatgc

SEQ ID NO: 409439 - DNA, 414 bp, Homo sapiens
ctcgctttcaccatattctattcatcaatgcaaatttgaggggatgggacttagactccacccgtgtatgggaaagtgacaaggtctctttatagaagagcatatagtcagaagttattattgtggccatctttggagaataatatgtgatacattactgggtatatacccaaatgagtataaatcatgctgctataaagacacatgcacacatatgtttattgcggcactattaaattcaaaaaagacttggaaccaacccaaatgtccaacaatgatagactggattaagaaaacgtgccacatgtccgccaccgaatactgcgcagccataaccaatgatgagttcatatcctttgtagggacatggatgaaattggaaaccatctctcagtaaactaacagtcaagagcc

SEQ ID NO: 409440 - DNA, 904 bp, Homo sapiens
ggtcccacgaaactgggtctcttcacagacagacccacagttcgcgagcatggctcagcgctgccccgcttctcccagcgccccttcccgacctttgaacgccttcaccgccctaggaaagcgagatcttgtcagagaaccttccggcgcctgtttcctggcagtggggcatagtccaacagctggctcccccaagatagccagcggccattacgcgcttgggtcgggggagatggagtcgcatttagccgcacagcagcctggaacctgaagttttcggccgctgagcgttctgggtgattgcgtagtgcgagggccaacgaaaccttctgggaagtgtagtccagcaagccgctcacttttcgtgaggcgtcacatcctgctgcttcaccctctggtgcacgggaggaccaactatttcagtcgaaggtgctcagagtaatgctcatgaacacttgtggaccagagatgagctgccttcccaaaacgtagaataatgactccaaagatatccacatcctaatccctgggacctatgaatatgttaccttacatggtaaaagggattttgcagatgtgagtaaatgaagactcttgatatgaggagattaccttggattatccatgtggacccgaggatatctatgagggaaagagggatgcaggagagtcagagtcggaaaaaggaatgttcaaggaaagcagaggtcagagtgatgtgaagatcctggctttgaagatggactgcaagtggtttgtaaaaactggaaagggcaaagaaattaattctcccctagaacctgcagaagaaacacagaccttgactttagcccagtaagacccatttgggacctctgacctccagaactgtaagataataaattagtgttgttttaagccaata

SEQ ID NO: 409441 - DNA, 870 bp, Homo sapiens
ggtcccacgaaactgggtctcttcacagacagacccacagttcgcgagcatggctcagcgctgccccgcttctcccagcgccccttcccgacctttgaacgccttcaccgccctaggaaagcgagatcttgtcagagaaccttccggcgcctgtttcctggcagtggggcatagtccaacagctggctcccccaagatagccagcggccattacgcgcttgggtcgggggagatggagtcgcatttagccgcacagcagcctggaacctgaagttttcggccgctgagcgttctgggtgattgcgtagtgcgagggccaacgaaaccttctgggaagtgtagtccagcaagccgctcacttttcgtgaggcgtcacatcctgctgcttcaccctctggtgcacgggaggaccaactatttcagtcgaaggtgctcagagtaatgctcatgaacacttgtggaccagagatgagctgccttcccaaaacataacttgaaggtcatgatgttctgttttctagttatgctgacgactcaaatcagacacgagtgaaatttggtgccatgactcagatcgggggacttcccttgggagatcaatcccctgtcctcctgctctttgctgcgtgagaaagatccacctatgacctcgggtcctcagaccaaccaacccaaggaacatctcaccaattttaaactcggatccttagctttaggggctgaaaacttgattgctccccgatcacctcagaagctcctgggaccatcacagaccacttgggttactcttaccgggaagggtaagtccttcccctcttaactcttaacgaggctacccatccaaataccttctttcaagggcggtacccg

SEQ ID NO: 409442 - DNA, 510 bp, Homo sapiens
ctcatgggcatctgttttgggagcttcatttcctcatctgctttgacactttaatcttggacattgtagtgaaatgcttcacattgtcacacattctaatctcagagaccactccaaatctttttgaattttcttggccattggaattagtactctggaatcagtacattaagaatggttttttaaaaactatcagctagaatttccacattttagaagaaatggtcagtataaatttggagaagcagtttctagctagtagtagctgtgcagaaaaacagttttattgataagtatctgatttggatttaggatccagctaggatgaaaaattcaattgaggtctggccagatagacataaattttatttttcctttatattctgtgtccaaaagacaaattgtcatgagttattatttttttcctgaagtatccgtttgtttctcagctttggaattagaggtgtagaaaataaacgggactcaacagcctaagattttgtttaaaaa

SEQ ID NO: 409443 - DNA, 118 bp, Homo sapiens
ttgtacacagggtatttctagaagcagaaatagactgggaagatgcacaaccaaggggttacaggcatcgcccgtgctcacctgtattttgtaatcagaaataaattgcttttaaaga

SEQ ID NO: 409444 - DNA, 4643 bp, Homo sapiens
ggaaagtccaccttccccatcaaggccagcctgggaacatggagtggcagcggccgcagcaaatgagagagccaacgcgcggaaagtttgctcaatgggcgatgtccgagataggctgtcactcaggtggcagcggcagaggccgggctgagacgtggccaggggaacacggctggctgtccaggccgtcggggcggcagtagggtccctagcacgtccttgccttcttgggagctccaagcggcgggagaggcaggcgtcagtggctgcgcctccatgcctgcgcgcggggcgggacgctgatggagcgcgccatcagcccggggctgctggtacgggcgctgctgctgctgctgctgctggggctcgcggcaaggacggtggccgcggggcgcgcccgtggcctcccagcgccgacggcggaggcggcgttcggcctcggggcggccgctgctcccacctcagcgacgcgagtaccggcggcgggcgccgtggctgcggccgaggtgactgtggaggacgctgaggcgctgccggcagccgcgggagagcaggagcctcggggtccggaaccagacgatgagacagagttgcgaccgcgcggcaggtcattagtaattatcagcactttagatgggagaattgctgccttggatcctgaaaatcatggtaaaaagcagtgggatttggatgtgggatccggttccttggtgtcatccagccttagcaaaccagaggtatttgggaataagatgatcattccttccctggatggagccctcttccagtgggaccgagaccgtgaaagcatggaaacagttcctttcacagttgaatcacttcttgaatcttcttataaatttggagatgatgttgttttggttggaggaaaatctctgactacatatggactcagtgcatatagtggaaaggtgaggtatatctgttcagctctgggttgtcgccaatgggatagtgacgaaatggaacaagaggaagacatcctgcttctacagcgtacccaaaaaactgttagagctgtcggacctcgcagtggcaatgagaagtggaatttcagtgttggccactttgaacttcggtatattccagacatggaaacgagagccggatttattgaaagcacctttaagcccaatgagaacacagaagagtctaaaattatttcagatgtggaagaacaggaagctgccataatggacatagtgataaaggtttcggttgctgactggaaagttatggcattcagtaagaagggaggacatctggaatgggagtaccagttttgtactccaattgcatctgcctggttacttaaggatgggaaagtcattcccatcagtctttttgatgatacaagttatacatctaatgatgatgttttagaagatgaagaagacattgtagaagctgccagaggagccacagaaaacagtgtttacttgggaatgtatagaggccagctgtatctgcagtcatcagtcagaatttcagaaaagtttccttcaagtcccaaggctttggaatctgtcactaatgaaaacgcaattattcctttaccaacaatcaaatggaaacccttaattcattctccttccagaactcctgtcttggtaggatctgatgaatttgacaaatgtctcagtaatgataagttttctcatgaagaatatagtaatggtgcactttcaatcttgcagtatccatatgataatggttattatctaccatactacaagagggagaggaacaaacgaagcacacagattacagtcagattcctcgacaacccacattacaacaagaatatccgcaaaaaggatcctgttcttcttttacactggtggaaagaaatagttgcaacgattttgttttgtatcatagcaacaacgtttattgtgcgcaggcttttccatcctcatcctcacaggcaaaggaaggagtctgaaactcagtgtcaaactgaaaataaatatgattctgtaagtggtgaagccaatgacagtagctggaatgacataaaaaactctggatatatatcacgatatctaactgattttgagccaattcagtgcctgggacgtggtggctttggagttgtttttgaagctaaaaacaaagtagatgactgcaattatgctatcaagaggatccgtctccccaatagggaattggctcgggaaaaggtaatgcgagaagttaaagccttagccaagcttgaacacccgggcattgttagatatttcaatgcctggctcgaagcaccaccagagaagtggcaagaaaagatggatgaaatttggctgaaagatgaaagcacagactggccactcagctctcctagcccaatggatgcaccatcagttaaaatacgcagaatggatcctttctctacaaaagaacatattgaaatcatagctccttcaccacaaagaagcaggtctttttcagtagggatttcctgtgaccagacaagttcatctgagagccagttctcaccactggaattctcaggaatggaccatgaggacatcagtgagtcagtggatgcagcatacaacctccaggacagttgccttacagactgtgatgtggaagatgggactatggatggcaatgatgaggggcactcctttgaactttgtccttctgaagcttctccttatgtaaggtcaagggagagaacctcctcttcaatagtatttgaagattctggctgtgataatgcttccagtaaagaagagccgaaaactaatcgattgcatattggcaaccattgtgctaataaactaactgctttcaagcccaccagtagcaaatcttcttctgaagctacattgtctatttctcctccaagaccaaccactttaagtttagatctcactaaaaacaccacagaaaaactccagcccagttcaccaaaggtgtatctttacattcaaatgcagctgtgcagaaaagaaaacctcaaagactggatgaatggacgatgtaccatagaggagagagagaggagcgtgtgtctgcacatcttcctgcagatcgcagaggcagtggagtttcttcacagtaaaggactgatgcacagggacctcaagccatccaacatattctttacaatggatgatgtggtcaaggttggagactttgggttagtgactgcaatggaccaggatgaggaagagcagacggttctgaccccaatgccagcttatgccagacacacaggacaagtagggaccaaactgtatatgagcccagagcagattcatggaaacagctattctcataaagtggacatcttttctttaggcctgattctatttgaattgctgtatccattcagcactcagatggagagagtcaggaccttaactgatgtaagaaatctcaaatttccaccattatttactcagaaatatccttgtgagtacgtgatggttcaagacatgctctctccatcccccatggaacgacctgaagctataaacatcattgaaaatgctgtatttgaggacttggactttccaggaaaaacagtgctcagacagaggtctcgctccttgagttcatcgggaacaaaacattcaagacagtccaacaactcccatagccctttgccaagcaattagccttaagttgtgctagcaaccctaataggtgatgcagataatagcctacttcttagaatatgcctgtccaaaattgcagacttgaaaagtttgttcttcgctcaatttttttgtggactactttttttatatcaaatttaagctggatttgggggcataacctaatttgagccaactcctgagttttgctatacttaaggaaagggctatctttgttctttgttagtctcttgaaactggctgctggccaagctttatagccctcaccatttgcctaaggaggtagcagcaatccctaatatatatatatagtgagaactaaaatggatatatttttataatgcagaagaaggaaagtccccctgtgtggtaactgtattgttctagaaatatgctttctagagatatgatgattttgaaactgatttctagaaaaagctgactccatttttgtccctggcgggtaaattaggaatctgcactattttggaggacaagtagcacaaactgtataacggtttatgtccgtagttttatagtcctatttgtagcattcaatagctttattccttagatggttctagggtgggtttacagctttttgtacttttacctccaataaagggaaaatgaagctttttatgtaaattggttgaaaggtctagttttgggaggaaaaaagccgtagtaagaaatggatcatatatattacaactaacttcttcaactatggactttttaagcctaatgaaatcttaagtgtcttatatgtaatcctgtaggttggtacttcccccaaactgattataggtaacagtttaatcatctcacttgctaacatgtttttatttttcactgtaaatatgtttatgttttatttataaaaattctgaaatcaatccatttgggttggtggtgtacagaacacacttaagtgtgttaacttgtgacttctttcaagtctaaatcatttaataaaactttttttaaatt

SEQ ID NO: 409445 - DNA, 1942 bp, Homo sapiens
cggccgctcagcgccagcagcacgtgcatctccgcgtgcagggggccgggccagggtgaggggctggggctgcgcaatggcatcaggctctagctgccttcaggcaagtccatcgaggcagaggacacaggtcaggctgcggaggccgctgaggacacgtcaccggtggggtggtccaggcctctgccacgtgttctgaccccaagcccaaggcgtcgatgtctgagggaaaggccctggctcccggacagaggaccgaagggtctcgggtgcccccacctgctcattggctttgccctgccctgcggcctctgtgttctgccttgccctttgatgaagtcacaaaccagagggaggaggccaggcctgcaggggctgcttcggagggctggccacgcgggcagctgcaacctgggcatgtacgtctgtgtggcaggggggcttctggactgggggctcggcaccgacccaggaaggggagctgtgagcagggacatctggccctagtctcagagcaacatccctcgaaatgccatctggccctggaaggtgcaagggaggcaggatgagtctgctcatgctaccgcgggccgcccagcaaggaagcaggctgcccgccaggctggcacgcgcctcttgcagtggagggtttgctcttcaggaacggacagagaacctccagactccctcggctgcacgctgggggcgagcccaggcagccacaggagtcctccaagccagatgagcccgccctgcggcactgccagcacttgggacgccagactcccttcaggcggcgggccccaagggcactgcgacagctcagcacccaccacagatcagcaacaggacaacccgagcgcggagacacagacgggaagcgtgtggggtcctgggataggcccaactcaatgatttcccctccctggggctaaggtctcagccgtgagggggctctggggaggggaggtcagagtagcctggagagctctccctaaggagggccgtgggatccatgggatctgcaggggaatcgccggggctggccctaaggctctccagccagcgccagggaggcaggggctccaaaccagcaggctgctcagggtggtcctcggacagcagccatgccctcccagggagcttgccagacacacagacctttcccagcctccagaccagaacctgcattttttaggagctttctgggggaccctcatctgtgacctgcctccagggatactttctcgctctacagacaccactgatgtgaagacgcaggagacaggacaaccccccgtgaagggtcctgtccacccaccactgaggcctggcccgactttctacaagaccctgctgggggggaagtgcccctcggagtaaaggaaatacagccccactcctgggaagacagcactcatttccatcagaggccacgccccccactcacacgccaggagaaagccacacctgcagaagcctgctccccacccaatgccagcccctcctctggggaggctctgggactggagcaactgggactctcctggctgctgaccccggagccaggctctctgcttgtcctgcactacctcgccacgtctgcacaggggcctgacaagcgctactgtctccgggctacagaggacactggagctcagagctggacaaccggcccaggcccaggccgcacacggcgcagcaggccgtctgccgcactctgggggaggtcaccctggggctgctgacctgctctgtccctcgccccagcaccgtggcaatctaacaggaaggggcagggccagctccctctggaactcgggcagcgtcaaagataaggtgtcttcaaaaagctcatggaaaacgtgcgttgtgacgaaacttgcatggctttcaagtttttttgccccaaaataaactgatactaacttgtcaaaaaatg

SEQ ID NO: 409446 - DNA, 1620 bp, Homo sapiens
cggccgctcagcgccagcagcacgtgcatctccgcgtgcagggggccgggccagggtgaggggctggggctgcgcaatggcatcaggctctagctgccttcaggcaagtccatcgaggcagaggacacaggtcaggctgcggaggccgctgaggacacgtcaccggtggggtggtccaggcctctgccacgtgttctgaccccaagcccaaggcgtcgatgtctgagggaaaggccctggctcccggacagaggaccgaagggtctcgggtgcccccacctgctcattggctttgccctgccctgcggcctctgtgttctgccttgccctttgatgaagtcacaaaccagagggaggaggccaggcctgcaggggctgcttcggagggctggccacgcgggcagctgcaacctgggcatgtacgtctgtgtggcaggggggcttctggactgggggctcggcaccgacccaggaaggggagctgtgagcagggacatctggccctagtctcagagcaacatccctcgaaatgccatctggccctggaaggtgcaagggaggcaggatgagtctgctcatgctaccgcgggccgcccagcaaggaagcaggctgcccgccaggctggcacgcgcctcttgcagtggagggtttgctcttcaggaacggacagagaacctccagactccctcggctgcacgctgggggcgagcccaggcagccacaggagtcctccaagccagatgagcccgccctgcggcactgccagcacttgggacgccagactcccttcaggcggcgggccccaagggcactgcgacagctcagcacccaccacagatcagcaacaggacaacccgagcgcggagacacagacgggaagcgtgtggggtcctgggataggcccaactcaatgatttcccctccctggggctaagacaccactgatgtgaagacgcaggagacaggacaaccccccgtgaagggtcctgtccacccaccactgaggcctggcccgactttctacaagaccctgctgggggggaagtgcccctcggagtaaaggaaatacagccccactcctgggaagacagcactcatttccatcagaggccacgccccccactcacacgccaggagaaagccacacctgcagaagcctgctccccacccaatgccagcccctcctctggggaggctctgggactggagcaactgggactctcctggctgctgaccccggagccaggctctctgcttgtcctgcactacctcgccacgtctgcacaggggcctgacaagcgctactgtctccgggctacagaggacactggagctcagagctggacaaccggcccaggcccaggccgcacacggcgcagcaggccgtctgccgcactctgggggaggtcaccctggggctgctgacctgctctgtccctcgccccagcaccgtggcaatctaacaggaaggggcagggccagctccctctggaactcgggcagcgtcaaagataaggtgtcttcaaaaagctcatggaaaacgtgcgttgtgacgaaacttgcatggctttcaagtttttttgccccaaaataaactgatactaacttgtcaaaaaatg

SEQ ID NO: 409447 - DNA, 1927 bp, Homo sapiens
cggccgctcagcgccagcagcacgtgcatctccgcgtgcagggggccgggccagggtgaggggctggggctgcgcaatggcatcaggctctagctgccttcaggcaagtccatcgaggcagaggacacaggtcaggctgcggaggccgctgaggacacgtcaccggtggggtggtccaggcctctgccacgtgttctgaccccaagcccaaggcgtcgatgtctgagggaaaggccctggctcccggacagaggaccgaagggtctcgggtgcccccacctgctcattggctttgccctgccctgcggcctctgtgttctgccttgccctttgatgaagtcacaaaccagagggaggaggccaggcctgcaggggctgcttcggagggctggccacgcgggcagctgcaacctgggcatgtacgtctgtgtggcaggggggcttctggactgggggctcggcaccgacccaggaaggggagctgtgagcagggacatctggccctagtctcagagcaacatccctcgaaatgccatctggccctggaaggtgcaagggaggcaggatgagtctgctcatgctaccgcgggccgcccagcaaggaagcaggctgcccgccaggctggcacgcgcctcttgcagtggagggtttgctcttcaggaacggacagagaacctccagactccctcggctgcacgctgggggcgagcccaggcagccacaggagtcctccaagccagatgagcccgccctgcggcactgccagcacttgggacgccagactcccttcaggcggcgggccccaagggcactgcgacagctcagcacccaccacagatcagcaacaggacaacccgagcgcggagacacagacgggaagcgtgtggggtcctgggataggcccaactcaatgatttcccctccctggggctaaggtctcagccgtgagggggctctggggaggggaggtcagagtagcctggagagctctccctaaggagggccgtgggatccatgggatctgcaggggaatcgccggggctggccctaaggctctccagccagcgccagggaggcaggggctccaaaccagcaggctgctcagggtggtcctcggacagcagccatgccctcccagggagcttgccagacacacagacctttcccagcctccagaccagaacctgcattttttaggagctttctgggggaccctcatctgtgacctgcctccagggatactttctcgctctacagacaccactgatgtgaagacgcaggagacaggacaaccccccgtgaagggtcctgtccacccaccactgaggcctggcccgactttctacaagaccctgctgggggggaagtgcccctcggagtaaaggaaatacagccccactcctgggaagacagcactcatttccatcagaggccacgccccccactcacacgccaggagaaagccacacctgcagaagcctgctccccacccaatgccaggggcggaaatgtggacggagggcgacttctctgccagcctggcgggggcctgcagcaagctcgccgatgccctctgcgcctgctgggcccgcaggggcctgacaagcgctactgtctccgggctacagaggacactggagctcagagctggacaaccggcccaggcccaggccgcacacggcgcagcaggccgtctgccgcactctgggggaggtcaccctggggctgctgacctgctctgtccctcgccccagcaccgtggcaatctaacaggaaggggcagggccagctccctctggaactcgggcagcgtcaaagataaggtgtcttcaaaaagctcatggaaaacgtgcgttgtgacgaaacttgcatggctttcaagtttttttgccccaaaataaactgatactaacttgtcaaaaaatg

SEQ ID NO: 409448 - DNA, 454 bp, Homo sapiens
gtccatttaggcttagtgctgacatgacatctgaccaggctattttcatgacacaatcaaaagagaataaagctgtgtgtgatctgtgaaataaaaaccccttgcaggtctgtgaacacaagcaagataaatttatgaaggctctggccaagaatctctctcaacaatatacaaagagtcctgtcttgaagatctgtgtgaaaaaggattctaggttagtttcggtaataataaaacctaccactgtatccttataaccgcagacatctgggtaagacccagaagagaactgccatgatacaatctattttggaattacctatgggctttttatttcattttttgaaacaaggtcttgctctgtcactcaggctggagcagtggcatgattacaactcactgaagccttgacctcccatgctcaaacgatcctcctgcctcagcctcttgagca

SEQ ID NO: 409449 - DNA, 597 bp, Homo sapiens
caaaaaaaaaaaaaaaaaaaaaactctgggcaaaaggtacctatgttcatttcagttgtcatttcattcaaactttctatgcctgttctccaccctagcagctgatttatagactgaccttttacctgggctagtccccagctacattggcactgtcacaaggcagtgaactccgtgagtaaatgcatgttctgatttgctttgctctcaaaggccaacctgaccttctgcttgtctttctgactggttgtgactcatagactagctgaacaccaggtccttgggatcccaagctgggcagggtgctgtgttttttctttgctcactcagactttcccagtgctgtctgtttcagaactggggttgataacagggtcggtaatggggagaccaggctccattgctatggttactctctccatggatacaaattatcagggaacttccatcctcacagacctgactcctacctcctccagaggtcttttaccaagtaaaaacaagtggtgaactcttcactcacttcctggaaatttctcttcaatttcaccctatttgtatcaacaaaatcacctacctaccaaataggaattttta

SEQ ID NO: 409450 - DNA, 3347 bp, Homo sapiens
agcggggaggagctggagaacatagacagggatgatttatttattgttcctggtcactgtctctttgaggattggtatctctgctccagaaaagatggcagcctctttcttctctgattttggtcttatgtggtatctggaggagctcaaaaaggaggagttcaggaaatttaaagaacatctcaagcaaatgactttgcagcttgaactcaagcagattccctggactgaggtcaaaaaaagcatcccgggaagaacttgcaaacctcttgatcaagcactatgaagaacaacaagcttggaacataaccttaagaatctttcaaaagatggatagaaaggatctctgcatgaaggtcatgagggagagaacaggatacacaaagacctatcaagctcacgcaaagcagaaattcagccgcttatggtccagcaagtctgtcactgagattcacctatactttgaggaggaagtcaagcaagaagaatgtgaccatttggaccgcctttttgctcccaaggaaactgggaaacagccacgtacagtgattattcaaggaccacaaggaattggaaaaacgacactcctgatgaagctgatgatggcctggtcggacaacaagatctttcgggataggttcctgtacacgttctatttctgctgcagagaactgagggagttgccgccaacgagtttggctgacttgatttccagagagtggctgaccccgctgctcctataacagagatcgtgtctcaaccggagagactcttgttcgtcatcgacagcttcgaagagctgcagggcggcttgaacgaacccgattcggatctgtgtggtgacttgatggagaaacggccggtgcaggtgcttctgagcagtttgctgaggaagaagatgctcccggaggcctccctgctcatcgccatcaaacccgtgtgcccgaaggagctccgggatcaggtgacgatctcagaaatctaccagccccggggattcaacgagagtgataggttagtgtatttctgctgtttcttcaaagacccgaaaagagccatggaagccttcaatcttgtaagagaaagtgaacagctgttttccatatgccaaatcccgctcctctgctggatcctgtgtaccagtctgaagcaagagatgcagaaaggaaaagacctggccctgacctgccagagcactacctctgtgtactcctctttcgtctttaacctgttcacacctgagggtgccgagggcccgactccgcaaacccagcaccagctgaaggccctgtgctccctggctgcagagggtatgtggacagacacatttgagttttgtgaagacgacctccggagaaatggggttgttgacgctgacatccctgcgctgctgggcaccaagatacttctgaagtacggggagcgtgagagctcctacgtgttcctccacgtgtgtatccaggagttctgtgccgccttgttctatttgctcaagagccaccttgatcatcctcacccagctgtgagatgtgtacaggaattgctagttgccaattttgaaaaagcaaggagagcacattggatttttttggggtgttttctaactggccttttaaataaaaaggaacaagaaaaactggatgcgttttttggcttccaactgtcccaagagataaagcagcaaattcaccagtgcctgaagagcttaggggagcgtggcaatcctcagggacaggtggattccttggcgatattttactgtctctttgaaatgcaggatcctgcctttgtgaagcaggcagtgaacctcctccaagaagctaactttcatattattgacaacgtggacttggtggtttctgcctactgcttaaaatactgctccagcttgaggaaactctgtttttccgttcaaaatgtctttaagaaagaggatgaacacagctctacgtcggattacagcctcatctgttggcatcacatctgctctgtgctcaccaccagcgggcacctcagagagctccaggtgcaggacagcaccctcagcgagtcgacctttgtgacctggtgtaaccagctgaggcatcccagctgtcgccttcagaagcttggaataaataacgtttccttttctggccagagtgttctgctctttgaggtgctcttttatcagccagacttgaaatacctgagcttcaccctcacgaaactctctcgtgatgacatcaggtccctctgtgatgccttgaactacccagcaggcaacgtcaaagagctagcgctggtaaattgtcacctctcacccattgattgtgaagtccttgctggccttctaaccaacaacaagaagctgacgtatctgaatgtatcctgcaaccagttagacacaggcgtgccccttttgtgtgaagccctgtgcagcccagacacggtcctggtatacctgatgttggctttctgccacctcagcgagcagtgctgcgaatacatctctgaaatgcttctgcgtaacaagagcgtgcgctatctagacctcagtgccaatgtcctgaaggacgaaggactgaaaactctctgcgaggccttgaaacatccggactgctgcctggattcactgtgtttggtaaaatgttttatcactgctgctggctgtgaagacctcgcctctgctctcatcagcaatcaaaacctgaagattctgcaaattgggtgcaatgaaatcggagatgtgggtgtgcagctgttgtgtcgggctctgacgcatacggattgccgcttagagattcttgggttggaagaatgtgggttaacgagcacctgctgtaaggatctcgcgtctgttctcacctgcagtaagaccctgcagcagctcaacctgaccttgaacaccttggaccacacaggggtggttgtactctgtgaggccctgagacacccagagtgtgccctgcaggtgctcgggctgagaaaaactgattttgatgaggaaacccaggcacttctgacggctgaggaagagagaaatcctaacctgaccatcacagacgactgtgacacaatcacaagggtagagatctgattgcgaggaacctgggctctgactcgaacacctgcaaaggacagggactgggaccgttacttacatgacactgcacccaggagatacaaatcattgacactctgagttgtgagatttctggcaccccattcatagatttgatatgatacacgtggtttttatgtgctctgtggccttggatgagtcactgaaaggccttcatggtctctcggtctcacaaggacctcttaacccctcaataaagtgttacatttctaaacattggaaa

SEQ ID NO: 409451 - DNA, 3382 bp, Homo sapiens
gcccccgcgaaacctcacgccccccccaactacggcagtacgagccggttaaatcggacgagattatcaatttatttattgttcctggtcactgtctctttgaggattggtatctctgctccagaaaagatggcagcctctttcttctctgattttggtcttatgtggtatctggaggagctcaaaaaggaggagttcaggaaatttaaagaacatctcaagcaaatgactttgcagcttgaactcaagcagattccctggactgaggtcaaaaaaagcatcccgggaagaacttgcaaacctcttgatcaagcactatgaagaacaacaagcttggaacataaccttaagaatctttcaaaagatggatagaaaggatctctgcatgaaggtcatgagggagagaacaggatacacaaagacctatcaagctcacgcaaagcagaaattcagccgcttatggtccagcaagtctgtcactgagattcacctatactttgaggaggaagtcaagcaagaagaatgtgaccatttggaccgcctttttgctcccaaggaaactgggaaacagccacgtacagtgattattcaaggaccacaaggaattggaaaaacgacactcctgatgaagctgatgatggcctggtcggacaacaagatctttcgggataggttcctgtacacgttctatttctgctgcagagaactgagggagttgccgccaacgagtttggctgacttgatttccagagagtggctgaccccgctgctcctataacagagatcgtgtctcaaccggagagactcttgttcgtcatcgacagcttcgaagagctgcagggcggcttgaacgaacccgattcggatctgtgtggtgacttgatggagaaacggccggtgcaggtgcttctgagcagtttgctgaggaagaagatgctcccggaggcctccctgctcatcgccatcaaacccgtgtgcccgaaggagctccgggatcaggtgacgatctcagaaatctaccagccccggggattcaacgagagtgataggttagtgtatttctgctgtttcttcaaagacccgaaaagagccatggaagccttcaatcttgtaagagaaagtgaacagctgttttccatatgccaaatcccgctcctctgctggatcctgtgtaccagtctgaagcaagagatgcagaaaggaaaagacctggccctgacctgccagagcactacctctgtgtactcctctttcgtctttaacctgttcacacctgagggtgccgagggcccgactccgcaaacccagcaccagctgaaggccctgtgctccctggctgcagagggtatgtggacagacacatttgagttttgtgaagacgacctccggagaaatggggttgttgacgctgacatccctgcgctgctgggcaccaagatacttctgaagtacggggagcgtgagagctcctacgtgttcctccacgtgtgtatccaggagttctgtgccgccttgttctatttgctcaagagccaccttgatcatcctcacccagctgtgagatgtgtacaggaattgctagttgccaattttgaaaaagcaaggagagcacattggatttttttggggtgttttctaactggccttttaaataaaaaggaacaagaaaaactggatgcgttttttggcttccaactgtcccaagagataaagcagcaaattcaccagtgcctgaagagcttaggggagcgtggcaatcctcagggacaggtggattccttggcgatattttactgtctctttgaaatgcaggatcctgcctttgtgaagcaggcagtgaacctcctccaagaagctaactttcatattattgacaacgtggacttggtggtttctgcctactgcttaaaatactgctccagcttgaggaaactctgtttttccgttcaaaatgtctttaagaaagaggatgaacacagctctacgtcggattacagcctcatctgttggcatcacatctgctctgtgctcaccaccagcgggcacctcagagagctccaggtgcaggacagcaccctcagcgagtcgacctttgtgacctggtgtaaccagctgaggcatcccagctgtcgccttcagaagcttggaataaataacgtttccttttctggccagagtgttctgctctttgaggtgctcttttatcagccagacttgaaatacctgagcttcaccctcacgaaactctctcgtgatgacatcaggtccctctgtgatgccttgaactacccagcaggcaacgtcaaagagctagcgctggtaaattgtcacctctcacccattgattgtgaagtccttgctggccttctaaccaacaacaagaagctgacgtatctgaatgtatcctgcaaccagttagacacaggcgtgccccttttgtgtgaagccctgtgcagcccagacacggtcctggtatacctgatgttggctttctgccacctcagcgagcagtgctgcgaatacatctctgaaatgcttctgcgtaacaagagcgtgcgctatctagacctcagtgccaatgtcctgaaggacgaaggactgaaaactctctgcgaggccttgaaacatccggactgctgcctggattcactgtgtttggtaaaatgttttatcactgctgctggctgtgaagacctcgcctctgctctcatcagcaatcaaaacctgaagattctgcaaattgggtgcaatgaaatcggagatgtgggtgtgcagctgttgtgtcgggctctgacgcatacggattgccgcttagagattcttgggttggaagaatgtgggttaacgagcacctgctgtaaggatctcgcgtctgttctcacctgcagtaagaccctgcagcagctcaacctgaccttgaacaccttggaccacacaggggtggttgtactctgtgaggccctgagacacccagagtgtgccctgcaggtgctcgggctgagaaaaactgattttgatgaggaaacccaggcacttctgacggctgaggaagagagaaatcctaacctgaccatcacagacgactgtgacacaatcacaagggtagagatctgattgcgaggaacctgggctctgactcgaacacctgcaaaggacagggactgggaccgttacttacatgacactgcacccaggagatacaaatcattgacactctgagttgtgagatttctggcaccccattcatagatttgatatgatacacgtggtttttatgtgctctgtggccttggatgagtcactgaaaggccttcatggtctctcggtctcacaaggacctcttaacccctcaataaagtgttacatttctaaacattggaaa

SEQ ID NO: 409452 - DNA, 3176 bp, Homo sapiens
agcggggaggagctggagaacatagacagggatgatttatttattgttcctggtcactgtctctttgaggattggtatctctgctccagaaaagatggcagcctctttcttctctgattttggtcttatgtggtatctggaggagctcaaaaaggaggagttcaggaaatttaaagaacatctcaagcaaatgactttgcagcttgaactcaagcagattccctggactgaggtcaaaaaaagcatcccgggaagaacttgcaaacctcttgatcaagcactatgaagaacaacaagcttggaacataaccttaagaatctttcaaaagatggatagaaaggatctctgcatgaaggtcatgagggagagaacaggatacacaaagacctatcaagctcacgcaaagcagaaattcagccgcttatggtccagcaagtctgtcactgagattcacctatactttgaggaggaagtcaagcaagaagaatgtgaccatttggaccgcctttttgctcccaaggaaactgggaaacagccacgtacagtgattattcaaggaccacaaggaattggaaaaacgacactcctgatgaagctgatgatggcctggtcggacaacaagatctttcgggataggttcctgtacacgttctatttctgctgcagagaactgagggagttgccgccaacgagtttggctgacttgatttccagagagtggctgaccccgctgctcctataacagagatcgtgtctcaaccggagagactcttgttcgtcatcgacagcttcgaagagctgcagggcggcttgaacgaacccgattcggatctgtgtggtgacttgatggagaaacggccggtgcaggtgcttctgagcagtttgctgaggaagaagatgctcccggaggcctccctgctcatcgccatcaaacccgtgtgcccgaaggagctccgggatcaggtgacgatctcagaaatctaccagccccggggattcaacgagagtgataggttagtgtatttctgctgtttcttcaaagacccgaaaagagccatggaagccttcaatcttgtaagagaaagtgaacagctgttttccatatgccaaatcccgctcctctgctggatcctgtgtaccagtctgaagcaagagatgcagaaaggaaaagacctggccctgacctgccagagcactacctctgtgtactcctctttcgtctttaacctgttcacacctgagggtgccgagggcccgactccgcaaacccagcaccagctgaaggccctgtgctccctggctgcagagggtatgtggacagacacatttgagttttgtgaagacgacctccggagaaatggggttgttgacgctgacatccctgcgctgctgggcaccaagatacttctgaagtacggggagcgtgagagctcctacgtgttcctccacgtgtgtatccaggagttctgtgccgccttgttctatttgctcaagagccaccttgatcatcctcacccagctgtgagatgtgtacaggaattgctagttgccaattttgaaaaagcaaggagagcacattggatttttttggggtgttttctaactggccttttaaataaaaaggaacaagaaaaactggatgcgttttttggcttccaactgtcccaagagataaagcagcaaattcaccagtgcctgaagagcttaggggagcgtggcaatcctcagggacaggtggattccttggcgatattttactgtctctttgaaatgcaggatcctgcctttgtgaagcaggcagtgaacctcctccaagaagctaactttcatattattgacaacgtggacttggtggtttctgcctactgcttaaaatactgctccagcttgaggaaactctgtttttccgttcaaaatgtctttaagaaagaggatgaacacagctctacgtcggattacagcctcatctgttggcatcacatctgctctgtgctcaccaccagcgggcacctcagagagctccaggtgcaggacagcaccctcagcgagtcgacctttgtgacctggtgtaaccagctgaggcatcccagctgtcgccttcagaagcttggaataaataacgtttccttttctggccagagtgttctgctctttgaggtgctcttttatcagccagacttgaaatacctgagcttcaccctcacgaaactctctcgtgatgacatcaggtccctctgtgatgccttgaactacccagcaggcaacgtcaaagagctagcgctggtaaattgtcacctctcacccattgattgtgaagtccttgctggccttctaaccaacaacaagaagctgacgtatctgaatgtatcctgcaaccagttagacacaggcgtgccccttttgtgtgaagccctgtgcagcccagacacggtcctggtatacctgatgttggctttctgccacctcagcgagcagtgctgcgaatacatctctgaaatgcttctgcgtaacaagagcgtgcgctatctagacctcagtgccaatgtcctgaaggacgaaggactgaaaactctctgcgaggccttgaaacatccggactgctgcctggattcactgtggttggaagaatgtgggttaacgagcacctgctgtaaggatctcgcgtctgttctcacctgcagtaagaccctgcagcagctcaacctgaccttgaacaccttggaccacacaggggtggttgtactctgtgaggccctgagacacccagagtgtgccctgcaggtgctcgggctgagaaaaactgattttgatgaggaaacccaggcacttctgacggctgaggaagagagaaatcctaacctgaccatcacagacgactgtgacacaatcacaagggtagagatctgattgcgaggaacctgggctctgactcgaacacctgcaaaggacagggactgggaccgttacttacatgacactgcacccaggagatacaaatcattgacactctgagttgtgagatttctggcaccccattcatagatttgatatgatacacgtggtttttatgtgctctgtggccttggatgagtcactgaaaggccttcatggtctctcggtctcacaaggacctcttaacccctcaataaagtgttacatttctaaacattggaaa

SEQ ID NO: 409453 - DNA, 647 bp, Homo sapiens
ctcctgtagacaatatacccgtgaatggtgtagtgagttctaatgaaactttatttacaagaggagactgaccaggtttggcctgggggccacagtgtgtagacctctggaaagatacatcctgagaagaaaaaaagaatatatgcaggaatgcttaactttgtgggttttctctcctcttgccctcactgactcaggatacacaaagacctatcaagctcacgcaaagcagaaattcagccgcttatggtccagcaagtctgtcactgagattcacctatactttgaggaggaagtcaagcaagaagaatgtgaccatttggaccgcctttttgctcccaaggaaactgggaaacagccacgtacagtgattattcaaggaccacaaggaattggaaaaacgacactcctgatgaagctgatgatggcctggtcggacaacaagatctttcgggataggttcctgtacacgttctatttctgctgcagagaactgagggagttgccgccaacgagtttggctgacttgatttccagagagtggctgaccccgctgctcctataacagagatcgtgtctcaaccggagagactcttgttcgtcatcgacagcttcgaagagctgcagggcggcttgaacgaacccga

SEQ ID NO: 409454 - DNA, 370 bp, Homo sapiens
gacaaggacaggaggctgggaaattctgggcagaagagagcgagtcctggtaaaggccccaccctcaagcctggaactacagcccaaagtgagaacatgcattcctgttttcctgctcaaatgttgccttttccaaaaccacccatggcccactctgccccctatcctgtgccatcccaggctttgccagcagagcaggcgaggagaagatgaaaagcagctggacattggaaactggtttggggctggagagaagaagtccaggccactggacttcaggaaaagatcatcttcctgctctatcccttttccagctccccttgcggctgagagccactttcataggcaataaagtccttcacattcacta

SEQ ID NO: 409455 - DNA, 405 bp, Homo sapiens
atatatctgcataaaactttcatgtgcaacttaatactattaagtgaacactcatggaatcagaaaccatgtcatgaaacacaaatggctctgcaaaaatccctgtttacctatgcttggttacaacttctctatgcttagaattcacacaacttctctatgcttagaattcaccagtctcctaatatttatgtaataatttccttgattttcttcatagttttatcaacaatatatgaattcctaaaatgtcattgaattttgcctgcttctgacctttacataaatatagccatatatgcatattttttcttttggttaatattatgtttgtaatcagtgtacaagattttatgtggctgtataatttttccttaaagaatacaactgtttctccattctact

SEQ ID NO: 409456 - DNA, 399 bp, Homo sapiens
ggacacatcatttaactcctttgagcctctctcctcttcccatttccccaaacagtcaagccctttctcgttggtgccctgggaacaatgccatttctagtacttaccatggcagatttcagtgattgtttgcctctctcattaggctcggagcaacttgaaggcggggcccatgtctgtctcattcaaagctatatcctctgctcctaaaatagtgtctaacccttgataggtgcccagttgatgtttgataaaggaatgtagatgtggatgaaatgtgaaccagaaaatgacttctgtgaacttcatgtatcatggctgctgctttctagatacatcatggtatttagtctccctcatgttattatctgccatttattaaatactgactacattcca

SEQ ID NO: 409457 - DNA, 483 bp, Homo sapiens
ggccactccatgtgccatctcaccatctcttcagcgttcctcatgctgcttctccccgtgccataggcgtttccattcttgcaggaaaatgacaatgcaagtgcaaattccactcacttttattggtatgacaataaattattctttctaaacacttagcaaaatgacgaaaagcagtattccttaaaatataggttttcattttctcaatatattttgaactgactaaagttctttacaaagacaagaggatcagaaggttccacttacccgtgttttagcgtttgtttggagataatgccaaccaaaaggtggaaaactaaaaccaccattgctttacataagaggtacacactgccccccaccccccaaaaaaaaacacagctttgaaagttgggagaaacactgcagtcttcattgtaaatataaagtgataatttaggtgaggaaggaacggtaaggagggaaggggaatgagtcctt

SEQ ID NO: 409458 - DNA, 212 bp, Homo sapiens
aatttggtttcattctttagagctgtgctgaacaatacgtagccacgagccacatgtgactactgagcacttgaaatgctacttttccatattgagatgtgctctaagtgtaaaatctacactgaagttcaaagacttaggaaaaatgaatgtcaaatatctcattactaattttgatattgcatgctagtttggatatattgagttaaata

SEQ ID NO: 409459 - DNA, 563 bp, Homo sapiens
ttttttttttgccttttcgaagttgcgttattgtgatatttgtaaagggcttcctattacatctgcaagagggtaaggaattaaactaccaggtctttaccacatcttattaaaaaaagaaagtcattcttacagacctaacgcttcttcccccaccaagcactatttttccatgagtgaaaagtgttgaattctgggattttgccagcaattaattgtattctgaaaatggggaaatgatgtgctttggggatgcacttatataatcacttacattcttggagtagccagaggacagtttgccatatacagaatggtgtgacagacacttaagcacctaagatatttagggtatgggctttgtgttagaggaaagttaacacagtggctggttttgtgaaggaggaaatctagctgtgggaggagagagatgacatgttgagttttaaaaggatggatacttaaaatgtcattgggaacattctacaacttgggagaggtcctttctaaagctgttacgattaggtgctaaaggaggtattgaaggcaaaggcatatccaaa

SEQ ID NO: 409460 - DNA, 651 bp, Homo sapiens
gaactttccaacgaaaaacttttgaaggatgggcttctggtagtggtaattgacctgaatacgtaacatttaaatcaaagacctcaaactaatttcctagatttatctagacatattcttttgctacatgaggaccagcgttccaccccctttggaggatttgacaacaaggtgccatcttggaagcagagaacagcacgcaccaaacaaccaaatctcttggcaccttgatcttgcacttcacagccccaaggactgaacctgtacccactcatgggcttaccacatatggagcaatatagatggagtgttctcctgaagggagctgcagcccaaccttcttctttattctagtcttcaagcctctcttttggctctgagcaaagctttgaagggctcattatgtgctataatggttccactatcaacctgctatgttgtgaaattcagcctgatcacctggagaaaacatgacctttctgagcaacttgtctctcaggagaaaagtctcctttattttgaaggagattggcctcagggcactgtggaagtgataactctatttctacttttgtcccttatttcaaggtgaagagaagtggaaaccttgcagtgagtcatgacaaaaatatataaagtaaaacattaaaa

SEQ ID NO: 409461 - DNA, 408 bp, Homo sapiens
ctcctcccccaaatagggagacatctgaatttgaagccagtaagtcagcaaaaaattaaactatctgttgaagaaacccccctgggagatgacttacaaatgagttcctgatgagactatttatactttcgtggaccaggaataaataatatggtaagctgcagaataaaactgtcataacataaggaaaactacatggaacttgaaaaggatataggaaataaaatatcagggcacctctatgggctaggaaagagatgagattttggcagagataagcattctaattaatgatgaagcaggaaaaattctccaagtcttacctcagcacaactgaaatattaccccaatttatcaatcttcctttgctcatacctgtgtttaccaagtaacttcctgtttcctaat

SEQ ID NO: 409462 - DNA, 444 bp, Homo sapiens
tgttgtgttagtccaggagagtgatactaatgatagtttttatagttctagataaaaggatgaatataaagacatggcagaaggaaaatatgtgagctttggcatctgatcagtggggatgatctagataaagcaatctaaaaatgacgaagatttcaaactgccatgatgggaagcaaaaaatgatttgattttagatagagaagctcggaggttcccgtgggaaaatggtagaaatctgggtttaccacttgaaaggagagatatgccagggtttagggaatcatcttcagagaagtcatcattgaaattgctgaagcagctgatatctctgataaattatatagtaagaaaagagatcagggttgacatgagaccttggaggattgtctggctttaaggggcagaaagaggaagaggtgctaacaaagaatgcagcaaaaa

SEQ ID NO: 409463 - DNA, 766 bp, Homo sapiens
gtgtgtagagccggaactccaagggagagctattcaaatgagaagtatccaaatcagttagatcaatggtttgcatttttctaatgtttttctaaatttattttatcttcccaaattatctcgaagtgaactccactaattatatcattcagagatgcctggctttaaacttttaaatctctttttgggtaagctgttccctcttttgctctctcgctctgtgtatgtgtttaaacagattctattttaaaaagcctaaaggtcaaagtttgtgactttacgagcttggacatttcatttgtgaggcaactgttatttcggcttggcaatgttcctatccctattttacatagacaagctgttaaactgttagtttagttagattttgaatgtgagagacatgttctccaagcttcagggctgtgggattgtggaatgctgtgtgtggcaaaagatgaaatgagttcaatgatagtgaaatgtcctttgatatgtaggaaaatgcatgctgtaagtatggaacataaatatgtattgaaatgcaagtgttatacaccttgctctgagattttatttctgaaaagaagagaaaatgtttactgtttactgagtttttagaactgcttaaaaatgatatggttagaaacagattatatgtttataaccagtttcaaatttgttgcctttctagtaaatcatgaacaatgaaaccattgttcattataacaagggaacatttactaggagaaataaatgactatacttt

SEQ ID NO: 409464 - DNA, 220 bp, Homo sapiens
cctggttcctaataggccacagattgatacatgtccacagcctgggcattggggacccctggtctaaatgcccaatttaaaggcatagagtgaaaagcttgataaaaagtcaagaaacaattgtctgttgtcttcaagagacacagctcatatgtaatggcagccacaggctcaaagtaaagggatggaaaaagatctaccatgcaaatggagaacaaaa

SEQ ID NO: 409465 - DNA, 529 bp, Homo sapiens
aagagggactggacggctgagctgggcatccgacacgtactgctgaccatcaagtgcctgctgatccaccctaaccccgagtctgcactcaacgaggaggcgggccgcctgctcttggagaactacgaggagtatgcggctcgggcccgtctgctcacagagatccacgggggcgccggcgggcccagcggcagggccgaagccggtcgggccctggccagtggcactgaagcttcctccaccgactctggggccccagggggcttgggaggggctgagggtcccatggccaagaagcatgctggcgagcgcgataagaagctggcggccaagaaaaagacggacaagaagcgggcgctacggcggctgtagtgggctctcttcctccttccaccgtgaccccaacctctcctgtcccctccctccaactctgtctctaagttatttaaattatggctggggtcggggagggtacagggggcactgggacctggatttgtttttttaaataaagttggaaaagcaaaaa

SEQ ID NO: 409466 - DNA, 470 bp, Homo sapiens
actggaaaggtaattaaaagggtccttttactcccctatgccacatgtcacagtctttaatgtttaatgagagttgctctttgagtctaggatttagtgaaagacatttggcttggacaagaactaagacaaatgctgctaacatgattctattcaatttagtgctttaaatactttcaggaatggtggattattttcaaagtaaggtttgtggaagctgggaattttgaagtattttacctggaaattatctatcggaatgcttctgtatgctttaaaaaatgtatactctacatatggacacaaagaaaggaacaagagacactggagcctacttgagggtagagggtgaggattgaaaaactacctattgggtactctgcttattacctggatgatgaaataatctgtgcactgaagccccgcaacacacattgacctatataataaatctgcacatgtgtccctga

SEQ ID NO: 409467 - DNA, 490 bp, Homo sapiens
gggctgtgagctcaggaaagactggtaggacccaggctggtatctgaaattatgcccacaggcatcccaaggcccacattatccagagcctttactttgtattacgaatttttatttattacttttagtagcagagaaatctaaggatgaggcagaaaagtggtagagatcaagtaggagcagactggcaaagtgtggaaccagggtcagagatgggcaaatggattagcataaaatgtgctcaggacaaaagtgggaagacaatctcctttcaatcttggtgcaaatgttaactgcagacatccagcctttgtgtcagtccacaccaaaacttaagagtccttaataagggcgatgtgaacaagggggctgggtgccatttatcaatgtgctgcaaatggctggaaaaggcacccctcaccaaatactggatataaagaggtgataaggataaagaatttgggtaataaggaacatctatattagaatg

SEQ ID NO: 409468 - DNA, 395 bp, Homo sapiens
ggccatcttccctccccattaaggagacagctgtctttgcgggcatccaggagactggacagagagaagacaaaaaataaacatcactgagtgccagccttcagggtccggctggattggaacagcaaaccctctctgcctgcctctggcctcttcttgcccccttggattgaagaattggctcagggtgctgcctctgacataggttgcaaagagtgattctgccccatgccaaaccctttcgcgatgattgtctcatgtgacgcttacaattctgggagccaggcaggacagatagagtgatcatctccattttatggatgaggaaattgatccccaagagttgaagtgacttgcccaaggacatggtgagtaaggagtctggacttcccgca

SEQ ID NO: 409469 - DNA, 675 bp, Homo sapiens
attttcgagaactaagaatgctgatgtttgtaaactctgtagcacagtgtctggaaaatggaagatattcaatacatctagctattattataacaggtaataatttactattgtaaataaataaattaaaatcctgaggtttggtagaggaggaataatgcataggagatagtcctccaatctgtgtaagggtttcatttatgttcttagttagggtctctcctctaaactcactgcccccaaaccccaaactatcaagtccttgatcacagggacactgccatccacttcccaccacttaagaggcagtgcctggctccacagtgacggtttttgcttagtggtgatatttgaagctgtaggagggcgtgaagttgccaaattaaagaatgaagagcttggccatgggaaacacctgtatttatttacagtggagagagagagagagagaggagagagcagttgatgccagaaaaactaggatagtcagtctctacagcccaggaatgaaggagagttagtgcagcaagctgcatcacagtctgggaggacaaggagactagaaaaaaggaccagatgggatgagaacattgcctctcagagagacagtttcaggcacgtgtggggcagaatctggattgtagagttaaaatgtaggtggtggtgaggaagtgg

SEQ ID NO: 409470 - DNA, 301 bp, Homo sapiens
atactgagatcaacataatcatgaattcttctcccactgtaaagtttgaggaggtaagaatctccttgacttagcaaatttgggcttataaatgctaggtccaactagactttactggcctcaatcccttagcattatcctgcaaaatactgatgtatactttttggataatacctttgatctactttcagccaccattgtagggaattgttagtatgagaggttgacattttggttaaataatcacttggaaactgtgactcagcattagtcactggctttctgctgggttacattctct

SEQ ID NO: 409471 - DNA, 248 bp, Homo sapiens
tggtgttgagcacagtgtggatgctcaataagcagcagatgctaccatcctgattattatcactattatttcctccaccaccagcagcagccagggtcacacagctcgtcagggccagaacctgcctacagaggcccacaagacattttaatcaaggtccggggaacaggccagggctggattaagccaagttttgtttgtggggagtcacatggtccaaagctatgcgtgtgcacagccaagtaaac

SEQ ID NO: 409472 - DNA, 688 bp, Homo sapiens
tttttcctgtaaagacggtgttcgccttgttgcccaggtgggtcttgaactcctaggctcaagcggatccgcccgcgtcggcctcccataagtgttaggattacaagcgttagctaccccgcccggccgtcataggagacttttaaacaaagcagtaacacgatctgattctggatttgtgttgaaagcagagcaggcagggtttacagataattgttatgtaaaaagagggaaaagagctaagaaagactctaaatttttggattaagcggccgacggatgacgtcatttactgaaatgggtaagaccgaaggagaattaggccgggagagtgaaatttcagatggccatggacaaagcagataagccagtatggtgctcataaagacatcaggggaggggacgctcacacacaggcatataggtacccaataacccttgaaaacagattactaaaacaatcatttgttccttcctaagcaaacaacttaaggaaaatgacggccagccggcaagcccggagccgcacgctcgcgtcagggccggcctttccataccaaggggcggcacgtgcggcaccgcctcccgcccaggccccaccccgcatgccgagcttggcccaacctctcctcccacttttcccaaggcggcaaaagccggaaagtgggagtagatgagcacatacccg

SEQ ID NO: 409473 - DNA, 465 bp, Homo sapiens
ttgggaaaagaaaaagatgtgggaaactaatggaaaaatagtagaaaaaattaaatataggagaaagagggaatttgaatcgatcctccaaaatgtaatggaattttttcatttaaaatgtgtttgatgacaaccccaatggagtgattgctccgtcaaaatttatcctcggttccagctttttaaaaaagtattagtatttaccaatacatttttgcatatttgcaaaatatcttctacaaaagatctaattttcatatgtaagaaattgctgcgaaattgcagctgggtttataacagcgtactccaagtatgcaacacagagacttgtctggcactctcaaaaatcacatgcgacttctccgaattggcctttttcggaacaaaggttttctccaagctgccgggcagacatagagatgcacctagtaggaaaccagtgacctccaggacttctgcccctgg

SEQ ID NO: 409474 - DNA, 371 bp, Homo sapiens
gcaaccagttaactttgtccgagtttgttctctgggtcacagtgccacctagaggacgtgtctgtccttggctggttttcctgctgacaaaaaaaatggacttgattcacttcgatgaatgtacaatgaggccgaggcgggcggatcatctgaggtcaggagttcaagaccaccctggccagcatggtgaaaccctgtctgtacaaaaatacaaaaaaaaaattagcccggcatgatggtgcatgcctgtaatccagctactcaggaggctgaggcaggagaatcacctgaaccggggaggtggaggttgcagtgagccgagattgcactacggcactccagcctgggcgacagagcaagactccatctca

SEQ ID NO: 409475 - DNA, 435 bp, Homo sapiens
cggcacgaggccggagcgcgggccaagctggagatggatgatgctgaccctgaggaaagaaactatgacaacatgctgaaaatgctgtcagatctgaataaggacttggaaaagctattagaagagatggagaaaatctcagtgcaggcgacctggatggcctatgacatggtggtgatgcgcaccaaccctacgctggccgagtccatgcgtcggctggaggatgccttcgtcaactgcaaggaggagatggagaagaactggcaagagctgctgcatgagaccaagcaaaggctgtaggccccactggcccaccacagctgccatgccaccctctgcccgtatgaagaggtcactgggggatggagctggcacccacatgaatagctgtatgcactgtacttgtttcttaataaacttatttttaagcacagc

SEQ ID NO: 409476 - DNA, 438 bp, Homo sapiens
taggaacagccatggaatgttctaatgcttgaaatacagaccatagcatgcacccatgtgcatgccatgtatttcttgttgagagtttcttgggaaccagtgaatttggctggaccatcagaaaattttgtgacttctccctctgcctgttgtccaaatggtggagagatggacccttgtggccagagaacacactggtgatttctcagacttcccttagcattttcagaggatctcagggtgctctttccctttctcctccttattggcttctttgttcccatggaatcactgatgaagcccagccctcctggagttaagtgtggtcaaatggtaaaaaatcccaggtgtttgttgctattcatctttgtcttggacattttggatgactctcccctcctgggactagagacaaactgaactgactttccagggcct

SEQ ID NO: 409477 - DNA, 518 bp, Homo sapiens
gttgtggagataagaagacttaaaatacaatttaaaaatcttagggaagtaaatgcctgacacaaaccagacattgtaaggattaaataagataataaatgtacaccacttagaatggtgccaagtatatagtaattatacaatatatgtacattatattgctataattcattaaaaggaagtcacttattgacttccaattttaacatggtaaaaacatttccatacccccaaacataaaggtaaacaagaaacagaaacacattcaataacccacaaagacatttataaccctaagctaaaatgcatgaggatggaaaacatttgaaagaaaggtaaatgactcagcagaatgggaaaaggtcaagttaaaatgcctgcagaggaaactgttcatgtgagcaagctaaatcacccccagagaaccccaaaaggctccaaattatagaagcacctgtaatcaccaaaggcagaggactggggagggcaagataaagaatgcaaacaggggaaatgtc

SEQ ID NO: 409478 - DNA, 601 bp, Homo sapiens
tgtcatcccagctgcagactggaagagacctggaagatgaagtcgttgtcagctactctcatcctcacgtcaggctgcttcgccaaaggatggatcggctggataatttaacctgtcacctgttgaagaaacaggcctttagaccccagctgcctgcctacgagtccctggttcaggagatccaccactacgtcaccagcatcgccaaggcccctgctgttcaggatctgctcacacggcttctgcaggccctccacatagatgggccacggtctgcccaagtagcccagagccttctaaaggaggaggcctcttggcagcagtcacaccaccagttccggaagcggctgtcagaggagtacaccttctatccagatgccgtgagcccactgcaggcatccatattgcagttacaacatggcatgaggctggtggctctgagctccacacctcactccacagcagtatggttggtgcagacaggctggggaccctggccacagccttgctggctttcccatcggtgggccccaccttcccgacttactatgctcatgcagacactttgtgctcggtgaagtctgaggaggttctacgaggc

SEQ ID NO: 409479 - DNA, 429 bp, Homo sapiens
tgccattcttcccagctactaaatttctccctctccctcagggtaactttgacctaaatcttcagtgcctgcttgcctcaaccaggccttatgcagcggttacacagtcacctccagagcccatgttttatttaggaggaaatattgcccatttctacccgggtaataacctgccagccctatggggccaaagtaaacaccaggcccatggattaaggccttcggcaaggattaggctgcagttcactaggtactccttctgagtaggcccttgtaagcagtgagaaataaactattatgaaaaacaagttcctaatgaaaagataccaggtcctgagatcgaaactgctagtaaacaatttatatctggagggcactctcaatgctttcaagactctgaattatccagcggtggagttgggctgcagt

SEQ ID NO: 409480 - DNA, 3944 bp, Homo sapiens
  misc_feature (2331)..(2331): n is a, c, g, or t
cttttttcccgggaactaagtgttaaacatttaccagcacaccactgcctagacttgttaggaaattcacaagtgagaagaaattctgtgattccaggagatgaaagagggaagtgtaatgagaatatcaacttgagtattttatccgttgctttctttaattgggtcatttcagagggtgggtagattttgttaagacagttgaaatatttaggtaggtagaggggtgagtgcagttgaagagtaaaggctgtttggggcagacaaaaggatgatagcactctttcaagtgctctgccaccagcagtaaaagtcgggagaaggacctagcaccaggacacgtgatctgtccggcgtaagcgagtgctgagtcaaaggcctgcaattcaggcccctgctctggggcacggtcagtttcagccaggcccaactctctttcccaggtccatggcgtggatggcacccagaatccagcaggggagtgctggtggatacacctgggagggcctggtggaggatcatttgcgtgcagaaataaggaaatagacatatttgagctggaagaaaatcttacatgtctgatccaattctctcatttcacagataaggaaaaggggccccaaagagtgaagaggggatgtcctgaggtcatgaggctggcttacagcaaggatctggaccagacagcagggtgggaccctcagctgtccccatacttgctgcttgatattggataggttatttaggctctatgtgttttctcataaacacatagaggttaggtaaaaatggtggtgtgagaatgaactaatacatgtaaagagcttgcatgtagtaagctctcaataaatattaataatactgggcacagtggctcacacctgtaatcccagcactttgagaggccaaggcgggtggatcccttgaggtcaggagtttgagaacgccctgacaaacatggtgaaaccccatctctactaaaaatacaaaaaattagccaggcatggtggtgggtgcctgtaatcccagctgctcgggaggctgaggcaagagaatcacttgaacctgagaggtggaggttgctttgagcccagatcatgccactgcactccagcctaggtgacagaaccagacttcatctcaaaaaaaaaaattaataatatagagcccttgtgttgacactattctcttttacagccagaaagagagaaagattacagaaaataaaaatatattaatatattaaaggcataatactgtgaattaatactgattaattcaatatactattatatcaaaaaccaggatactaataataaataatatatggaaaaccaccatacacattggtaaaacattaacattttcaaatctccaatccaagaattttccccaaatccagattgtgcaggtattttagtgaatgattcaccctacagaattacttattacatttttctttaaacttcaatggatttgtagctgaatgagggatcaggtaatcaccagacatcttggaagggcacatgatccctcaggccttttcttggagaatgtttaaagaaacctcttccttcccattagggaggccgaccatgagtccctttgtgttgacagtgaaggtgtctggggctacacctctttcacatgctctgccaccagcagtaaaagtcagaaggccctggcacagggcacacctgatctgttcggcataagtgctgagtcaaaagcctgcaattaaggccagtggctgggaggaggcctggtcccagcctctccttgatttgcctcaccccacccaaacacaggtcatgttcatcatctgctagccagcaaggaagatgtgtggggtacaggttacagggactgagcccggagcctgactttctgggctctaccactcgttgtcttcatttccaaaggcaaagcacttgacctctctgagcctccatttctcatccataaaatggggatgatgataaaagtgactgcttcataggattgttgagaggatcaactcaagtaatatgtgaaaagtggcacataataagtactctgtttcatgtttctaattaattttattttttttaggttttttactgtggtaaaatatatgtaacataaaatttactattttactatttttaagtgtaagtggcgttgaatacattgtggcattgaatacattcacactgtcatgcaaccatcaacaccatccacctccagccttcttcgtcatcccaaactgaaactctactcattaaacaataactcctcattcccgcttccccttagcctctgggaaccattgttctttgcccatttttaaanggaggttgttgctgggttgtgggagttctttattctggatattaatcctttaccaaatagataatttgattttttttcctattctgtgtgttgccttgactatgtcctttcatgcacaaaatattttaattttgatgaagtctagtttacctattttttcttgtattgcctgtgttttggtgttaattccaagaaatcattgcaaaattcaatgtcatgaaattttgcccctttcttctaagagttttatagttttagctcttatgtttaggtcattgatgactttgagttaatttttgtttatgatgtaaggtaatggtacaacttcatccttttgcatgtggatatccagttttcccagcactatttattgaaaaaaagactgtcttttctccattgagtggtcttggcatcctagttgaaaatcatttgaccctatatattaaggtttatttctgatttcattggtctatgagtctgtctttatgccaggaccactctgttttgattacggtagctttatagcaagttttgaaatcaggaagtgtgagaccttcaactttgttcttcatttttctggatgttttggctattctgggccccttgagatttgagaaagagttccctctactggcagatctaagacagtctgttgactcaggtacctgataatttttgaagatgcatttaagaagttaaactattgagaataaaaaaatcttagctaggctttattttatttttctgatcggttagagactcttggagacttctctttcttctcaatcaatttgactgaggtataattaaaaaaaaataaaacatactgatatggcttggctgtgtccccacccaaaatctcatcttgaattataatccccataatcatcataatccccacgtgtcaagagagagaccaggtggaagtaattgaatcatgggggcagtttccccgatgttgttctcgtgatagtgagtgagttctcacgagatctgatggtttatgtgtttactagttcttcctgcgttaattttccttcctgccaccatgtgaagaaggggtcttgcttccccttcgctttcttacacgattgaaagtttcctgaggcctccccagtcctgcggaactgtgagtcaattaaacctctttcctttataaattacccagtctcggacagttctttatagcagtatgaaaacagactaatgcatatacagacacatacacctaagtaaccatcactatcgcaatcaggatatcaaatatttctatcaacccaaaaagttcctttgtgatttttgtagtcagtccccactcttgattccccatgccccaggcaaccacaggtctgctccccgtcatatagacgagtgttgtctgtgttcagatttcaaatacatggaattgcacaatatatgctcctatgtctaaatttttttcacttagcataatgttttcgaaattcattcatgttgtatttatcagtagtttttagcattgtatcgcactgtggtatttcattgtatatatcatcatttgtttatccattgaccagttgaacatttgggctatttccagtttggggctgttttgaataaaggtgccaagttca

SEQ ID NO: 409481 - DNA, 1119 bp, Homo sapiens
  misc_feature (29)..(29): n is a, c, g, or t
  misc_feature (33)..(33): n is a, c, g, or t
  misc_feature (41)..(41): n is a, c, g, or t
  misc_feature (43)..(43): n is a, c, g, or t
  misc_feature (50)..(50): n is a, c, g, or t
ggaaaggttaattcactgaacagctaacntatnattggggngncgacccnttggggcagtgttttaaaccgcgtgcgcggatactcgtaaacatacattatcgagtatgataagcaacggcgaccgaatcgtcagaatggcagatctaagacagtctgttgactcaggtacctgataatttttgaagatgcatttaagaagttaaactattgagaataaaaaaatcttagctaggctttattttatttttctgatcggttagagactcttggagacttctctttcttctcaatcaatttgactgaggtataattaaaaaaaaataaaacatactgatatggcttggctgtgtccccacccaaaatctcatcttgaattataatccccataatcatcataatccccacgtgtcaagagagagaccaggtggaagtaattgaatcatgggggcagtttccccgatgttgttctcgtgatagtgagtgagttctcacgagatctgatggtttatgtgtttactagttcttcctgcgttaattttccttcctgccaccatgtgaagaaggggtcttgcttccccttcgctttcttacacgattgaaagtttcctgaggcctccccagtcctgcggaactgtgagtcaattaaacctctttcctttataaattacccagtctcggacagttctttatagcagtatgaaaacagactaatgcatatacagacacatacacctaagtaaccatcactatcgcaatcaggatatcaaatatttctatcaacccaaaaagttcctttgtgatttttgtagtcagtccccactcttgattccccatgccccaggcaaccacaggtctgctccccgtcatatagacgagtgttgtctgtgttcagatttcaaatacatggaattgcacaatatatgctcctatgtctaaatttttttcacttagcataatgttttcgaaattcattcatgttgtatttatcagtagtttttagcattgtatcgcactgtggtatttcattgtatatatcatcatttgtttatccattgaccagttgaacatttgggctatttccagtttggggctgttttgaataaaggtgccaagttca

SEQ ID NO: 409482 - DNA, 994 bp, Homo sapiens
  misc_feature (147)..(147): n is a, c, g, or t
tggacggggtcccctccctggagctggggttgccaaggaaacagagcgagatgcagatgaaggccggtgtgacctgtgaggtgtgcatgaacgtggtgcagaagctggaccactggctcatgtccaacagctctgagctcatgatcnacccatgccctggagcgcgtgtgctcggtaatgcctgcctctatcacgaaggagtgcatcatcttggtggacacctacagcccctccttggtgcagcttgtggccaaaatcaccccagagaaggtgtgcaagttcatccgtctgtgtggcaaccggaggcgggcccgggcagtccatgatgcctatgccatcgtgccgtccccagagtgggacgcggagaaccagggcagcttctgcaatgggtgcaagaggctgctcacggtgtcctcccacaacctggagagcaagagcaccaagcgagacatcctggtggccttcaagggtggctgcagcatcctgccgctgccctatatgatccagtgcaagcacttcgtcacccagtacgagcccgtgctcattgagagtctcaaggacatgatggaccccgtggctgtgtgcaagaaggtgggggcctgccacggtcccaggaccccactgctgggcaccgaccagtgtgccctgggcccaagcttctggtgcaggagccaggaggccgccaagctgtgcaacgctgtgcaacactgccagaagcatgtatggaaagagatgcacctccacgctggggaacacgcgtgaccgtggctgccagagacccagagcctgctagcgaggcccatgagaatggggatgatcatacctgcctcacaagaatgttgagacaattcacagagacgttctggagcccctttcccccgagaccggcattcatgagtctgctgggaccagaaaacccatctcaggggcccagcggggcacccaggagagtctggcggtgcaagcgctgtataaaccacaagcgttctccaaa

SEQ ID NO: 409483 - DNA, 1819 bp, Homo sapiens
  misc_feature (147)..(147): n is a, c, g, or t
tggacggggtcccctccctggagctggggttgccaaggaaacagagcgagatgcagatgaaggccggtgtgacctgtgaggtgtgcatgaacgtggtgcagaagctggaccactggctcatgtccaacagctctgagctcatgatcnacccatgccctggagcgcgtgtgctcggtaatgcctgcctctatcacgaaggagtgcatcatcttggtggacacctacagcccctccttggtgcagcttgtggccaaaatcaccccagagaaggtgtgcaagttcatccgtctgtgtggcaaccggaggcgggcccgggcagtccatgatgcctatgccatcgtgccgtccccagagtgggacgcggagaaccagggcagcttctgcaatgggtgcaagaggctgctcacggtgtcctcccacaacctggagagcaagagcaccaagcgagacatcctggtggccttcaagggtggctgcagcatcctgccgctgccctatatgatccagtgcaagcacttcgtcacccagtacgagcccgtgctcattgagagtctcaaggacatgatggaccccgtggctgtgtgcaagaaggtgggggcctgccacggtcccaggaccccactgctgggcaccgaccagtgtgccctgggcccaagcttctggtgcaggagccaggaggccgccaagctgtgcaacgctgtgcaacactgccagaagcatgtatggaaagagatgcacctccacgctggggaacacgcgtgaccgtggctgccagagacccagagcctgctagcgaggcccatgaggtgggtgctttccccatccccatttcacaaatgaaaaactgaagctctgaggagggaggctgggaaggagcagagctgaagttcaaaaccaagtattcctgatcccgaaagcctctctcttaacaacggtgccgcacagctttgcccttgaaagcatctctactggaccggaacacactcatgtgccccgctccctgacccagccaaggctgccctctcatctccaaggctgagatgttgccggtggtcccatgagagcctgcccatgggctcaggtgcccctttaccttctgctggatggacatctggctgtgagccaggctggggtcatggccggggtgagcggaggcaggggtggacggaggcttcgagggcccatcactagtaggttcattacctcttgccaacagccggggggtgggagtctgggtctcgctcaggccagagcttctcaacctggagtccctgggggtggctgccaaaggtgtgtatgacaagcacgtatccctggacatttccggggagaggtctggggctttggtcacattctccaagggctgctgggcttcggagcagtccccccccatgtctcagccactacagggtccctctctctccttgcaccccagaccctccgctgccctggtaatgagcagaaggaaagtcttggggtgtgctcaaagtcaggagagcaaaatatgccaggcaaaagctcccgggaaaagccggaggagtctggggtggccaccgggatgtggagcagcgagggcaaagacggtgaacacagccctccagctgtctgagcctcagttttctaatctgtagaatggggatgatcatacctgcctcacaagaatgttgagacaattcacagagacgttctggagcccctttcccccgagaccggcattcatgagtctgctgggaccagaaaacccatctcaggggcccagcggggcacccaggagagtctggcggtgcaagcgctgtataaaccacaagcgttctccaaa

SEQ ID NO: 409484 - DNA, 551 bp, Homo sapiens
ttatacaggtgttagaatgtgaggaatacacaacctatgagatggtgctatgtacatatttgtttattttgttgaatagctggccagtacaggagagttccattaaactgaaagtagctcatttaaagcaacatacatcactaaagcttaggcctccattgcacagaatggcgattgtagttaataattcttatatatttcaaaattggtaaaataataaattttaaatgttcccatcacaaaaaataagtatatgaggtgatggatatgctacttagtttgagttcatcattccacagtggagatatatatcaaagtatcatattgtaccctaaatgtatacaattattatttgtcaattaaaaactgtatttaaaattataaaaaataaataaataataagcccaacatatagtcacagagatggctagtatcaacaaatgatatactttttcccaccacaactataaataacaattcaagtccattttatttagtttttgcttttggtcttttgcatttcaagttaataaaatataaactatttggca

SEQ ID NO: 409485 - DNA, 343 bp, Homo sapiens
ctcatgctttccaagctccttcaaatgcaagtaataataatcaaaggaaaacgaagccccgtatgtttaggaacagtgccatgctttgctgactggcgaagctctgtatctttaggggcggtgtcatgctttgctgactgtcaaagccctgtatctttagggacagtgccatgctttgctgaccatggtgctggctgtctaccgctggtccagacccacctccatcctcgccacgctctgtgttgcaggaggctgactgcatgggccagaccccagcggcttctctgctctttggcttctggtcaggttggcagccagggagagagagtagaagggggcagga

SEQ ID NO: 409486 - DNA, 871 bp, Homo sapiens
aaaatgaagcatttaaatttattcattaatcattcatctccagctcattgaaaactttaaacttccacaaaattaagatagaacattgaggagtgattgagagagacagctctcagtgagctaaaaaagactggtaaacacaaaaacaaaagtacattagacagagtgtctcaaagtgtcacatgggcatagatattgttacagtttacacaaactttaagtactgaatggcaaagcctttatttgggccaagacgatagggaaatctggggaagcgaacagtcactgtcaacaccgccagtaattattctctcttccaattaatggtgacatagattaattatcagatgaggcaaagccaattgcaatcagtcacccagagctgaaattagatcgttcctgacagcagcatgaaagtcacctgtttcattgttatggatttgctgtgagtaaaagagtggcaaagcatgctgggaggtgagtgagtttttcgttcatggaagtgtgaaatggcaaacaggtgaatgtccaattacactgttatctgaactgtgtgacttttcttgtcttttatttcagcatccaagatacattggttgtttgcttaaccatcgttttcgcatgtgccatctgtcaaagtctggaagaaacctaagatgtgttgcattaaatttgaagattcctcctgcacagctaatattttctgaatactctcctgagagtctgtctggaagttggccagcctcatctggctgaagaggaccaccagtttgaagtgctcctgccacagtgtgtgcatccttctctgcagctgacagagcatgaggaaggggaaaatctgatcctgggttgttattttgcagagcaagtt

SEQ ID NO: 409487 - DNA, 494 bp, Homo sapiens
agttcagaggctattgaaatgctccagccctatattaggtattgagggttcagggatgaactaagctgatctggttcctgctctctaggctgtagaagatggcaagtgctgtggacttcaaagaaaagatttctgaagtgtcatgttatgacaattgtgcatccaagatacattggttgtttgcttaaccatcgttttcgcatgtgccatctgtcaaagtctggaagaaacctaagatgtgttgcattaaatttgaagattcctcctgttcagaagcaagaaacaaacaaaatcaataagtactcattaattaagaaaacagagcattattatgaaatcatacacatggaaaacttatcaacaataaaaataacgacaaacaccattacattctcctttataggagacaaacagtataaaccccaaggaagagtgatttctctatgatctagtaagttctaaaaattaaagtccaactaactttaaggtagaga

SEQ ID NO: 409488 - DNA, 230 bp, Homo sapiens
gcagaggttgcagtgaactgagatcacaccactgcactacagcctggcaacagagcaagactccatctcaaaaaaagtgactgctatagattgaacaaagcaaatacaaaagtagaggagctaaacttaaaagcatatgtaaacaagaatgaatgtaagctagaataaagatcaagtctctcacacataccaagtttaggctggggcttgtaacccatttctgaccacct

SEQ ID NO: 409489 - DNA, 501 bp, Homo sapiens
gagagccaaacccagcaaacatcatgtcagagaaaaagaactgtaagaactcgtctacaaataacaaccagactcaagacccttctagaaatgagctacaggtccctaggagcttcgtggaccgcgttgtgcaagatgaacgagacgtccaaagccagagttcctccacaataaataccctccttaccttgctcgattgccttgctgactacatcatggagcgggtaggcttggaggccagcaacaatggcagtatgcgcaacacttcacaagatagggagagagaagtggacaacaaccgtgagccccacagcgctgagagtgatgtgactcgctttttgtttgatgagatgcccaaatccaggaagaatgactgaagactgggtcccagagccttgaagggaacctcacaggcttagccagggcaaaaatgtgtcacagctgaggaatatctgctgttgtcatcaacaagtgctattaaaggatgtaaatccatgagta

SEQ ID NO: 409490 - DNA, 566 bp, Homo sapiens
gctgaaaatggtgataatgaaaagatggctgccctggaggccaaaatctgtcatcaaattgagtattatcttggagacctcaggttgccacggacaagtttttaaaggaaaagataaaactggatgaaggctgggtatctttggagataatgataaaattcaacaggttgaaccgtctaacaacagactttaacgtaattgtggaagcattgagcaaatccaaggcagaagtcatggaaatcagtgaagataaaactaaaatcagaaggtctccaagcaaatccctacctgaagtgactgatgagtattaaaatgatgtaaaaaacagatctgtttatattaaaggcttccctactgatgcaactcttgatgcatgaaagaatggttagaagataaaggtcaagtactaaatattcagatgagaagaatattgcataaagcatttaagggatcaatttttgttgtgtttggtagcattgaatctgctaagaagtttgtagagacccctggccagaagtacaaagacacagacctgctaatacttttcaagaacgattgctttgcca

SEQ ID NO: 409491 - DNA, 432 bp, Homo sapiens
aggaattagaaactccacatctaacttagttgccttgaggaagcagctatggcaaccagaaagttcccaggatcctgtctcctaaaggtagctgaagcctaatcgactgcagggggcctttctgtgggaagataacagcagcgcagaggcaaagaaaagggaaggcacggcggtggcccttgtggggcgttctgggagaagagattaattcaccaagtccctgcgcggcacagcaggattacggggcttttacaaaactgaagacaaaatgaagagcagcagcttctagaataaggccaagcaccaaattgaagactcggtggagactatcacttcagatgatagcatgtctccaagcaagacaaatgaaagggaaaatgaagcaaagggagagtggggagctacaataaaaaccgagctattctttgccaa

SEQ ID NO: 409492 - DNA, 670 bp, Homo sapiens
gaagagagagccccgaggcttcctcagatatgtcctgtccttcctgtcccttcaccctcccaactggggtcaggacgtcccatgcccatcccctgctcctgctggggcccaggcaggtcagatggaaggtgcaaggtactgcagcactgagtgtggaacccctgccccgaagcatgtactactctcctgggcagccccacccactttagggtacaccctcattccatatttcttatacgccaggggtcctcaacccttgggccaccaactgatagcagtccatggcctgttaggaactggatagcacagcaggaggagattggtgggcgagcaagcgaagcttcatctgtatttacagctgctccccacggctcagggtaccacctgagctctgcctcctgtcagatcagcagaggcattagattcccataggcacgtgaaccctattgtgaattgtatgggagggatctaagttgaatgctccttatgagaatctaatgcctgatgatctgtcattgtctcccatcacccccaaatgggaccctctcgttgcaggaaaacaagctcagggctcccacagtttctacattatggtgagttgtataattatttcattatatattacaatgtaataataatagaaataaagtacacaataaatgtaatatgc

SEQ ID NO: 409493 - DNA, 311 bp, Homo sapiens
atctccaccaccctttatcttaacccatacattcctttctactgacaatagctttttcaaccaattgccaatcagaatatatttaaatctacctatgatctggaagtgccctgctccctttgagttgtcccacccttccagatcaaaccaatgcaaaccttacatgtattgattgatgtctcgtgtctccctaacatgcataaaagcaaactgtaccccaaccatcttgagcatgtgtctgcaggacctcctgaggctgtgtcacgggtgtgtccttacccttggcaaaataaagttaccaaattgattga

SEQ ID NO: 409494 - DNA, 681 bp, Homo sapiens
gtctcaaaaaaaaaaaaaaaggctagtttattagtcaacagttttccattcttgctctgagacagactactggagacagcagtacagaaatattagcatgccttatgtttgattaactaaggcaagcataactcaaagctgcaaagaatcccttcccaaatttgagaatggtttaaaatcttccttatcacttggctactgcaccaaatacaaatgtatcaacttagaaaaatcctatacagatcagagttgaatgacaactaccaatttcgttgggaaaaatatccctgcattcaaaatgctaaaaaccacacatgaggttaacaactgtttatagtgctactcaaagggctggtcctggtaagatgtggataaatcaacgcaccactttcttcactgagagttttgctaccaggaaaaaaaaaagtcaccatctgaattaacagtgtggttagtggtgtaatttctttatctcattccacactggtaattgacagttcacagactggcagccagtgcaggccccacctgaggacaacagtggtacagaaacaaatgttttaaaaaatgcgctaaagctcatctaataccaagaaagcagtccatttctctggatatctctactagaaaaaagttctctctttacgttagaaagacttaatcaacctgctctacattcag

SEQ ID NO: 409495 - DNA, 608 bp, Homo sapiens
aggtcatagaatcttccctctcctccctctgtctcctcattgccacagccaaccggctcccacatatctgcacacacttaaatacaaaggccgggaagggtcagaccaccatccgggtactctaagtcctccctcccccttctccttcacccccaagtgtctcccacgactgccctccccgacctctagctgaccatggcatcagaggcagaaaaaacattccatcggtttgctgcgtttggagaatcatcaagcagtggcactgaaatgaacaacaagaacttctccaagctgtgcaaagactgtggcatcatggatggcaagacagtcacctccacggacgtggacatcgtgttcagcaaagtcaaggccaagaacgcccgaaccatcacgtttcaacagttcaaagaggcagtgaaggaactgggccagaagcgcttcaaagggaagagtccagatgaagtcctggagaacatttatggactcatggagggcaaagacccagccaccactggcgctacttggatgctctcgtctcgcctggacagcacacacactccaactccagtaagactcaactcaaatatatctcttatacaacttcaaga

SEQ ID NO: 409496 - DNA, 768 bp, Homo sapiens
ggcaactttccaacccaacaaacctttttaaaaagtttaccaaaaaagggcccgggaaggggtcagaccaccatccgggtactctaagtcctccctcccccttctccttcacccccaagtgtctcccacgactgccctccccgacctctagctgaccatggcatcagaggcagaaaaaacattccatcggtttgctgcgtttggagaatcatcaagcagtggcactgaaatgaacaacaagaacttctccaagctgtgcaaagactgtggcatcatggatggcaagacagtcacctccacggacgtggacatcgtgttcagcaaagtcaaggccaagaacgcccgaaccatcacgtttcaacagttcaaagaggcagtgaaggaactgggccagaagcgcttcaaagggaagagtccagatgaagtcctggagaacatttatggactcatggagggcaaagacccagccaccactggcgctactaaagcaacaacagtgggtgcagtggaccgtttgacagacaccagcaagtacaccggcacccacaaggagcgctttgatgagagtggcaagggcaagggcattgcgggacgggaagagatgactgacaacacaggctatgtgagtggttacaagggttctggcacctacgataagaagaccaagtagagaggagcttcatctcagcctgctagccccctgaccctgcatgtttaacaccagggagcttggaaaacaataaacatctgtgtgtgcagcagccaaaa

SEQ ID NO: 409497 - DNA, 1063 bp, Homo sapiens
aggtcatagaatcttccctctcctccctctgtctcctcattgccacagccaaccggctcccacatatctgcacacacttaaatacaaaggccgggaagggtcagaccaccatccgggtactctaagtcctccctcccccttctccttcacccccaagtgtctcccacgactgccctccccgacctctagctgaccatggcatcagaggcagaaaaaacattccatcggtttgctgcgtttggagaatcatcaagcagtggcactgaaatgaacaacaagaacttctccaagctgtgcaaagactgtggcatcatggatggcaagacagtcacctccacggacgtggacatcgtgttcagcaaagtcaagtgaggagccaaaaatatggaggtgggggtgagaagaacctgcgaggtagttggccacggaagggttcacgtggtggaacatttgcagtgggcctaccaagcaccacagggtacctggcgctgtgctatcctttgtcttcgagacactcactgattgataggacaaaagaggccaaatctgagtgaggcaagagttggaccttggaaggtaatgcattcatgctccaaagtttctggatttctgtctaactgaccagggccaagaacgcccgaaccatcacgtttcaacagttcaaagaggcagtgaaggaactgggccagaagcgcttcaaagggaagagtccagatgaagtcctggagaacatttatggactcatggagggcaaagacccagccaccactggcgctactaaagcaacaacagtgggtgcagtggaccgtttgacagacaccagcaagtacaccggcacccacaaggagcgctttgatgagagtggcaagggcaagggcattgcgggacgggaagagatgactgacaacacaggctatgtgagtggttacaagggttctggcacctacgataagaagaccaagtagagaggagcttcatctcagcctgctagccccctgaccctgcatgtttaacaccagggagcttggaaaacaataaacatctgtgtgtgcagcagccaaaa

SEQ ID NO: 409498 - DNA, 906 bp, Homo sapiens
aggtcatagaatcttccctctcctccctctgtctcctcattgccacagccaaccggctcccacatatctgcacacacttaaatacaaaggccgggaagggtcagaccaccatccgggtactctaagtcctccctcccccttctccttcacccccaagtgtctcccacgactgccctccccgacctctagctgaccatggcatcagaggcagaaaaaacattccatcggtttgctgcgtttggagaatcatcaagcagtggcactgaaatgaacaacaagaacttctccaagctgtgcaaagactgtggcatcatggatggcaagacagtcacctccacggacgtggacatcgtgttcagcaaagtcaaggccaagaacgcccgaaccatcacgtttcaacagttcaaagaggcagtgaaggaactgggccagaagcgcttcaaagggaagagtccagatgaagtcctggagaacatttatggactcatggagggcaaagacccagccaccactggcgctacttttccctggttacctatgcaagaaacctgaaagtgatcctagacccctccacctccccaatcccagctacggggaggcggtcctgcatggtggttaagatcaaggcttttgagtgaaacagaccaggaattgaatcctgcctctgcagcttacaaactgcacaccatctatctgtttacgaaaccactgaaagcttccttgtttcatctgttcatgaggatagtattttttactcacggcagtatgaggatccattaagatgtatatcaagagtttttagaccagtgcccggcacatgtggatgctctcgtctcgcctggacagcacacacactccaactccagtaagactcaactcaaatatatctcttatacaacttcaaga

SEQ ID NO: 409499 - DNA, 865 bp, Homo sapiens
aggtcatagaatcttccctctcctccctctgtctcctcattgccacagccaaccggctcccacatatctgcacacacttaaatacaaaggccgggaagggtcagaccaccatccgggtactctaagtcctccctcccccttctccttcacccccaagtgtctcccacgactgccctccccgacctctagctgaccatggcatcagaggcagaaaaaacattccatcggtttgctgcgtttggagaatcatcaagcagtggcactgaaatgaacaacaagaacttctccaagctgtgcaaagactgtggcatcatggatggcaagacagtcacctccacggacgtggacatcgtgttcagcaaagtcaagtgaggagccaaaaatatggaggtgggggtgagaagaacctgcgaggtagttggccacggaagggttcacgtggtggaacatttgcagtgggcctaccaagcaccacagggtacctggcgctgtgctatcctttgtcttcgagacactcactgattgataggacaaaagaggccaaatctgagtgaggcaagagttggaccttggaaggtaatgcattcatgctccaaagtttctggatttctgtctaactgaccagggccaagaacgcccgaaccatcacgtttcaacagttcaaagaggcagtgaaggaactgggccagaagcgcttcaaagggaagagtccagatgaagtcctggagaacatttatggactcatggagggcaaagacccagccaccactggcgctacttggatgctctcgtctcgcctggacagcacacacactccaactccagtaagactcaactcaaatatatctcttatacaacttcaaga

SEQ ID NO: 409500 - DNA, 631 bp, Homo sapiens
ggcaactttccaacccaacaaacctttttaaaaagtttaccaaaaaagggcccgggaaggggtcagaccaccatccgggtactctaagtcctccctcccccttctccttcacccccaagtgtctcccacgactgccctccccgacctctagctgaccatggcatcagaggcagaaaaaacattccatcggtttgctgcgtttggagaatcatcaagcagtggcactgaaatgaacaacaagaacttctccaagctgtgcaaagactgtggcatcatggatggcaagacagtcacctccacggacgtggacatcgtgttcagcaaagtcaaggccaagaacgcccgaaccatcacgtttcaacagttcaaagaggcagtgaaggaactgggccagaagcgcttcaaagggaagagtccagatgaagtcctggagaacatttatggactcatggagggcaaagacccagccaccactggcgctactctgcttccaagaacaggatggaagaatatatttggagtaaagagatgaaccagatgtggagtggatgctctcgtctcgcctggacagcacacacactccaactccagtaagactcaactcaaatatatctcttatacaacttcaaga

SEQ ID NO: 409501 - DNA, 434 bp, Homo sapiens
tatctgggccctaagaaagcagcaccccatgccagtggcagagcaagagctccaagcacttgttctaagtatctcgggccatctttggggaagggatatgacagcgtaaggaaaggaagagagctcaaatccatccctggcttgcagaaagcaacaacagtgggtgcagtggaccgtttgacagacaccagcaagtacaccggcacccacaaggagcgctttgatgagagtggcaagggcaagggcattgcgggacgggaagagatgactgacaacacaggctatgtgagtggttacaagggttctggcacctacgataagaagaccaagtagagaggagcttcatctcagcctgctagccccctgaccctgcatgtttaacaccagggagcttggaaaacaataaacatctgtgtgtgcagcagccaaaatct

SEQ ID NO: 409502 - DNA, 641 bp, Homo sapiens
tcctcattgccacagccaaccggctcccacatatctgcacacacttaaatacaaaggccgggaagggtcagaccaccatccgggtactctaaggtacataaaagaggtaggggaaagagaggatcattcagtaggtaggatccacactggtatctccaatgctgggaatgggagactcatgctgtagttgcgtaggtgcaatgggagctgggagggagaaaggagagagcaacagggaagaggggagctgttcctgttgctgactgattttaccataacactcatcctcattactccacagtcctccctcccccttctccttcacccccaagtgtctcccacgactgccctccccgacctctagctgaccatggcatcagaggcagaaaaaacattccatcggtttgctgcgtttggagaatcatcaagcagtggcactgaaatgaacaacaagaacttctccaagctgtgcaaagactgtggcatcatggatggcaagacagtcacctccacggacgtggacatcgtgttcagcaaagtcaagtgaggagccaaaaatatggaggtgggggtgagaagaacctgcgaggtagttggccacggaagggttcacgtggtggaacatttgcagtgggcctacc

SEQ ID NO: 409503 - DNA, 1180 bp, Homo sapiens
atcctctggacaaaccagccagcctctccagagcaggcgtgtgatctctgtacccccgcagtggtcagaatatggagaacttctcactcctcagcatctctggacctccaatctcttcctccgccctgagtgcttttcccgacattatgttctctcgtgccaccagcctgccagacattgcaaagacagcagtacccactgaggcatccagcccagctcaggccctgccaccccagtaccaaagcatcattgtcaggcaagggatacagaacacagtgctctcaccagactgcagcttgggggacacccagcacggagagaagctgaggcggaactgcactatctaccggccctggttctccccctacagctacttcgtgtgtgcagacaaagagagccagctggaggcctatgacttcccagaggtgcagcaggatgagggcaagtgggacaactgcctttctgaggacatggctgagaacatctgttcgtcctcttcctccccagagaacacttgccctcgagaagccaccaagaaatccaggcatggcctggactccatcacatcccaggacatcctaatggcttccaggtggcacccagcacagcagaatggctacaagtgcgtggcctgctgccgcatgtaccccaccctggacttcctcaagagccacatcaagaggggcttcagggagggcttcagctgcaaggtgtactaccgcaagctcaaagccctctggagcaaggagcagaaggcccggctgggagacaggctctcctccggcagctgccaggccttcaatagtcctgctgaacaccttaggcaaattggcggtgaagcctacttatgtctctagagagatgccaataaagttagtcacagccttctgtccagtctgaggtcaccccgcacagcctgctgtccttcccagaacccggctctcatcacctttggctaatggttgcctagcaacaccaggcacacaccctcccctttctctcttttaaaaataaagacaatacttgaagtttgggaaaatcatctaagatagaggttctcaaaggtgcccagctggcagtaccagcaacccctgggaactctcaggccctcctcagacctactgaatcagaaactatgggtctggggctggcggtctatgtcctaaccagccctccaggt

SEQ ID NO: 409504 - DNA, 888 bp, Homo sapiens
atcctctggacaaaccagccagcctctccagagcaggcgtgtgatctctgtacccccgcagtggtcagaatatggagaacttctcactcctcagcatctctggacctccaatctcttcctccgccctgagtgcttttcccgacattatgttctctcgtgccaccagcctgccagacattgcaaagacagcagtacccactgaggcatccagcccagctcaggccctgccaccccagtaccaaagcatcattgtcaggcaagggatacagaacacagtgctctcaccagactgcagcttgggggacacccagcacggagagaagctgaggcggaactgcactatctaccggccctggttctccccctacagctacttcgtgtgtgcagacaaagagagccagctggaggcctatgacttcccagaggtgcagcaggatgagggcaagtgggacaactgcctttctgaggacatggctgagaacatctgttcgtcctcttcctccccagagaacacttgccctcgagaagccaccaagaaatccaggcatggcctggactccatcacatcccaggacatcctaatggcttccaggtggcacccagcacagcagaatggctacaagtgcgtggcctgctgccgcatgtaccccaccctggacttcctcaagagccacatcaagaggggcttcagggagggcttcagctgcaaggtgtactaccgcaagctcaaagccctctggagcaaggagcagaaggcccggctgggagacaggctctcctccggcagctgccaggccttcaatagtcctgctgaacaccttaggcaaattggcggtgaagcctacttatgtctctagagagatgccaataaagttagtcacagccttc

SEQ ID NO: 409505 - DNA, 863 bp, Homo sapiens
ggcagatcactgaagcatcactcctgaatgttcctctgtaccctcaatgtgcatttgcactaccagtgatctcaagaattctagaaaatgaaaactggattaccatcaccaacgtctaggaactgtgagtcctatggctattgatatctaacatcctggcttcactcacatggatgagccccacctggaatgcctagaagacgtgggacagctggatctctctccacacggtttttcattgttgcctcaggttccaataaaagcaaaagctgcaaggtcttctgaggcaaagacttagaaataccacaatgttacttctgctgcattctgttgataaaagaatcccacaatgccagcttcatttaaaggggtaaagatatagattattcaccttcgatgggaggaactgcaaatgatgtaattagtgataatttttaatatactgtaatgtattgacttatctttaaaaaatgaaaaaataaacaaaaactaaaagcaaaacaaaactataatagaaaacaattgcttctggaggaggaatgcaatggggaaaaggttatagaaacaaaagctacattttatttgaatatacctgttttaggtttgaccctggtaacatttgatattttacataattatatcattatttaaaattaaattttaaaacaccaatacccataacagaaaagtttgataaaagaggtgaaatataaatataaatatattaagtttgcattataatcacacagagatgaattgtgtcagttactcaaacacagatatttgactatacaacctttataagatatcctaaggacaaaaaaacatgcaaaaatatatattgaactgttttaaaattatat

SEQ ID NO: 409506 - DNA, 962 bp, Homo sapiens
gctctcattctgtcttgccgccacaatgtaagaattgtctctcaccctctgccatgtaagaattctctttcaccctctgccgtgatcgtgagaccttccccagccatgtgaaactggtctcactctgtcgcccaggctgcagtgcagtggtgtgatcatggctcaccgcagccttgacctcctaggctcaagcgatcctttcacctcagcttcctaagtagccaggactacagttttcagctttcctccactgttttgggaaacgtcaccttcttatcttggaagagtaatctcaaaattgaagcatcttagatccaacaagaattaaaaggatgggaagtccttgcagccatccaatagagtcagaagactttggattttggagtctgtgagattatcttacagagcaagactgcagatcaagattttccaacgtggtgctgacttttttgagaacagttaatgagaactaggaaagtccttgcagaccatccagtccagcggctttcaaatggaacatgtgaaaggacaacagaatcacatggattcttttctgaactgcttttttccagtgatgccatattctataagacttcatgtgaaggtgtgacggaggacgggtaatgtctgaatcttccaggcaatgagagggatggtgtgagtctggaaattctttgtgatggtctgagactccccttactccagttaagaacactgacttaattcgatctggttttttttaacaaatggcctctgagacgtagagcagtgaggataaggactcttacccggttacagagtggagtaagggctagaactcaactcttaaaaatttcaaatgcaatgttctttctacaatattgtgcctacttcttcacttctgcttataggcaacttccttttcctttaattctctaatatttggagggcacgtcacaacttatacacttgctctatatgtt

SEQ ID NO: 409507 - DNA, 844 bp, Homo sapiens
gctctcattctgtcttgccgccacaatgtaagaattgtctctcaccctctgccatgtaagaattctctttcaccctctgccgtgatcgtgagaccttccccagccatgtgaaactttttcagctttcctccactgttttgggaaacgtcaccttcttatcttggaagagtaatctcaaaattgaagcatcttagatccaacaagaattaaaaggatgggaagtccttgcagccatccaatagagtcagaagactttggattttggagtctgtgagattatcttacagagcaagactgcagatcaagattttccaacgtggtgctgacttttttgagaacagttaatgagaactaggaaagtccttgcagaccatccagtccagcggctttcaaatggaacatgtgaaaggacaacagaatcacatggattcttttctgaactgcttttttccagtgatgccatattctataagacttcatgtgaaggtgtgacggaggacgggtaatgtctgaatcttccaggcaatgagagggatggtgtgagtctggaaattctttgtgatggtctgagactccccttactccagttaagaacactgacttaattcgatctggttttttttaacaaatggcctctgagacgtagagcagtgaggataaggactcttacccggttacagagtggagtaagggctagaactcaactcttaaaaatttcaaatgcaatgttctttctacaatattgtgcctacttcttcacttctgcttataggcaacttccttttcctttaattctctaatatttggagggcacgtcacaacttatacacttgctctatatgtt

SEQ ID NO: 409508 - DNA, 643 bp, Homo sapiens
gatatatccaggggtgatcagagtggaaggggggcaacccttcggatttagaggagagaagaatcaactcagacattatcttacagagcaagactgcagatcaagattttccaacgtggtgctgacttttttgagaacagttaatgagaactaggaaagtccttgcagaccatccagtccagcggctttcaaatggaacatgtgaaaggacaacagaatcacatggattcttttctgaactgcttttttccagtgatgccatattctataagacttcatgtgaaggtgtgacggaggacgggtaatgtctgaatcttccaggcaatgagagggatggtgtgagtctggaaattctttgtgatggtctgagactccccttactccagttaagaacactgacttaattcgatctggttttttttaacaaatggcctctgagacgtagagcagtgaggataaggactcttacccggttacagagtggagtaagggctagaactcaactcttaaaaatttcaaatgcaatgttctttctacaatattgtgcctacttcttcacttctgcttataggcaacttccttttcctttaattctctaatatttggagggcacgtcacaacttatacacttgctctatatgtt

SEQ ID NO: 409509 - DNA, 1512 bp, Homo sapiens
gctctcattctgtcttgccgccacaatgtaagaattgtctctcaccctctgccatgtaagaattctctttcaccctctgccgtgatcgtgagaccttccccagccatgtgaaactggtctcactctgtcgcccaggctgcagtgcagtggtgtgatcatggctcaccgcagccttgacctcctaggctcaagcgatcctttcacctcagcttcctaagtagccaggactacagttttcagctttcctccactgttttgggaaacgtcaccttcttatcttggaagagtaatctcaaaattgaagcatcttagatccaacaagaattaaaaggatgggaagtccttgcagccatccaatagagtcagaagactttggattttggagtctgtgagattatcttacagagcaagactgcagatcaagattttccaacgtggtgctgacttttttgagaacagttaatgagaactaggaaagtccttgcagaccatccagtccagcggctttcaaatggaacatgtgaaaggacaacagaatcacatggattcttttctgaactgcttttttccagtgatgccatattctataagacttcatgtgaaggtgtgacgggatgtactcacatcccaacaaattgaaaatgctgaccaatcccagcacagccaactcgaatttgctccttcatcaaagtgaccagcacctcatttcttcctctttagaatttatagttcaggaactttgcagatctcttattaactcttcagttaataatgagagtcctatggctattgatatctaacatcctggcttcactcacatggatgagccccacctggaatgcctagaagacgtgggacagctggatctctctccacacggtttttcattgttgcctcaggttccaataaaagcaaaagctgcaaggtcttctgaggcaaagacttagaaataccacaatgttacttctgctgcattctgttgataaaagaatcccacaatgccagcttcatttaaaggggtaaagatatagattattcaccttcgatgggaggaactgcaaatgatgtaattagtgataatttttaatatactgtaatgtattgacttatctttaaaaaatgaaaaaataaacaaaaactaaaagcaaaacaaaactataatagaaaacaattgcttctggaggaggaatgcaatggggaaaaggttatagaaacaaaagctacattttatttgaatatacctgttttaggtttgaccctggtaacatttgatattttacataattatatcattatttaaaattaaattttaaaacaccaatacccataacagaaaagtttgataaaagaggtgaaatataaatataaatatattaagtttgcattataatcacacagagatgaattgtgtcagttactcaaacacagatatttgactatacaacctttataagatatcctaaggacaaaaaaacatgcaaaaatatatattgaactgttttaaaattatat

SEQ ID NO: 409510 - DNA, 1192 bp, Homo sapiens
gctctcattctgtcttgccgccacaatgtaagaattgtctctcaccctctgccatgtaagaattctctttcaccctctgccgtgatcgtgagaccttccccagccatgtgaaactggtctcactctgtcgcccaggctgcagtgcagtggtgtgatcatggctcaccgcagccttgacctcctaggctcaagcgatcctttcacctcagcttcctaagtagccaggactacagttttcagctttcctccactgttttgggaaacgtcaccttcttatcttggaagagtaatctcaaaattgaagcatcttagatccaacaagaattaaaaggatgggaagtccttgcagccatccaatagagtcagaagactttggattttggagtctgtgagattatcttacagagcaagactgcagatcaagattttccaacgtggtgctgacttttttgagaacagttaatgagaactaggaaagtccttgcagaccatccagtccagcggctttcaaatggaacatgtgaaaggacaacagaatcacatggattcttttctgaactgcttttttccagtgatgccatattctataagacttcatgtgaaggtgtgacgggatgtactcacatcccaacaaattgaaaatgctgaccaatcccagcacagccaactcgaatttgctccttcatcaaagtgaccagcacctcatttcttcctctttagaatttatagttcaggaactttgcagatctcttattaactcttcagttaataatgagagtcctatggctattgatatctaacatcctggcttcactcacatggatgagccccacctggaatgcctagaagacgtgggacagctggatctctctccacacggtttttcattgttgcctcaggttccaataaaagcaaaagctgcaaggtcttctgaggcaaagacttagaaataccacaatgttacttctgctgcattctgttgataaaagaatcccacaatgccagcttcatttaaaggggtaaagatatagattattcaccttcgatgggaggaactgcaaatgatgtaattagtgataatttttaatatactgtaatgtattgacttatctttaaaaaatgaaaaaataaacagatgcggccgtaagggctttttggattaaaacaacaataatttaacggaaggtggggc

SEQ ID NO: 409511 - DNA, 1197 bp, Homo sapiens
gctctcattctgtcttgccgccacaatgtaagaattgtctctcaccctctgccatgtaagaattctctttcaccctctgccgtgatcgtgagaccttccccagccatgtgaaactggtctcactctgtcgcccaggctgcagtgcagtggtgtgatcatggctcaccgcagccttgacctcctaggctcaagcgatcctttcacctcagcttcctaagtagccaggactacagttttcagctttcctccactgttttgggaaacgtcaccttcttatcttggaagagtaatctcaaaattgaagcatcttagatccaacaagaattaaaaggatgggaagtccttgcagccatccaatagagtcagaagactttggattttggagtctgtgagattatcttacagagcaagactgcagatcaagattttccaacgtggtgctgacttttttgagaacagttaatgagaactaggaaagtccttgcagaccatccagtccagcggctttcaaatggaacatgtgaaaggacaacagaatcacatggattcttttctgaactgcttttttccagtgatgccatattctataagacttcatgtgaaggtgtgacgggatgtactcacatcccaacaaattgaaaatgctgaccaatcccagcacagccaactcgaatttgctccttcatcaaagtgaccagcacctcatttcttcctctttagaatttatagttcaggaactttgcagatctcttattaactcttcagttaataatgagagtcctatggctattgatatctaacatcctggcttcactcacatggatgagccccacctggaatgcctagaagacgtgggacagctggatctctctccacacggtttttcattgttgcctcaggttccaataaaagcaaaagctgcaaggtcttctgaggcaaagacttagaaataccacaatgttacttctgctgcattctgttgataaaagaatcccacaatgccagcttcatttaaaggggtaaagatatagattattcaccttcgatgggaggaactgcaaatgatgtaattagtgataatttttaatatactgtaatgtattgacttatctttaaaaaatgaaaaaataaacacctgtgcacgcgtgaaggttcttttttcttgtacattgattataatctcttctatattagtat

SEQ ID NO: 409512 - DNA, 1752 bp, Homo sapiens
aaacgactaattggttgcagaaagtgatgaatcagaggctgaagtgaagttacaaagttatactcctatgcaaaggaagacttggcctgtgaccagcctgattgactgcaggaggggaccagtcagagcaagaaggcagccatctgtagggcaggaagagagccctcaccagaacttgaccatgctggcaccctgatctcagacttctagcctccagaactgtgaggatgctgagatgtagagagactgatttgctcaagataacaaagagttttattgatttgggaacccatggaagggggtcagctgtgagatatcacatgatcagactgactgcctgaccagactgactgccatcctgttaaaggaatgaatcacagttcatctcgcagatttatggcatgcctacagaaaaagtaccttatgatgcaaacctgaaagtttaaataatctcctgaaagttccacaatcagttttcagctttcctccactgttttgggaaacgtcaccttcttatcttggaagagtaatctcaaaattgaagcatcttagatccaacaagaattaaaaggatgggaagtccttgcagccatccaatagagtcagaagactttggattttggagtctgtgagattatcttacagagcaagactgcagatcaagattttccaacgtggtgctgacttttttgagaacagttaatgagaactaggaaagtccttgcagaccatccagtccagcggctttcaaatggaacatgtgaaaggacaacagaatcacatggattcttttctgaactgcttttttccagtgatgccatattctataagacttcatgtgaaggtgtgacgggatgtactcacatcccaacaaattgaaaatgctgaccaatcccagcacagccaactcgaatttgctccttcatcaaagtgaccagcacctcatttcttcctctttagaatttatagttcaggaactttgcagatctcttattaactcttcagttaataatgagagtcctatggctattgatatctaacatcctggcttcactcacatggatgagccccacctggaatgcctagaagacgtgggacagctggatctctctccacacggtttttcattgttgcctcaggttccaataaaagcaaaagctgcaaggtcttctgaggcaaagacttagaaataccacaatgttacttctgctgcattctgttgataaaagaatcccacaatgccagcttcatttaaaggggtaaagatatagattattcaccttcgatgggaggaactgcaaatgatgtaattagtgataatttttaatatactgtaatgtattgacttatctttaaaaaatgaaaaaataaacaaaaactaaaagcaaaacaaaactataatagaaaacaattgcttctggaggaggaatgcaatggggaaaaggttatagaaacaaaagctacattttatttgaatatacctgttttaggtttgaccctggtaacatttgatattttacataattatatcattatttaaaattaaattttaaaacaccaatacccataacagaaaagtttgataaaagaggtgaaatataaatataaatatattaagtttgcattataatcacacagagatgaattgtgtcagttactcaaacacagatatttgactatacaacctttataagatatcctaaggacaaaaaaacatgcaaaaatatatattgaactgttttaaaattatat

SEQ ID NO: 409513 - DNA, 1303 bp, Homo sapiens
gctctcattctgtcttgccgccacaatgtaagaattgtctctcaccctctgccatgtaagaattctctttcaccctctgccgtgatcgtgagaccttccccagccatgtgaaactggtctcactctgtcgcccaggctgcagtgcagtggtgtgatcatggctcaccgcagccttgacctcctaggctcaagcgatcctttcacctcagcttcctaagtagccaggactacagtatcttacagagcaagactgcagatcaagattttccaacgtggtgctgacttttttgagaacagttaatgagaactaggaaagtccttgcagaccatccagtccagcggctttcaaatggaacatgtgaaaggacaacagaatcacatggattcttttctgaactgcttttttccagtgatgccatattctataagacttcatgtgaaggtgtgacgggatgtactcacatcccaacaaattgaaaatgctgaccaatcccagcacagccaactcgaatttgctccttcatcaaagtgaccagcacctcatttcttcctctttagaatttatagagtcctatggctattgatatctaacatcctggcttcactcacatggatgagccccacctggaatgcctagaagacgtgggacagctggatctctctccacacggtttttcattgttgcctcaggttccaataaaagcaaaagctgcaaggtcttctgaggcaaagacttagaaataccacaatgttacttctgctgcattctgttgataaaagaatcccacaatgccagcttcatttaaaggggtaaagatatagattattcaccttcgatgggaggaactgcaaatgatgtaattagtgataatttttaatatactgtaatgtattgacttatctttaaaaaatgaaaaaataaacaaaaactaaaagcaaaacaaaactataatagaaaacaattgcttctggaggaggaatgcaatggggaaaaggttatagaaacaaaagctacattttatttgaatatacctgttttaggtttgaccctggtaacatttgatattttacataattatatcattatttaaaattaaattttaaaacaccaatacccataacagaaaagtttgataaaagaggtgaaatataaatataaatatattaagtttgcattataatcacacagagatgaattgtgtcagttactcaaacacagatatttgactatacaacctttataagatatcctaaggacaaaaaaacatgcaaaaatatatattgaactgttttaaaattatat

SEQ ID NO: 409514 - DNA, 1129 bp, Homo sapiens
gctctcattctgtcttgccgccacaatgtaagaattgtctctcaccctctgccatgtaagaattctctttcaccctctgccgtgatcgtgagaccttccccagccatgtgaaactttttcagctttcctccactgttttgggaaacgtcaccttcttatcttggaagagtaatctcaaaattgaagcatcttagatccaacaagaattaaaaggatgggaagtccttgcagccatccaatagagtcagaagactttggattttggagtctgtgagatgatgtactcacatcccaacaaattgaaaatgctgaccaatcccagcacagccaactcgaatttgctccttcatcaaagtgaccagcacctcatttcttcctctttagaatttatagagtcctatggctattgatatctaacatcctggcttcactcacatggatgagccccacctggaatgcctagaagacgtgggacagctggatctctctccacacggtttttcattgttgcctcaggttccaataaaagcaaaagctgcaaggtcttctgaggcaaagacttagaaataccacaatgttacttctgctgcattctgttgataaaagaatcccacaatgccagcttcatttaaaggggtaaagatatagattattcaccttcgatgggaggaactgcaaatgatgtaattagtgataatttttaatatactgtaatgtattgacttatctttaaaaaatgaaaaaataaacaaaaactaaaagcaaaacaaaactataatagaaaacaattgcttctggaggaggaatgcaatggggaaaaggttatagaaacaaaagctacattttatttgaatatacctgttttaggtttgaccctggtaacatttgatattttacataattatatcattatttaaaattaaattttaaaacaccaatacccataacagaaaagtttgataaaagaggtgaaatataaatataaatatattaagtttgcattataatcacacagagatgaattgtgtcagttactcaaacacagatatttgactatacaacctttataagatatcctaaggacaaaaaaacatgcaaaaatatatattgaactgttttaaaattatat

SEQ ID NO: 409515 - DNA, 370 bp, Homo sapiens
caagacgggtccatgagacagatgaggaaactgaggctcaaggtggtcaaggggtttttctaaggccccatggcagcaggtgatagagcctggattagaaccgaaatttgctgcactgccttcaactccagcttgttgtctcccttacctcttgggcccctcctcggcttctttggtgggctgtgctctcagcccccaccctcttctcctcacaactcaagtgagcacctctgtgtctgtggcttccatgcccatttttcttttttctttttctttcttttttttttttatttgagacagagcgagaaactgaaaaaaaaaaaaaaaaaaaaaagagattaataaacttgtaaatttgtcccaaggtcaa

SEQ ID NO: 409516 - DNA, 435 bp, Homo sapiens
catgaacctttttttaaagcagagaaaattctacagctggaggcagaagagattctgtagaaggggaagtcagagagattcaaagcataaaaaagacactacctgctgtatggctttgaagatggtggaacaaggccactcgccaaggtacaaggagcctctagaaagctgaacaggatgtcagctgacaatcaacaagaaaacaaggacctcacccttaagaccaccacgtggatctgaattctgtgaacaacttgcaagaatttgggagcaaattcatttccagaacctccagcaaaggaatccagccctggtgacaccttgatattggccttgagagactctaagcagagaaccagctgagccactctgcacctaaacttctaactcagaacattgtaaaccaatacatttgtgttgttttaagccactaaa

SEQ ID NO: 409517 - DNA, 1074 bp, Homo sapiens
caagctctcatcgtcctgcatagtaagagtcttcagaacgtggaaaggaacttcagtggcttttgctgggttgggctgaaggaaaccccggtgaaacccacacctgtaaagatgcttctcacagtgggacttttatcgcttgggtcctggtcacaatcaatttttctgcaaataattggctttgcttttcttgtggtgagtctctaaggacagtgagttccgttctggggactgtgagttctatgctgtgtacatgtgtgctttggagggtgactggaagcaccatcgttccttcccatactttcaggctcagttaccgcttcagtctggactgttgtgaacgagaatatggaagtcattttccccacattgtttacccagcttgcctgggaaacaccaactggaggattagagtccggctcttcagtttgaactcactttccctttctcttcctgggaccacccagtgattcagagccctgcattctgtaatgagattaatgtcaacagtttcctgcattgaagattattttcccaaagagttcacgatttccttcaggacttctccatcaccccagtgtctggctacctaatgactgattaacaggttgattttctagaaaactcaaattacaatttcttttttttaaaaaagggcaatccagccttttctctgattatccgtcctccccatctcccacttgtcctatgttttagccacacaggctgttgtcatcccctaaaagtgtgcttctgagtctccaggcctttgataaattgttccctcctcctgaaatgccattcaccccatctgccttttggaattctgcccttccctcggaatctagcccaagtcctatctcctctaagaagggacttttctagattgaattaaatttccttccctggccctgcatagtggccgcacccagtagactgtgagtctacttttttcatcttttattcttacaagtgcctggcctcatattttgcacacagtaggcatttgctatactttaattactagtaaaattgagtgataaaataaaacatttaaatctcaccatacgtttg

SEQ ID NO: 409518 - DNA, 722 bp, Homo sapiens
gaaaaaaaaaaagaactgagaccccatctctacaaaagtaaaaaattagctgggtgtggtggggcacacctgtgattctcagcctcccgagtagctgggattacaggcatgtgccaacatgcccagctaatttttgtatttttggtagagatagggtttcaccatgttggtcaggctggtctggaactcctagcctcaggtgatccacccacctcagcctcccaaagtgctgggattcctcccatcttacacatgaaaaaacagaggcagagagagcacagggtctttcccaaactcatgtaaatcagaattatagagtctcaaagttttgaagttctagtgtgttccaccacctgtcaaactttttttttttttttgagatgaggtcttgctctatcacccaggctagattgcagcggtgcgatcatagttcactgtcaccttgacttctggggagtgatcctcctgcctcagcctcccaagtagttgggactgcaggtgcatgcttccataagcggacttagaaaatttgaatgaggccgtactgggtgcctcatgcctgtcatctcaacactttaggaggctgaggtgggaggatggtttgtgcccaggagttccacgtggcagtgagctgtgattacaccactgcacagcaacctgggcgacagtgaggctcagtcgtgttgaaaaaagaaaagacagagagagaaagaaaagaaaaa

SEQ ID NO: 409519 - DNA, 677 bp, Homo sapiens
cactggttgccgtggtaacaggcctccggtggagggcggggaccctcggaagccagctgggtggcgatcgcttgtctgccttggcaggccccttgtgcagtcttttcccggcgtgagcgtgcagggattgaaaaggaatgctttatggttcagcagagagccaccacgcaggatgcactgggacctgagaaccgtcgggcagtcccacgagctctttcatgaccagctccaaccgacaagtacacgccccttcgcactccactagctagtaagctgagctacaaggtgtgccaggcacccaggacgccgattcaccgcttcagtgaaggcccagctcaaatgccacctcttccatgaagacttccgtgatccacaatgatagcatctccagcaattgcttctataatgaatagcatgagtcattctgcaggatgttgatcttcctttttttactcctagactgaatttttccaccacctggatgaacatagcagaaagaacatagtgttttagagtcagacacaataggaatcaggcactttggaatcttggctctaccacctttgagctatgtatcccaaggcaagtcacttcccctctctcagctttaaaatagtaataggattgctgtagggattaaagtaaatcaacatatgtaaagtgcccacacaaaacct

SEQ ID NO: 409520 - DNA, 356 bp, Homo sapiens
cgccctcatctatccggaacacagccgagaaacaaggaagttagcaaaaaaggaatctgagcagccagattagacgtttaaaaagttcatgcaccaaagctcatgcacttaactcctaggagaaatcttaggcccccaactcagagctccttcattttgattttatttgtaatctgaacaagctgggttgaaggagcacattgacattgagttgctatactcaggcaggctggctacagcaagaaggacagacaacagcttaataacgagagaggaggaactaatataaaaagtagacacataaaccctggggccatttaatgtaggggcacaccagtcaaccctgagaacacacc

SEQ ID NO: 409521 - DNA, 338 bp, Homo sapiens
aagctcagacacgctgcactttggtggctgatgagcccaaggtgggaacttcagaatcgcaactttagaagcttaatttcctccttgcacagaacaatggtgcacccagcttactcgtgcctagggtagggccacacagaaaatgagagacttcaaggttatgaatcacactctgagccagctggatcttcttaaagcatctctataaggcaatgcctcccagcaagggatcatgcttgaccctctcaaagctgccacagtgtcctcccagggcagtactttaaaaaaacagtaacatggtgttattctcaagtttacttctgctttttatagagtct

SEQ ID NO: 409522 - DNA, 283 bp, Homo sapiens
gaaagtgacagaagacgtgcggagggagacgcagagacagaggagaggccggcagccacccagtctcgggggagcacttagctcccccgccccggctcccaccctgtccggggggctcctgaagccctcagccccaaccccgggctccccatggaagccagctgtgccccaggaggagcaggaggaggtggagtcggctgaatgcccacggtgcgcccggggcccctgagcccatcccgctcctagccgctgccctaaggcccctgcgcgccccgcgcccccc

SEQ ID NO: 409523 - DNA, 511 bp, Homo sapiens
gcagcctgctgtttgacaaagctgctttgctgagtgagacaatgattctgatgcagaaagggaagcagaaacaaaagataagcaagcgagtgcttggaaggcactggaatccctggcttgatctatctttggagcccagccataatgttttctttcctgcatgcacataaaccactgcattatccttttgttttagcctgtttaatttaggtatctgtcatttgcagccaaatatactctctgtaaccttggatttgccatttaatagtgcctggtgcatagtaggtgttcaacaaatatttgttgactgacttgtaccctctggaccctgtttcccttacttgtgtgttgggggtgataattagtagctcgtagggctgttgcatggatgagaaaatgagagggagagggctgtcttggcctgtttcatgctgctgcgacagaccaccaccgactgggtaatttataaagaatagatatttattttctcacagttctgtaggctgggaag

SEQ ID NO: 409524 - DNA, 706 bp, Homo sapiens
ggaatatttttcatctactagttcacccacatacagtgtttgcactccccagaaacgatttcacaacttctaaatattttttaaacgcaatttgtttcctttttaagttactttgctttctttaaaatgtcaatttatttttagtgacacttagttttacttaattggctatgccttcatcacttaaaaacctatttctttcatatttgagaagcttttacttcactttaacataactttgattgctctgtgatgctctggtgccatcatttagtccaatttctaccattaaaattgaagctgtagggaaaatatgtgcaatttcgacgaaagttcaggagctatgcagaaatcaatttaacaaatcaaaaagcaaataatttagggagttaacaaaattactttagtaatccagactgaaaaagtatttgaggctagataaacatagttaatatatgaagtattgttaaagattctaatttctgactattttgtttcagacagttcatttagagccatcattgcatgatacacgtgtttagaccacatactgtctggaccctgattccatgtcgtccaacctcgggagtacaatctgactttccatgcagatcctgcgcagcagagaaacatgttcctgagcagacatcagcagtgcctgacaattacattacacgctataaatttatgtgtggcttgagattct

SEQ ID NO: 409525 - DNA, 412 bp, Homo sapiens
ccacataaattcttcaaagatatcatttacatctattttaatagctgccctaaatgtctttactacaaagactgaccactgaaggacaaatttccaggagctgtgacagatgtaatagctgtctttctgctttgattcaagacaattttttgaacctaaatacagagaatgggtgctcagaattcctttctcattatcagcctcagacagttcatttagagccatcattgcatgatacacgtgtttagaccacatactgtctggaccctgattccatgtcgtccaacctcgggagtacaatctgactttccatgcagatcctgcgcagcagagaaacatgttcctgagcagacatcagcagtgcctgacaattacattacacgctataaatttatgtgtggcttgagattct

SEQ ID NO: 409526 - DNA, 426 bp, Homo sapiens
atgaatgtttttcaggaagctattgagctaaagtaggaaagtatccaagaaagaaaaaaaaaaaacagcttccaaataccagagagatgaaactctgattccttcatgaaatgaattgaaagtactctgtgtaactgaaggcaaacttttaatcaattggatttcaagggtgcgggctgagtctatgccgtgcaatgactggacagtaaatcacctaccagaagctgctaaacttcacgtggtgctctccaccaaaatggctagagagatccaccattggcagcacactcccttcaacttgctgtttctatactggaaattgttttatttgatccaaccatatcaccgcctaggtagggtaatgtcttgcccaaacagtgaagtctcttaagtccatctttgaaataaaaattggcgacattcttt

SEQ ID NO: 409527 - DNA, 371 bp, Homo sapiens
ttatggactgaattgtgcccccccaaccagatgcttctgttgaagttctaactcctgaatggatttggagctagggccttaaaggaggtaattaaggttacaaagattctaagggtggcgccctaacctgataggactgatgcctttataaaaagaggaacagacaccagaaatctcaatctctctctctctctctctctctgtctccacacacacacaccgaggaaaggccatgtgaggacacagcaagaagacagctgtctgcaagccaggaagagaagcctcactagaaaccagccctgccagcactttgatctttgatcttggacttatagcccctagaactgtgagaaaataaacttctgttgttt

SEQ ID NO: 409528 - DNA, 4593 bp, Homo sapiens
  misc_feature (1)..(1): n is a, c, g, or t
  misc_feature (1105)..(1105): n is a, c, g, or t
  misc_feature (2777)..(2777): n is a, c, g, or t
  misc_feature (2801)..(2801): n is a, c, g, or t
  misc_feature (2819)..(2820): n is a, c, g, or t
  misc_feature (2884)..(2884): n is a, c, g, or t
  misc_feature (2921)..(2921): n is a, c, g, or t
  misc_feature (2936)..(2936): n is a, c, g, or t
  misc_feature (3472)..(3472): n is a, c, g, or t
  misc_feature (3474)..(3474): n is a, c, g, or t
  misc_feature (3911)..(3911): n is a, c, g, or t
  misc_feature (3988)..(3988): n is a, c, g, or t
  misc_feature (3993)..(3993): n is a, c, g, or t
  misc_feature (3995)..(3995): n is a, c, g, or t
  misc_feature (3997)..(3997): n is a, c, g, or t
  misc_feature (3999)..(3999): n is a, c, g, or t
  misc_feature (4001)..(4001): n is a, c, g, or t
  misc_feature (4004)..(4004): n is a, c, g, or t
  misc_feature (4008)..(4008): n is a, c, g, or t
  misc_feature (4010)..(4010): n is a, c, g, or t
  misc_feature (4012)..(4012): n is a, c, g, or t
  misc_feature (4015)..(4015): n is a, c, g, or t
  misc_feature (4017)..(4017): n is a, c, g, or t
  misc_feature (4021)..(4021): n is a, c, g, or t
  misc_feature (4025)..(4025): n is a, c, g, or t
  misc_feature (4029)..(4029): n is a, c, g, or t
  misc_feature (4031)..(4031): n is a, c, g, or t
  misc_feature (4034)..(4034): n is a, c, g, or t
  misc_feature (4036)..(4036): n is a, c, g, or t
  misc_feature (4039)..(4039): n is a, c, g, or t
  misc_feature (4043)..(4044): n is a, c, g, or t
  misc_feature (4049)..(4049): n is a, c, g, or t
  misc_feature (4054)..(4054): n is a, c, g, or t
  misc_feature (4057)..(4057): n is a, c, g, or t
  misc_feature (4060)..(4060): n is a, c, g, or t
  misc_feature (4062)..(4062): n is a, c, g, or t
  misc_feature (4067)..(4067): n is a, c, g, or t
  misc_feature (4071)..(4071): n is a, c, g, or t
  misc_feature (4073)..(4073): n is a, c, g, or t
  misc_feature (4076)..(4076): n is a, c, g, or t
  misc_feature (4079)..(4079): n is a, c, g, or t
  misc_feature (4082)..(4082): n is a, c, g, or t
  misc_feature (4084)..(4084): n is a, c, g, or t
  misc_feature (4090)..(4090): n is a, c, g, or t
  misc_feature (4092)..(4092): n is a, c, g, or t
  misc_feature (4094)..(4094): n is a, c, g, or t
  misc_feature (4097)..(4097): n is a, c, g, or t
  misc_feature (4100)..(4100): n is a, c, g, or t
  misc_feature (4102)..(4102): n is a, c, g, or t
  misc_feature (4108)..(4108): n is a, c, g, or t
  misc_feature (4112)..(4112): n is a, c, g, or t
  misc_feature (4115)..(4115): n is a, c, g, or t
  misc_feature (4120)..(4120): n is a, c, g, or t
  misc_feature (4123)..(4123): n is a, c, g, or t
  misc_feature (4526)..(4526): n is a, c, g, or t
ncctcgggtcatttttaacaataacaaaaaatattttcagctgaaacttcagaccggagacctgcaagtaaatgagacattggaccgggaagaattgtgtagaatcactgagccttgtgtgctgcaattccaagtgttactggaagaacctttggaggtttaaacttttggtcagtgacataaacacaattcccctgtattcccagaagcagaaattattttgaaatcatggaaaatactcctccaggaactgtgtttcctctgaaaaatacacaagatttggatgtggccatcaataacatccaaaactacaccatctacccctactcccatgtccacgctctcacccaaaatggcagtgaaggcagaaaatacccagagctggttctggacaaagccctggatcgggaggagcaggctgagatcaggttaactctcatggcagtagatggcgggactcctcccagaactgggactgctctggtcctcattgaaatcttggacatcaatgacaatgcacctgagtttgtgtagccactctatcaggtgcagatatcagaaaacagccccctggattcccttgttgccactgtttccgctagagattcagacatgggaattaatggtgagatattctactcattttttatggtgatgaagagatttctaagacatttgcacttaatgaacgaaggggagaaattaaaataatcagaaaactagattttgaaaaaattgtgtcatatcaggtggatattaaagcctctgatggggcaggtctttctggaaaatgcactgtcataatacaggtggtagatatcaacgataacgctccggaactgaccatggcttcattcacaagccccatccgcgaaaattctcctgagaccgttgcagctcttttcagcattcaagaccgcgattctgggaaaaatggaagaatagtttgatcaattcaaaatgatgttccgttcatgccgaaaccttccgttgagaatttatactggctgttaacagaaggaccactggacaaagagattagagccgagtacaacatcaccaacacagccacggacttggggactcctaggctgaaaaccgagtncaacataacggtgctggtctcctacgtcaatgacaaagcccccaccttcacctaaacctcctacaccctgttcgtccgcgagaacaacagccccgccctgcatattggcagcgtcagcaccgcagagactcgggcaccaacatccaggtcacctactcgctgctgccgccccggaacccgcacctgcccctcgcctccctggtctccatcaacacagacaacggccacctgttcgccctcaggtcgctggactacgaggccctgcaggagttcgagttccgcgtgggcgcttcagaccgcggctccacggcgctgagcagcgaggcgctggtgcgcgtgctggtgctggacgccaacgacagctcactcttcgtgctgttcccgctgcagaacggctccgcgccctgcaccgagctgatgccccgggcgggccgccgagccgggctacctggtgaccaaggtggtggcggtggacggtgactcgggccagaacgcctggctgtcgtagcagttgctcaaggccacggagccagggctgttcggcgtgtgggcgcacaatgcactgacaggctgctgagcgagcgtgacacagccaagcacaggctgatggtcctggtcaaggacaatggcgagcctccgcgctcggccaccgccacgctgcacgtgctcctggtggatggcttctccctgccctacttgccgttccctgaagcggccccggcccaggcccaggccgacttgctcaccgtctacctggtggtggcgttggccttggtgtcgtcgttcttcctcttctcggtgctcctgttcgtggcggtgcggctgtgcaggaggagcagggaggcctcattgggtcgctgctcggtgcccgaggacccctttccaggcatctggtggacgtgagcgacaccaggaccctatcccagaggtacaagtatgaagtgtttctgacgcgaggctccgggacaaatgaattcaaattcctgaagtctgttatccctaagcatccgggcgctgtgaatgatgggaggaaaagtccaactttgtaaatggttttggattcaattaagaatctgtagatttttcagagcatttaggataaaggttagtcctttatcaatatattaagtctctgttatgttttttgtgctatatggattttctaagatttttgctgatttcattttcctacttaagattagacattttctttgattatttgttcatacttggtctccttttatcatgtccattttgatgaatacaactttcaggtttactcattaatgaaaagtaatatttgttcaatttatcaacttttcaaaatcacaggctgttgacttgaagactccagctccattccgtttcattaaagaaagcttttctaaacttttgatgcttagaagacaggaacgatgatatagtgattattagtacatattctattgattctgtcttatgcttacctgtcttgaatttttaaatggagaagcgtctgcaaaaattgcatcgttttatttcacaatagcttgaagtgggaaagactacatttttccccaaacttaaagacttttctgctctttttataaccttcactccataacatatatgagcattattattactattattgagtcagagtttcactcttgtcgcccaggctggagtgcantggcgcgatctgggctcactgcancctcgcctccccggttcnngcgattctcctgcctcagcctcccgagtagctgggattacaggctccttgttttagtagagatngggtttcaccatgttggccaaactcaaactgacctcnggtgatacactcgcntctgcctcccaaagtgtggcattacaggtgtgagccaccttgcccggccatacgagcatctttagtgattattagattatctcaagattttaaaatcatagctcccttttgtagcgtctatctagcccacctgatctttttctggaaaattctccctgtctttggctgaagtgtaatgttgcagccacatttattttatatgacccacctccctctgtgatttcaaacacaaaaataagatgatcctagctggcctaatctgattctctctgtttaaaaaaaaatggctttaagaaccagatacaacatagtctctttgttaggaacataagcagaaagtggtgtcatatttggctaaacacttgcaaagaaatacagaacatcaatctattgagagacaagaaaaaataaggtaccaaaagaatgaccttgtcatagattttcctgttttagattttccagtccctcccaagtctttttcccttaggttgctggagacaaatttgtgctctttaataaatttccctctaattaananatctaagtgaggtttttgttgtcaaaagcatgtttagatattcctgcattgttggtaagttagacctttcttcctattgggtttttattgtggcttttcatattagtatgacaacatttgggatcaaggaggttgtaaaatattagtagtctataagggacatgcactagcttttgtcagaatatacaattttgagaaaaactgaaggatctttccaatggtacagtctttgaagtgtttaatagaaattcttagaacattttattatataagagttttgaatatcgtaagtgtcataataacattactgtaaaaaaaaaaccttgacaatgaaaaatgtgtgtctaaaagagacataatccttatctttagggtcatcataatcttgttatgttctttctttctgtcatataatatatcccttgcttatgggtagntaagttgttttgccacttaatgaaatgacattttaggtcattctgagttatttcacattactatttaaagggcatangaaanancnancntangaanangntgncnttgnttanccancntananaangaanntgaancccanaanaananggaanttcnanagnagnagnanaaccancngncanaangnttaaantaantgngattnatnaatggatccatttaacaaatatttattgagcacgtaccatgtgccagggattattttagatattggggatgcagcagtgaacaaaatgaagttctaacatgtgaggttgaaacagaaaggaaacaactaaataagtacatctatactacgtcagataataaatacgagagagacaaggcagggctgggtacagcagctcatgcctataaccccagcactttgggaggctgaggcaggaggattgcttgagctcggaaatttgagaccagcccgggcaacatagcaagacctcatctttacaaataattaaaacattagccaggcatggtgatgcgcaactgtggtcccagctacagttgctgaggtggggggattgcttgagcctgggtagtcaaggctgcantgagcagtgattgtgccactgcactccctcctggacaacagagcaagaccccatctcaaaaaaaaaa

SEQ ID NO: 409529 - DNA, 1131 bp, Homo sapiens
tgggcccattttacttaaagcaaatacaataggtttggaattatgtatttaaaagcatggcattggtccacgtgacatgttgggtgtcttgttttcattttaccagactctgtttttatttatgttttcagtttatgatcctgtcctttgttcataaggtacttagatggtttaagatgtagacttcttatatgaagatgttgctgttgtttttccaaagtaatggtggtcatcagcccatttttctatttagtctcatgaatagaatcatgagtagaatctttcttaaattattacttgtaaatggatcactttcttgttttctttttcttaattggagctttaaataaatatggaacttggaacaaaaagattttcaggaattttatggaaactaacttttttgacctaaatcgaaagggatgaaagtttctgaaaacctaacaaaatgtgtgcacagccaattcttttaggggaggaaataggcagggaatgtgtaattggctattttaaaaacatatgccttcttttgtaacttattgttgtttcaagttacaagatctttgaaggcaagtgtttatctcaaaatatttgaaagcttttatagtgcttaacatactaagacgtcctattagggtttacttagaacaagcttatccaacttgtgggccacatgtggcccaggatggctttgaaagcggcctaacacaaattcataagctttcttaaaacattatgtgatttttttttttagcttatcagctatcattagtgttaatgcattttatgtgtggcccaagacaattctttttcttccagtgtggcccagggaaaccaaaagattagacacccctgacttagaactttccataggttaggagaaagttgtactttcttgatgtctataacctagaatttctggtaaaggaattgattggaaatgttattaaaagttgaaaataatttggaaattaaacattttagtgatcagttcttccattgagactgtgttggttcctttactagatatgtgccatctttttaaaaacttactgtgttgcttcctttactagaaaattgccatctttttgagccttgtctattgaggaaccaagaacacagaaaaggcag

SEQ ID NO: 409530 - DNA, 434 bp, Homo sapiens
ctctgattttggatcaaaacaaaacgcctacagggaccggggggagcacaaatgagccaggtggtccaggtgtcttaagatagctgctttcaatacagaggcccactgcattaagcaggtcatattcttcacttccacagagaaatatgctttccactgcttttctttaaacatatcaccctctggtctatctttcacatctccactttgagagaaacaagtttaagagatatccactgaccttttaaccttactaaaataaatacacgttaaaactgagataaacagtagtaactggcagcctcgatgtcaggaacacactagagaggaggggcacaccccacactgtgtcccacaggggtgagggaggcagtggcgtagctgcatctcagccactgtggctgcaggagaggcgcaacccagtggctggagtc

SEQ ID NO: 409531 - DNA, 295 bp, Homo sapiens
cggcacgaggagcgttgggctgcggcagcggaggagctcaacatgcgtgagtgtatctctatccacgtgggagaaggcatggaggagggggagttctctgaggcccgcgaggacctggcagctctggagaaggattatgaagaggtgggcgtggattccgtggaagccgaggctgaagaaggtgaagaatactgaggggagggtgtggtgggttctccactccactgccacccccagcgtggctgctttcaagttctttgcaattaaaggttctgtataaaaccaaaaaaaatgt

SEQ ID NO: 409532 - DNA, 1530 bp, Homo sapiens
agcggtgggtgtgcgcagctgcagcggcggttgaggtcaagtagtagcgttgggctgcggcagcggaggagctcaacatgcgtgagtgtatctctatccacgtggggcaggcaggagtccagatcggcaatgcctgctgggaactgtactgcctggaacatggaattcagcccgatggtcagatgccaagtgataaaaccattggtggtggggacgactccttcaacacgttcttcagtgagactggagctggcaagcacgtgcccagagcagtgtttgtggacctggagcccactgtggtcgatgaagtgcgcacaggaacctataggcagctcttccacccagagcagctgatcaccgggaaggaagatgcggccaataattacgccagaggccattacaccatcggcaaggagatcgtcgacctggtcctggaccggatccgcaaactggcggatctgtgcacgggactgcagggcttcctcatcttccacagttttgggggtggcactggctctgggttcgcatctctgctcatggagcggctctcagtggattacggcaagaagtccaagctagaatttgccatttacccagccccccaggtctccacggccgtggtggagccctacaactccatcctgaccacccacacgaccctggaacattctgactgtgccttcatggtcgacaatgaagccatctatgacatatgtcggcgcaacctggacatcgagcgtcccacgtacaccaacctcaatcgcctgattgggcagatcgtgtcctccatcacggcctccctgcgatttgacggggcctgaatgtggacttgacggaattccagaccaacctagtgccgtacccccgcatccacttccccctggccacctacgccccggtcatctcagccgagaaggcctaccacgagcagctgtccgtggctgagatcaccaatgcctgcttcgagccaagccaatcagatggtcaagtgtgaccctcgccacggcaagtacatggcctgctgcatgttgtacaggggggatgtggtcccgaaagatgtcaacgcggccatcgccaccatcaagaccaagcgcaccatccagtttgtagattggtgcccaactggatttaaggtgggcattaactaccagccccccacggtggtccctgggggagacctggccaaggtgcagcgggctgtgtgcatgctgagcaacaccacggccatcgcggaggcctgggctcgcctggaccataagttcgatctcatgtatgccaagcgggcctttgtgcactggtacgtgggagaaggcatggaggagggggagttctctgaggcccgcgaggacctggcagctctggagaaggattatgaagaggtgggcgtggattccgtggaagccgaggctgaagaaggtgaagaatactgaggggagggtgtggtgggttctccactccactgccacccccagcgtggctgctttcaagttctttgcaattaaaggttctgtataaaaccaaaaaaaatgt

SEQ ID NO: 409533 - DNA, 1434 bp, Homo sapiens
agcggtgggtgtgcgcagctgcagcggcggttgaggtcaagtagtagcgttgggctgcggcagcggaggagctcaacatgcgtgagtgtatctctatccacgtggggcaggcaggagtccagatcggcaatgcctgctgggaactgtactgcctggaacatggaattcagcccgatggtcagatgccaagtgataaaaccattggtggtggggacgactccttcaacacgttcttcagtgagactggagctggcaagcacgtgcccagagcagtgtttgtggacctggagcccactgtggtcgatgaagtgcgcacaggaacctataggcagctcttccacccagagcagctgatcaccgggaaggaagatgcggccaataattacgccagaggccattacaccatcggcaaggagatcgtcgacctggtcctggaccggatccgcaaactggcggatctgtgcacgggactgcagggcttcctcatcttccacagttttgggggtggcactggctctgggttcgcatctctgctcatggagcggctctcagtggattacggcaagaagtccaagctagaatttgccatttacccagccccccaggtctccacggccgtggtggagccctacaactccatcctgaccacccacacgaccctggaacattctgactgtgccttcatggtcgacaatgaagccatctatgacatatgtcggcgcaacctggacatcgagcgtcccacgtacaccaacctcaatcgcctgattgggcagatcgtgtcctccatcacggcctccctgcgatttgacggggcctgaatgtggacttgacggaattccagaccaacctagtgccgtacccccgcatccacttccccctggccacctacgccccggtcatctcagccgagaaggcctaccacgagcagctgtccgtggctgagatcaccaatgcctgcttcgagccaagccaatcagatggtcaagtgtgaccctcgccacggcaagtacatggcctgctgcatgttgtacaggggggatgtggtcccgaaagatgtcaacgcggccatcgccaccatcaagaccaagcgcaccatccagtttgtagattggtgcccaactggatttaaggtgggcattaactaccagccccccacggtggtccctgggggagacctggccaaggtgcagcgggctgtgtgcatgctgagcaacaccacggccatcgcggaggcctgggctcgcctggacctggcagctctggagaaggattatgaagaggtgggcgtggattccgtggaagccgaggctgaagaaggtgaagaatactgaggggagggtgtggtgggttctccactccactgccacccccagcgtggctgctttcaagttctttgcaattaaaggttctgtataaaaccaaaaaaaatgt

SEQ ID NO: 409534 - DNA, 737 bp, Homo sapiens
cccttggattctgaagcggaaggagagctgtctcctccagctggtggaaactgcttcctatcctcctcctggagagcccaactcccagagcagatggcagaggagacctttagatggggcggtcacatgtcccagctggccttataacaactgtcccagggaactattaatagatctaccttacacacatctggactttcagatctgaaacgccctggtttggatgacagattatatggtgaacctacttttagagtgtagttcaactcatttgtcacatggatgagaaaatcagtccataaagggtttgctggggccaacaccagcctaagtggagagtaagcgtccattctcctagaccggcacttaaagcctggctgtcacccagccatcccgtctctgtgctggatggacaccaaaccccaaggccctcatctgcctttgtcccagctactgtccagtgcttcagagatggctacttcgtcctcgtggtgtcccaagaaatggccttgacacacaggatcacactggccaacatccacctggcctatgcccccaccagctgctccccaacacagcacacggaagctttcgtggtcttctacttccctctcacccactgtggaaccacaatgcaggtggctggcgaccagctcatctatgagaactggctggtgtctggcatccacatccaaaaggggccacagggttccatcacgcgggacagcaccttccag

SEQ ID NO: 409535 - DNA, 1738 bp, Homo sapiens
atttagtagaaaaatactgtgaaaaatccattacagttaaagtgaacagcacatatggaaattcctcaagaaatattgtgaatcagaatgtacgtgagaacctgaagacactctacagacttacaatggacctttgctctaaactgaaggattatggtttatggcaactatttcgtactttggagcttcctctgataccaattttggcagtgatggaaagccatgccattcaggtgaacaaagaggagatggagaagacgtcagcacttcttggggctcgtctcaaggaattggagcaagaagctcattttgttgcaggagaacggtttcttataacgagcaataaccagcttcgagagatcctctttggcaagttaaagctgcacctgctgagtcaaaggaacagtctccccagaacggggttgcagaaatacccgtctacatcagaagcattaaatgctctgcgagaccttcatccattacccaagataattttggaatacaggcaggttcacaagatcaagtcaacctttgtagatggattactagcttgcatgaaaaagggctccatttcctctacatggaatcagactggaactgtgactggaagactttcagccaagcatcctaatatccaaggtatctccaagcacccaattcagattactacacctaagaattttaaaggtaaagaagacaagattctcacgatctccccgagggccatgtttgtttcatccaaaggccacacctttctagcagcagacttttcacagattgaattgcgcattcttacacatttatctggagatccggaacttctgaagttattccaggaatctgaaagagatgatgtattttctactctgacttcacagtggaaggatgtgcccgtggaacaggtgacacacgcagacagagagcaaaccaagaaggtggtgtacgcggtggtctatggagcagggaaggagcggctggctgcttgccttggagttcctattcaggaagctgcccagtttttggagagttttttgcagaagtacaagaaaatcaaggacttcgcccgagcagctattgcccagtgtcaccagacaggctgtgtggtgtccatcatgggcagaaggagacccctgccaaggattcacgctcatgaccagcaactccgggcacaagcagagcgacaggcagtgaacttcgtggtgcaaggctccgctgctgacctctgcaagctggccatgatccatgtcttcactgcagtggctgcttcccacaccttgacggccaggctggtggcccagatccatgatgagctgctgtttgaagtggaagatccgcagatcccggagtgtgcagctctcgtcaggaggaccatggagtccttggaacaggtacccctcaaggtgagcctgagtgccggccgctcatggggacacctggtgccactgcaggaggcctggggccctccgccaggcccatgtcgcactgagtctcccagcaacagcctggctgcccctgggtcccctgccagcacccagcccccacccctgcatttttcgccttcattttgtctgtagccccaggcaacagtgggaggagagaactggtttccagcagtccattgtgtggccttccccaaggtcaccagctctgtacgccccaggacgcattaaccctttggggctggggtggcccgccatcccctggagtaaatgcctgtgcaaagccctcctcatccttg

SEQ ID NO: 409536 - DNA, 996 bp, Homo sapiens
gtgggaaggaaaagagactccttacctcccttccttagcagggagggaggtaaggaaaaaaaaaatagcctccttggaagttgaagggaatgcagtcctgggccaccctgcctgagagagagcctgggaaatgtcctttgtagctgaggacacagccccacctccaccccacccagcaacaaaggggccaacatgaagaaagagaggaagggcggattggggcaggtcaccggaaatctctgttgcaaagtccacatcccctgtggaaagtgccagcacagcccacctgtaccctggggcttgaaggctgccccttatcccagctggggctctccgtcacatgcccgtgactactgcccggcaaggacgcccatgcagaccagctccctagggccctgggcccgctgtgcccatctgtgccagccaaggacgggcagcaggggcgaagataggacgtgacccctgcccctgaagactcgatccaggagacagagccaaggtcacacagaggacagagctggtggcccagatccatgatgagctgctgtttgaagtggaagatccgcagatcccggagtgtgcagctctcgtcaggaggaccatggagtccttggaacaggtgcaggcattggagctgcagcttcaggtacccctcaaggtgagcctgagtgccggccgctcatggggacacctggtgccactgcaggaggcctggggccctccgccaggcccatgtcgcactgagtctcccagcaacagcctggctgcccctgggtcccctgccagcacccagcccccacccctgcatttttcgccttcattttgtctgtagccccaggcaacagtgggaggagagaactggtttccagcagtccattgtgtggccttccccaaggtcaccagctctgtacgccccaggacgcattaaccctttggggctggggtggcccgccatcccctggagtaaatgcctgtgcaaagccctcctcatccttg

SEQ ID NO: 409537 - DNA, 490 bp, Homo sapiens
ctgggacattcagaagggtcacactttagaggcaggtctagactagccctagattacagctattccaaatccactctaacaaagcttagaagcaaacctcaaaagggtcaagatgattggcaagtaacttaagcctgccaaaacaccctcagaaggaagacagcacaccccagcattcaacaacataaaattcacagtgcccagcatccggccaaaagtcactagaccgacaaagcagcagaagctgaaagggaccaagtcagagcagaagatctctcgtgtcctcactgccagtccttcttaagaatcttgtatattgcctggcatgtagctgtgtggtgtccatcatgggcagaaggagacccctgccaaggattcacgctcatgaccagcaactccgggcacaagcagagcgacaggcagtgaacttcgtggtgcaagacagctcagagccagcacctctgtgtggaggtaccgtgagagctgtggc

SEQ ID NO: 409538 - DNA, 434 bp, Homo sapiens
tgtgcaggcaaaaaggacacccgtaccccatcttccttttcagatttgtgccagacaggtggcttctgatttccagaaatgtgttgaagtatctgatgctatgatgaacagctccattttttggtggttgttgaagctgtatctctgatgaagaaaaaaaaaaaaaagctctaaattcccttgaacttatgatgcagcttgcatcacacttaaagcacttaactttctaaatggctctgtattttgaactaaaaaagactcatgattaatttctcattatagaaaattccttagatacagaaaagaaataaaaatagtaataagtcacttgttatccactgtgcagaactgtggtatctatctttccacactttttgctaagcacatatatttataaaatacaattttttaggccaggcgcagtggctcatgcc

SEQ ID NO: 409539 - DNA, 389 bp, Homo sapiens
aaaggactgaacgaatgtttatccaggggctccaggtttcagagcaagccctgagaaagcctgagcttgcgggtcccacctctggcccctgcccaggccttccctttcgtagggctctgagccccactgctgcatggtgatccacgccccaacaacggggtcagcctgcctgtggcacaaagccactgttgcctcaaacttcaccgggcagtagtggggatggggggttcttgtgtgcctggtggctctggctggtgggggctccctgtgcctcccccatcctcccagccccagtgctctgtacgccccaggacgcattaaccctttggggctggggtggcccgccatcccctggagtaaatgcctgtgcaaagccctcctcatccttg

SEQ ID NO: 409540 - DNA, 2754 bp, Homo sapiens
atttagtagaaaaatactgtgaaaaatccattacagttaaagtgaacagcacatatggaaattcctcaagaaatattgtgaatcagaatgtacgtgagaacctgaagacactctacagacttacaatggacctttgctctaaactgaaggattatggtttatggcaactatttcgtactttggagcttcctctgataccaattttggcagtgatggaaagccatgccattcaggtgaacaaagaggagatggagaagacgtcagcacttcttggggctcgtctcaaggaattggagcaagaagctcattttgttgcaggagaacggtttcttataacgagcaataaccagcttcgagagatcctctttggcaagttaaagctgcacctgctgagtcaaaggaacagtctccccagaacggggttgcagaaatacccgtctacatcagaagcattaaatgctctgcgagaccttcatccattacccaagataattttggaatacaggcaggttcacaagatcaagtcaacctttgtagatggattactagcttgcatgaaaaagggctccatttcctctacatggaatcagactggaactgtgactggaagactttcagccaagcatcctaatatccaaggtatctccaagcacccaattcagattactacacctaagaattttaaaggtaaagaagacaagattctcacgatctccccgagggccatgtttgtttcatccaaaggccacacctttctagcagcagacttttcacagattgaattgcgcattcttacacatttatctggagatccggaacttctgaagttattccaggaatctgaaagagatgatgtattttctactctgacttcacagtggaaggatgtgcccgtggaacaggtgacacacgcagacagagagcaaaccaagaaggtggtgtacgcggtggtctatggagcagggaaggagcggctggctgcttgccttggagttcctattcaggaagctgcccagtttttggagagttttttgcagaagtacaagaaaatcaaggacttcgcccgagcagctattgcccagtgtcaccagacaggctgtgtggtgtccatcatgggcagaaggagacccctgccaaggattcacgctcatgaccagcaactccgggcacaagcagagcgacaggcagtgaacttcgtggtgcaaggctccgctgctgacctctgcaagctggccatgatccatgtcttcactgcagtggctgcttcccacaccttgacggccagcccttgtggaattgataaaggaagttggcatgtgaggagctgaggtctctctctgttgctgactgagtccttctgaaagctggacacagacacttttactcaggaacgcagttactcgctggtcatccttctgtcatcagccattggctgtcacgaggaaatgcttctcatagcaaaatgcaaagcagactcgtgtggaatattgggcacatggtctgtgttttgtgaacgtgatttgttcttccaggagtaatgtgaaaggctgtggatggcgtctggaagggacgggtgcaggctcagtgtggccaggcatctctcgctgaagcagcaggcatgaaactcgatcactgggaggcacacggtgcccctagagtgagctgagatcgcaccacttcactccagcctgggcgagagcgagagtctgtctaacagaaaaaaaaataagattcactctcagtcctctcctgccccatctcactgccatctgcattcattcccaacacacacgtgcacacacacgcacacacaagcacatgcacccatacacgtgttcacccatgcatacaacccatgcacacacatatacgcatatacactgatgccaggcagcctctagtgccccacagtgttctcatggtgtcctgaaatccatgcatcccgctcacttccacagtttctgcaggtaaattatagcttctcccaggatatgagcagcttgtgctagtttccgtcttggcaggaactgaaagccaaatggtggtcctgcctctaagatactgcaagtctagaaaagttgattcaaggctgggcgcagtggctcacacctgtaatcccagcatttgggaggccgagtcgggtggatcacttgagctcagaagtttcgatgaacaacatatgtgttgcctgggcaacataatgaaacctgtctctacaaaataaaagctggccatggtggtgcacacctgtagtcccagctactcaggaggctgaagtgggaggatcacctgagcctgggagttcaaggctgcagtgagccatgatcataccactgcactccagcctgggcaacagggcaagaacctgcctcaaaaaaagaaaaaaatcggttcactttcagcccttgtggaattgataaaggaagttggcatgtgaggagctgaggtctctctctgttgctgactgagtccttctgaaagctggacacagacacttttactcaggaacgcagttactcgctggtcatccttctgtcatcagccattggctgtcacgaggaaatgcttctcatagcaaaatgcaaagcagactcgtgtggaatattgggcacatggtctgtgttttgtgaacgtgatttgttcttccaggagtaatgtgaaaggctgtggatggcgtctggaagggacgggtgcaggctcagtgtggccaggcatctctcgctgaagcagcaggcatgaaactcgatcactggg

SEQ ID NO: 409541 - DNA, 1113 bp, Homo sapiens
ggaggtggctgctccagcctcacaccttgcaggaaaggagaaagtcatagtggtcagaaaagcatctgcccctgggcagccctttacagtcagccgtttaaagagccttcccttttaggactttcctggagtctcttttccttcccactccttacctccctccctgctaaggaaaaaaaaaatagcctccttggaagttgaagggaatgcagtcctgggccaccctgcctgagagagagcctgggaaatgtcctttgtagctgaggacacagccccacctccaccccacccagcaacaaaggggccaacatgaagaaagagaggaagggcggattggggcaggtcaccggaaatctctgttgcaaagtccacatcccctgtggaaagtgccagcacagcccacctgtaccctggggcttgaaggctgccccttatcccagctggggctctccgtcacatgcccgtgactactgcccggcaaggacgcccatgcagaccagctccctagggccctgggcccgctgtgcccatctgtgccagccaaggacgggcagcaggggcgaagataggacgtgacccctgcccctgaagactcgatccaggagacagagccaaggtcacacagaggacagagctggtggcccagatccatgatgagctgctgtttgaagtggaagatccgcagatcccggagtgtgcagctctcgtcaggaggaccatggagtccttggaacaggtgcaggcattggagctgcagcttcaggtacccctcaaggtgagcctgagtgccggccgctcatggggacacctggtgccactgcaggaggcctggggccctccgccaggcccatgtcgcactgagtctcccagcaacagcctggctgcccctgggtcccctgccagcacccagcccccacccctgcatttttcgccttcattttgtctgtagccccaggcaacagtgggaggagagaactggtttccagcagtccattgtgtggccttccccaaggtcaccagctctgtacgccccaggacgcattaaccctttggggctggggtggcccgccatcccctggagtaaatgcctgtgcaaagccctcctcatccttg

SEQ ID NO: 409542 - DNA, 718 bp, Homo sapiens
ggacccccgggagggctctcctggcctctaggagccaccaatcctcccgggggcaggaccctgaggggcaagcacaggatgccccaggacacacccacccatccaagggcaccttgtctgccggccgcagcctacccactggcacagaggccctggcaggtgggggaacctccgccaagatcgaggtgtcgtgactgggaggtggatgtggcataagcctgttgctgggcgagtgtggtgagtgtgcacgtgtatgcacatgtgtgcgtgtggctgtctgatcatgtatctggatgtgtgcacctgtgtgctgtaggccctgtccccctgcttggggtctgggaggtggctgggggtggctggcccaggcgtggggctcacctctggctgccacctgcaggtacccctcaaggtgagcctgagtgccggccgctcatggggacacctggtgccactgcaggaggcctggggccctccgccaggcccatgtcgcactgagtctcccagcaacagcctggctgcccctgggtcccctgccagcacccagcccccacccctgcatttttcgccttcattttgtctgtagccccaggcaacagtgggaggagagaactggtttccagcagtccattgtgtggccttccccaaggtcaccagctctgtacgccccaggacgcattaaccctttggggctggggtggcccgccatcccctggag

SEQ ID NO: 409543 - DNA, 507 bp, Homo sapiens
acatagcattgctggagtttacactgattctttttaactaataaagggctccatttcctctacatggaatcagactggaactgtgactggaagactttcagccaagcatcctgtaagttgtttaaacaactgtctttgttaaacgccattttcctgccttgctattgaagttttttctccatatgtgtttgcctgtgcactttctgtttccaagagggaacttcatactgatatgttgtgttttattctgtttattctgagaacatagcaggagaacaagacagatgggttctcttctcatgaagtgctgagttagcaagaggggggcttcacacccagaaacccatgcaccagtgtgcaggcaaaaaggacacccgtaccccatcttccttttcagatttgtgccagacaggtggcttctgatttccagaaatgtgttgaagtatctgatgctatgatgaacagctccattttttggtggttgttgaagctgtatctctgatgaag

SEQ ID NO: 409544 - DNA, 774 bp, Homo sapiens
aatttagcaataatgtcgtgctaggacatgagagggattaacattgaagacacagcctctatctttaagtaattcataatttagccaaatatattaaatatctgtaatataaaacttacctaggaaagtaaaatagagatccaagaatcaggagtcctaaagcatataatgagtctgttcctcttggaagccacacatgtcaaggtcatcagtaagcaggcctactctttcttcatattctgggttaatgttcaccttgactgcttggtaaatttccctcactggtgctgaagtaaccaaaatggggaaggagtgatgaaaactcatctttgagtaagcttagtgggaaatagtatatctgggcctatagagaagttgggtcattacttagaatgacaactggaaaagtacatagactgcttgccaatcagtttgttgtaccatgtacctgttcacagactcttttcaaaaaacaagtttattttactttttttggtactttggtcatgttgtttccttggtaaagatcaaagttgaataaagcttaacaaagtttaataaagaaaaggaataaattactatctaaatgtgttaaaagcaatcaccaagtttaatcacttaaaaaataaatattctcttaacagaaatgtcagcggttacttacaatgcttagcagctaaattccatgagtataacgtttaatgtctttttggtacattaaatattcagtgcctttgatgaagggaacaaactgataatttcattcatgtgcag

SEQ ID NO: 409545 - DNA, 442 bp, Homo sapiens
tgcaaatgggagaggaagctggtaatgaatacatattttgcatgtgattagtaagattttcctaactggatagatagaggaaagaaaataaaataaaactaagcgttttataggggtagttattttagggagcaggaaaaacagagaatgggataaatacaacaaaaactctaaatgtaagtagtataacaaggaaaatcaggagataacaggaattttggaatagactcaacagggagggggtttagaagctgaaagtaaattacagtctaggtcttgacattatctagattataatggttagaatagtctattgtctacattcttacaatttgatatccctcatcaattcaacatcaaattaaatttataacagcaccaactcctttatgattaaatgaaaaagtttatagctctaacctgtcttatggttgtgattcat

SEQ ID NO: 409546 - DNA, 269 bp, Homo sapiens
tgcactgcagcctgggtgacagagagagagactctgtctaaaaaaagtaaatgattagtacataacttgtattaccaaatgacttgcccaacattgttagttaatggaaaccaatgatatccctagtaactgtcagggctaagaagttcatttttatagcctgttacgaaaaagttttgaaataaaccaacatatttatacttgagagagtagttgtctgtttattattttaaatagaccagaactatgattggtgagagacaaattat

SEQ ID NO: 409547 - DNA, 434 bp, Homo sapiens
aaaaacaaaaaaagaaacaaacaaaaaaaaaacaaaacacaacacatcctttggcccatcaattgtcctcagtagctaccctagagaaattattgctcacatgctcaaagaagcatgcccaaggatgctttagctactatattgcttgagcactccgccagtagaggaatggctgaataaagcctgtccatccctcctatgggacacactgcagggttgacaacaaagagggaggtttgtagggaccggcatgatccttgagacatgatgtagggggagaaaaccaagctacagatggatgtgctaagcagacaggataccaatcatgtttacagcccccactagacaatcctctacatcgtctgcatctttacatgtgggaatacccagaacagcgtgtggcatcccctaaacttcttagagagggagagaaa

SEQ ID NO: 409548 - DNA, 651 bp, Homo sapiens
ttcggcacatgagggagggtacctttcacatgatctgcctcagggaaggatcagacaatctttgctatacatgctgttttccaaattccttcaacctaaaatattcagtattccaagtcaccatattttggggtagtatgtcttgaaccttatcatcagtgatgtaatattcctccccagaaaatccttttgttggtaagttacaaacaattgctataacgattgttgacccactggcttcctacaggcaacccagctatactcagctgagtgtcaattcataagggttggaatcatttgagtttgctgcctgcacagtttgtgtctctaagccctgtgatactacctagtcctacgtttaaagagtaggttcaaaataaacaatggtaatacaacaattctaagggtaaagtgacagagcttgccttattgcacttttgtgtgcagatctttctctaaccttgtagcatttattcctttggacgtgtttcttttatgctctccttctcccttaaaataaatacttaaatgtaattaaaaattattaatccattactttgtttccttttttgtactgtgataattttctaactgacttgaatgtacatacaaaatttaataaaagactatgttttatgtttgccattaaaa

SEQ ID NO: 409549 - DNA, 629 bp, Homo sapiens
gttgcagtgagctgagatcatgccactgcactccagcctgggtgagtgagactctgtctcaaaaaaaaaaaaaaaaccccaaaaggcagcaagcaagatgtggctcgtggattgtagtttaccggccctgtcttagtggttaaatatctagctttaactctgtccatttctttgtcccccaagaaaatgtattggtgtgcacatgagtgagcttgaatgtgctctaaattatttgtgaaaaattattagcaaactttgatacttgtaactaagagattacttgtaacttacctcatgacttggaactcttaagatgaattcaaacaccaggctatcaagactaaggatacacaggttgagaatccctgaaccgcaaattggaaatgctttaaaatctacacttctggagcgctgacaggaggccacaagtggaaaatttcgcacctgacctcctgtgatgggtcaaggtcaaaacgcagtcgaaactttgtttcatatatgaaattgtcaaaaatattgtataaagttatctacaggctatgtgtgtaaggtgtatatgaaacaaaggaattttgtgtttagacttgatacatccccaaggtacatcattatgtatatgcagatttaaa

SEQ ID NO: 409550 - DNA, 1373 bp, Homo sapiens
taaaggtgggccactgcccccacagtttctctctgcttctggtcagctgggttgtcctgcatggtgacgggtgtcatcccgaacaaatcagatggcatcagaggcactccatcaagtgggagatggggaggaggctgtactgaagaaagaaaacttcaacatgatgaatgcccttgaccaactgccaaaaccctttccaaaccccaagtctatgaaccggaccgtcactaccaaaggactcccactagcctcaaagggcaatttggtcaacttcttggaggatgataccatcaacctactgaagccgctgccagtagaggattcagactgcagctctgatgagaccagcatctctgccttctcatccaccttgctgaaccccatcaaattagctgtgacccagcccaacagcagcttctttgcagggatgctggagggggagctgaacaaactcagcttctccccaatggccaagaatgcagaaaatgaggacctggcgctcggcccctgcccatgcccatcgaagtcccagatggccacaaggggcctgctggaccttgacaaccctgagctggagacagaaacctcctcaacgcactcagaatcttctgtggttgtggacctgccggacacccccttcatctttgagcacaccgtcaacaattccacagctgtgatttcctggacctacgccttgggcaagcagccggtcagtttctaccagctcctgttacaggaggtggccaagacacaggagaatgagttgcccgaggcaaagaatcgtccatggatcttcaacaagattttgggcactactgtcaagctgatggagctaaagcctaacacgtgttactgcctcagtgtccgtgcagccaacacagctggggtggggaagtggtgcaagccctacaaatttgcaaccctggccactgacttcagcagctttcctgagaactaccccatccagatcaccgtgcggcgcaaggaaccccggcaaaagatcgtgtccatcgggccggaggagatgcggaggctggaggatctggaatacctatttccctgttaagggggagggccccaggacacccctcacctactttcagcttcaaccccaggccctcagaaaccagagccatgagacctaccataccaccagcaccctgcgggcccggggtctggcagagtggtatgggcaccccacccctgggctggggccaaggctacataggggccccattcacctggaggcatctcaggccaggccatgccaggctcagccactgcccacagctgctagactccctcctcctccaaatctgggctgggtctaggtccctcattaaagaactgcaggtcatccagcaaaaaaaaaa

SEQ ID NO: 409551 - DNA, 382 bp, Homo sapiens
gcatcactaagtggacaagggccaggtgacaggtgatgaggtcagtgggcttaggcctgcagtccagagggagtgtgcagatacagaagaaaaggaggaaggtgttggctgtgagtccaataccagcttgggaaaaaagggcaatttttaatagtgtcataagtggactatggtcgtcttaatggtgaagagggatcatattttatatatctgaaaaagcaatagatatcctatcatcagtattatttattgcacggtcaaaattattaccaatattatcattttaattttacccatttatcctgattaacctggactatctcatataaattctttaaaatgtagcctaagcattttatcttacaacaaataagttatacgt

SEQ ID NO: 409552 - DNA, 497 bp, Homo sapiens
gctttgtcagatgaccaaccaactgcaagggaagctggaaaatggagctacctgtgtggccagggaaaaaaaatcccaggaaaaggatttactgagtgtgtatgaaatgttagtcagttctcagtgattttagaacagaagcaacagtgctctgtaaatttcctttttctatgcatgtgtagttattagtgttgctgttttcactatcatggtgtttgcatagtgttttggggattgtattttgtttcttttgttttggggtgggttttttttttcttatcttgttttttctgtagtgaagaatgcacatagaggtactgcatgagatccaattcctacaagtgaccacaagtcatttcatttcctcattgttgcatagagtaataatttgggcaagttgcagctggaagtaatttttttaaaaagccaaatgagaggtctcaagcaaaatagaagattatttctcccacacattaaagtctaggtaggcagtctag

SEQ ID NO: 409553 - DNA, 406 bp, Homo sapiens
ccatcaggacagcagtgtgaagaaagtgtggtgagttccatctcacagatgatcaagctctggctcacagatactaagaccctctccagataactggcagaatggcaatgaggttctatctcctaccctcccacacaatggaaccagcagcttcttatttggaggatgataattttatacttccccagtattgttccctaagggtactcactcaacagcccttcacattgaggaagaggatggtagagatgaaatcctgccctttgggcatgaggcatagctgtggggtcatatggattaccaggtctctgaggttaactgtggggtgaaataaagaaatataacctcatgtggaacaagaaagagcagtgaagagaatagaaaacagcaggccctccagggatca

SEQ ID NO: 409554 - DNA, 2217 bp, Homo sapiens
actgaagtaatcagattggactgttaaaatagcaaatgaaaatcagaagggaggtgcagtgacagcgaacccactttttccctttggaccccagttatgaagaaaaaattggaaactgaacttgtgacctataagatgaccctagacccaagaggctgggttgaagagagggcacagctcagttctagcacagccaatgccttttacgtgtgtaatttggtcccaagaagacccagcctgcaagcctagtggaatcagaatagagaaaagttctcattctgcacatacagcattcagagcctcgtcatcatacattatagatggtatagcatccagccaggtgctgatgttataaaaaatgatggaatttactcgaggtattttttctcctttgctgcaaatggtagatatagcttgaaagtgcatgtcaatcactctcccagcataagcaccccagcccactctattccagggagtcatgctatgtatgtaccaggttacacagcaaacggtaatattcagatgaatgctccaaggaaatcagtaggcagaaatgaggaggagcgaaagtggggctttagccgagtcagctcaggaggctccttttcagtgctgggagttccagctggcccccaccctgatgtgtttccaccatgcaaaattattgacctggaagctgtaaaagtagaagaggaattgaccctatcttggacagcacctggagaagactttgatcagggccaggctacaagctatgaaataagaatgagtaaaagtctacagaatatccaagatgactttaacaatgctattttagtaaatacatcaaagcgaaatcctcagcaagctggcatcagggagatatttacgttctcaccccaaatttccacgaatggacctgaacatcagccaaatggagaaacacatgaaagccacagaatttatgttgcaatacgagcaatggataggaactccttacagtctgctgtatctaacattgcccaggcgcctctgtttattccccccaattctgatcctgtacctgccagagattatcttatattgaaaggagttttaacagcaatgggtttgataggaatcatttgccttattatagttgtgacacatcatactttaagcaggaaaaagagagcagacaagaaagagaatggaacaaaattattataaataaatatccaaagtgtcttccttcttagatataagacccatggccttcgactacaaaaacatactaacaaagtcaaattaacatcaaaactgtattaaaatgcattgagtttttgtacaatacagataagatttttacatggtagatcaacaaattctttttgggggtagattagaaaacccttacactttggctatgaacaaataataaaaattattctttaaagtaatgtctttaaaggcaaagggaagggtaaagtcggaccagtgtcaaggaaagtttgttttattgaggtggaaaaatagccccaagcagagaaaaggagggtaggtctgcattataactgtctgtgtgaagcaatcatttagttactttgattaatttttcttttctccttatctgtgcagaacaggttgcttgtttacaactgaagatcatgctatattttatatatgaagcccctaatgcaaagctctttacctcttgctattttgttatatatattacagatgaaatctcactgctaatgctcagagatcttttttcactgtaagaggtaacctttaacaatatgggtattacctttgtctcttcataccggttttatgacaaaggtctattgaatttatttgtttgtaagtttctactcccatcaaagcagctttctaagttattgccttggttattatggatgatagttatagcccttataatgccttaactaaggaagaaaagatgttattctgagtttgttttaatacatatatgaacatatagttttattcaattaaaccaaagaagaggtcagcagggagatactaacctttggaaatgattagctggctctgttttttggttaaataagagtctttaatcctttctccatcaagagttacttaccaagggcaggggaagggggatatagaggtcacaaggaaataaaaatcatctttcatctttaattttactccttcctcttatttttttaaaagattatcgaacaataaaatcatttgcctttttaaaaa

SEQ ID NO: 409555 - DNA, 4023 bp, Homo sapiens
tcccagatggatccaccccagacttttcaaagaagacacctccttcatcttgtgttctaaaaccttgcaagttcaggaagaaaccatctgcatccatattgaaaacctgacacaatgtatgcagcaggctcagtgtgagtgaactggaggcttctctacaacatgacccaaaggagcattgcaggtcctatttgcaacctgaagtttgtgactctcctggttgccttaagttcagaactcccattcctgggagctggagtacagcttcaagacaatgggtataatggattgctcattgcaattaatcctcaggtacctgagaatcagaacctcatctcaaacattaaggaaatgataactgaagcttcattttacctatttaatgctaccaagagaagagtatttttcagaaatataaagattttaatacctgccacatggaaagctaataataacagcaaaataaaacaagaatcatatgaaaaggcaaatgtcatagtgactgactggtatggggcacatggagatgatccatacaccctacaatacagagggtgtggaaaagagggaaaatacattcatttcacacctaatttcctactgaatgataacttaacagctggctacggatcacgaggccgagtgtttgtccatgaatgggcccacctccgttggggtgtgttcgatgagtataacaatgacaaacctttctacataaatgggcaaaatcaaattaaagtgacaaggtgttcatctgacatcacaggcatttttgtgtgtgaaaaaggtccttgcccccaagaaaactgtattattagtaagctttttaaagaaggatgcacctttatctacaatagcacccaaaatgcaactgcatcaataatgttcatgcaaagtttatcttctgtggttgaattttgtaatgcaagtacccacaaccaagaagcaccaaacctacagaaccagatgtgcagcctcagaagtgcatgggatgtaatcacagactctgctgactttcaccacagctttcccatgaatgggactgagcttccacctcctcccacattctcgcttgtacaggctggtgacaaagtggtctgtttagtgctggatgtgtccagcaagatggcagaggctgacagactccttcaactacaacaagccgcagaattttatttgatgcagattgttgaaattcataccttcgtgggcattgccagtttcgacagcaaaggagagatcagagcccagctacaccaaattaacagcaatgatgatcgaaagttgctggtttcatatctgcccaccactgtatcagctaaaacagacatcagcatttgttcagggcttaagaaaggatttgaggtggttgaaaaactgaatggaaaagcttatggctctgtgatgatattagtgaccagcggagatgataagcttcttggcaattgcttacccactgtgctcagcagtggttcaacaattcactccattgccctgggttcatctgcagccccaaatctggaggaattatcacgtcttacaggaggtttaaagttctttgttccagatatatcaaactccaatagcatgattgatgctttcagtagaatttcctctggaactggagacattttccagcaacatattcagcttgaaagtacaggtgaaaatgtcaaacctcaccatcaattgaaaaacacagtgactgtggataatactgtgggcaacgacactatgtttctagttacgtggcaggccagtggtcctcctgagattatattatttgatcctgatggacgaaaatactacacaaataattttatcaccaatctaacttttcggacagctagtctttggattccaggaacagctaagcctgggcactggacttacaccctgaacaatacccatcattctctgcaagccctgaaagtgacagtgacctctcgcgcctccaactcagctgtgcccccagccactgtggaagcctttgtggaaagagacagcctccattttcctcatcctgtgatgatttatgccaatgtgaaacagggattttatcccattcttaatgccactgtcactgccacagttgagccagagactggagatcctgttacgctgagactccttgatgatggagcaggtgctgatgttataaaaaatgatggaatttactcgaggtattttttctcctttgctgcaaatggtagatatagcttgaaagtgcatgtcaatcactctcccagcataagcaccccagcccactctattccagggagtcatgctatgtatgtaccaggttacacagcaaacggtaatattcagatgaatgctccaaggaaatcagtaggcagaaatgaggaggagcgaaagtggggctttagccgagtcagctcaggaggctccttttcagtgctgggagttccagctggcccccaccctgatgtgtttccaccatgcaaaattattgacctggaagctgtaaaagtagaagaggaattgaccctatcttggacagcacctggagaagactttgatcagggccaggctacaagctatgaaataagaatgagtaaaagtctacagaatatccaagatgactttaacaatgctattttagtaaatacatcaaagcgaaatcctcagcaagctggcatcagggagatatttacgttctcaccccaaatttccacgaatggacctgaacatcagccaaatggagaaacacatgaaagccacagaatttatgttgcaatacgagcaatggataggaactccttacagtctgctgtatctaacattgcccaggcgcctctgtttattccccccaattctgatcctgtacctgccagagattatcttatattgaaaggagttttaacagcaatgggtttgataggaatcatttgccttattatagttgtgacacatcatactttaagcaggaaaaagagagcagacaagaaagagaatggaacaaaattattataaataaatatccaaagtgtcttccttcttagatataagacccatggccttcgactacaaaaacatactaacaaagtcaaattaacatcaaaactgtattaaaatgcattgagtttttgtacaatacagataagatttttacatggtagatcaacaaattctttttgggggtagattagaaaacccttacactttggctatgaacaaataataaaaattattctttaaagtaatgtctttaaaggcaaagggaagggtaaagtcggaccagtgtcaaggaaagtttgttttattgaggtggaaaaatagccccaagcagagaaaaggagggtaggtctgcattataactgtctgtgtgaagcaatcatttagttactttgattaatttttcttttctccttatctgtgcagaacaggttgcttgtttacaactgaagatcatgctatattttatatatgaagcccctaatgcaaagctctttacctcttgctattttgttatatatattacagatgaaatctcactgctaatgctcagagatcttttttcactgtaagaggtaacctttaacaatatgggtattacctttgtctcttcataccggttttatgacaaaggtctattgaatttatttgtttgtaagtttctactcccatcaaagcagctttctaagttattgccttggttattatggatgatagttatagcccttataatgccttaactaaggaagaaaagatgttattctgagtttgttttaatacatatatgaacatatagttttattcaattaaaccaaagaagaggtcagcagggagatactaacctttggaaatgattagctggctctgttttttggttaaataagagtctttaatcctttctccatcaagagttacttaccaagggcaggggaagggggatatagaggtcacaaggaaataaaaatcatctttcatctttaattttactccttcctcttatttttttaaaagattatcgaacaataaaatcatttgcctttttaaaaa

SEQ ID NO: 409556 - DNA, 2011 bp, Homo sapiens
tcccagatggatccaccccagacttttcaaagaagacacctccttcatcttgtgttctaaaaccttgcaagttcaggaagaaaccatctgcatccatattgaaaacctgacacaatgtatgcagcaggctcagtgtgagtgaactggaggcttctctacaacatgacccaaaggagcattgcaggtcctatttgcaacctgaagtttgtgactctcctggttgccttaagttcagaactcccattcctgggagctggagtacagcttcaagacaatgggtataatggattgctcattgcaattaatcctcaggtacctgagaatcagaacctcatctcaaacattaaggaaatgataactgaagcttcattttacctatttaatgctaccaagagaagagtatttttcagaaatataaagattttaatacctgccacatggaaagctaataataacagcaaaataaaacaagaatcatatgaaaaggcaaatgtcatagtgactgactggtatggggcacatggagatgatccatacaccctacaatacagagggtgtggaaaagagggaaaatacattcatttcacacctaatttcctactgaatgataacttaacagctggctacggatcacgaggccgagtgtttgtccatgaatgggcccacctccgttggggtgtgttcgatgagtataacaatgacaaacctttctacataaatgggcaaaatcaaattaaagtgacaaggtgttcatctgacatcacaggcatttttgtgtgtgaaaaaggtccttgcccccaagaaaactgtattattagtaagctttttaaagaaggatgcacctttatctacaatagcacccaaaatgcaactgcatcaataatgttcatgcaaagtttatcttctgtggttgaattttgtaatgcaagtacccacaaccaagaagcaccaaacctacagaaccagatgtgcagcctcagaagtgcatgggatgtaatcacagactctgctgactttcaccacagctttcccatgaatgggactgagcttccacctcctcccacattctcgcttgtacaggctggtgacaaagtggtctgtttagtgctggatgtgtccagcaagatggcagaggctgacagactccttcaactacaacaagccgcagaattttatttgatgcagattgttgaaattcataccttcgtgggcattgccagtttcgacagcaaaggagagatcagagcccagctacaccaaattaacagcaatgatgatcgaaagttgctggtttcatatctgcccaccactgtatcagctaaaacagacatcagcatttgttcagggcttaagaaaggatttgaggtggttgaaaaactgaatggaaaagcttatggctctgtgatgatattagtgaccagcggagatgataagcttcttggcaattgcttacccactgtgctcagcagtggttcaacaattcactccattgccctgggttcatctgcagccccaaatctggaggaattatcacgtcttacaggaggtttaaagttctttgttccagatatatcaaactccaatagcatgattgatgctttcagtagaatttcctctggaactggagacattttccagcaacatattcagcttgaaagtacaggtgaaaatgtcaaacctcaccatcaattgaaaaacacagtgactgtggataatactgtgggcaacgacactatgtttctagttacgtggcaggccagtggtcctcctgagattatattatttgatcctgatggacgaaaatactacacaaataattttatcaccaatctaacttttcggacagctagtctttggattccaggaacagctaagcttagaagattcgcatttattccagatgggaggctgaatctctcagttgtagattttgacacattggcactatttttgtttctgatttattgccttggccataaggtcaaaggcaacaataaagtgtactttcatt

SEQ ID NO: 409557 - DNA, 2251 bp, Homo sapiens
tcccagatggatccaccccagacttttcaaagaagacacctccttcatcttgtgttctaaaaccttgcaagttcaggaagaaaccatctgcatccatattgaaaacctgacacaatgtatgcagcaggctcagtgtgagtgaactggaggcttctctacaacatgacccaaaggagcattgcaggtcctatttgcaacctgaagtttgtgactctcctggttgccttaagttcagaactcccattcctgggagctggagtacagcttcaagacaatgggtataatggattgctcattgcaattaatcctcaggtacctgagaatcagaacctcatctcaaacattaaggaaatgataactgaagcttcattttacctatttaatgctaccaagagaagagtatttttcagaaatataaagattttaatacctgccacatggaaagctaataataacagcaaaataaaacaagaatcatatgaaaaggcaaatgtcatagtgactgactggtatggggcacatggagatgatccatacaccctacaatacagagggtgtggaaaagagggaaaatacattcatttcacacctaatttcctactgaatgataacttaacagctggctacggatcacgaggccgagtgtttgtccatgaatgggcccacctccgttggggtgtgttcgatgagtataacaatgacaaacctttctacataaatgggcaaaatcaaattaaagtgacaaggtgttcatctgacatcacaggcatttttgtgtgtgaaaaaggtccttgcccccaagaaaactgtattattagtaagctttttaaagaaggatgcacctttatctacaatagcacccaaaatgcaactgcatcaataatgttcatgcaaagtttatcttctgtggttgaattttgtaatgcaagtacccacaaccaagaagcaccaaacctacagaaccagatgtgcagcctcagaagtgcatgggatgtaatcacagactctgctgactttcaccacagctttcccatgaatgggactgagcttccacctcctcccacattctcgcttgtacaggctggtgacaaagtggtctgtttagtgctggatgtgtccagcaagatggcagaggctgacagactccttcaactacaacaagccgcagaattttatttgatgcagattgttgaaattcataccttcgtgggcattgccagtttcgacagcaaaggagagatcagagcccagctacaccaaattaacagcaatgatgatcgaaagttgctggtttcatatctgcccaccactgtatcagctaaaacagacatcagcatttgttcagggcttaagaaaggatttgaggtggttgaaaaactgaatggaaaagcttatggctctgtgatgatattagtgaccagcggagatgataagcttcttggcaattgcttacccactgtgctcagcagtggttcaacaattcactccattgccctgggttcatctgcagccccaaatctggaggaattatcacgtcttacaggaggtttaaagttctttgttccagatatatcaaactccaatagcatgattgatgctttcagtagaatttcctctggaactggagacattttccagcaacatattcagcttgaaagtacaggtgaaaatgtcaaacctcaccatcaattgaaaaacacagtgactgtggataatactgtgggcaacgacactatgtttctagttacgtggcaggccagtggtcctcctgagattatattatttgatcctgatggacgaaaatactacacaaataattttatcaccaatctaacttttcggacagctagtctttggattccaggaacagctaagcctgggcactggacttacaccctgaacaatacccatcattctctgcaagccctgaaagtgacagtgacctctcgcgcctccaactcagctgtgcccccagccactgtggaagcctttgtggaaagagacagcctccattttcctcatcctgtgatgatttatgccaatgtgaaacagggattttatcccattcttaatgccactgtcactgccacagttgagccagagactggagatcctgttacgctgagactccttgatgatggagcaggctgatgtgtctattgaagattctgtgatctcactctcaggagaccattgcatcattggccgcacactggtggcccatgaagaagcagatgacttggcaaataag

SEQ ID NO: 409558 - DNA, 965 bp, Homo sapiens
tcccagatggatccaccccagacttttcaaagaagacacctccttcatcttgtgttctaaaaccttgcaagttcaggaagaaaccatctgcatccatattgaaaacctgacacaatgtatgcagcaggctcagtgtgagtgaactggaggcttctctacaacatgacccaaaggagcattgcaggtcctatttgcaacctgaagtttgtgactctcctggttgccttaagttcagaactcccattcctgggagctggagtacagcttcaagacaatgggtataatggattgctcattgcaattaatcctcaggtacctgagaatcagaacctcatctcaaacattaaggaaatgataactgaagcttcattttacctatttaatgctaccaagagaagagtatttttcagaaatataaagattttaatacctgccacatggaaagctaataataacagcaaaataaaacaagaatcatatgaaaaggcaaatgtcatagtgactgactggtatggggcacatggagatgatccatacaccctacaatacagagggtgtggaaaagagggaaaatacattcatttcacacctaatttcctactgaatgataacttaacagctggctacggatcacgaggccgagtgtttgtccatgaatgggcccacctccgttggggtgtgttcgatgagtataacaatgacaaacctttctacataaatgggcaaaatcaaattaaagtgacaaggtgttcatctgacatcacaggcatttttgtgtgtgaaaaaggtccttgcccccaagaaaactgtattattagtaagctttttaaagaaggatgcacctttatctacaatagcacccaaaatgcaactgcatcaataatgttcatgcaaagtttatcttctgtggttgaattttgtaatgcaagtaccacatccagagtgtcgggatcctcatagagtca

SEQ ID NO: 409559 - DNA, 290 bp, Homo sapiens
atctctctgtctaatttctaatcactgtaaatatgttcaaaatgaaagaaaaaagtaatcttcacatgtatccccaaaccttaaataaaagttaaaaaaagaaaatgatgagattgtccaaatgcttagtgatatgaaaatctcataaggaatctggtccactggacataatggctcacacctgtaatcctagcaactccgaaggctgaggtaggaggattgcttgagcccaaaaattcaagaccagcctggataacatcatgaggtccccatctctaaaataaaattta

SEQ ID NO: 409560 - DNA, 541 bp, Homo sapiens
cagggagttgtggttgcaacactgtactccagcctgggcaacagagggagactctgtctcaacaaacaaacaaacaaagaaaaaaccccacagctatctagggaaaaagtaaagcaaccagcttttagaagtgacatattgttatattttcaccataggtttgctttaagaaatagtgctcccttcagaatggaagaatttatctgcctcttatttgatgtggatcagagctaagatggctgactaaataaacatgggggactggaatctccttggagatactctggaggaagttcacatccactccaccatgattggaaagatctggctcaccatcctgttcatatttcgaatgcttgttctgggtgtagcagctgaagatgtctggaatgatgagcagtctggcttcatctcctgcaaagaaacctaattgctacgggggccggaagaggaagaggtgcggctccgacagccagaggggcgggcatacgcagcctccctcggctcagcctgctactggggatgcagagcgtcctggtcg

SEQ ID NO: 409561 - DNA, 1901 bp, Homo sapiens
cagggagttgtggttgcaacactgtactccagcctgggcaacagagggagactctgtctcaacaaacaaacaaacaaagaaaaaaccccacagctatctagggaaaaagtaaagcaaccagcttttagaagtgacatattgttatattttcaccataggtttgctttaagaaatagtgctcccttcagaatggaagaatttatctgcctcttatttgatgtggatcagagctaagatggctgactaaataaacatgggggactggaatctccttggagatactctggaggaagttcacatccactccaccatgattggaaagatctggctcaccatcctgttcatatttcgaatgcttgttctgggtgtagcagctgaagatgtctggaatgatgagcagtctggcttcatctgcaatacagaacaaccaggctgcagaaatgtatgctacgaccaggcctttcctatctccctcattagatactgggttctgcaggtgatatttgtgtcttcaccatccctggtctacatgggccatgcattgtaccgactgagagttcttgaggaagagaggcaaaggatgaaagctcagttaagagtagaactggaggaggtagagtttgaaatgcctagggatcggaggagattggagcaagagctttgtcagctggagaaaaggaaactaaataaagctccactcagaggaaccttgctttgcacttatgtgatacacattttcactcgctctgtggttgaagttggattcatgattggacagtaccttttatatggatttcacttagagccgctatttaagtgccatggccacccgtgtccaaatataatcgactgttttgtctcaagaccaacagaaaagacaatattcctattatttatgcaatctatagccactatttcacttttcttaaacattcttgaaattttccacctaggttttaaaaagattaaaagagggctttggggaaaatacaagttgaagaaggaacataatgaattccatgcaaacaaggcaaaacaaaatgtagccaaataccagagcacatctgcaaattcactgaagcgactcccttctgcccctgattataatctgttagtggaaaagcaaacacacactgcagtgtaccctagtttaaattcatcttctgtattccagccaaatcctgacaatcatagtgtaaatgatgagaaatgcattttggatgaacaggaaactgtactttctaatgagatttccacacttagtactagttgtagtcattttcaacacatcagttcaaacaataacaaagacactcataaaatatttggaaaagaacttaatggtaaccagttaatggaaaaaagagaaactgaaggcaaagacagcaaaaggaactactactctagaggtcaccgttctattccaggtgttgctatagatggagagaacaacatgaggcagtcaccccaaacagttttctccttgccagctaactgcgattggaaaccgcggtggcttagagctacatggggttcctctacagaacatgaaaaccgggggtcacctcctaaaggtaacctcaagggccagttcagaaagggcacagtcagaacccttcctccttcacaaggagattctcaatcacttgacattccaaacactgctgattctttgggagggctgtcctttgagccagggttggtcagaacctgtaataatcctgtttgtcctccaaatcacgtagtgtccctaacgaacaatctcattggtaggcgggttcccacagatcttcagatctaaacagcggttggcttttagacattatatatattatcagagaagtagcctagtggtcgtggggcacagaaaaaatagataggggcagctctaaagaccagct

SEQ ID NO: 409562 - DNA, 2153 bp, Homo sapiens
actattataagcattctttatctgtgctgtccaaaaaagcagccattaggtagatgcagctctttacatttttattaaaattatttaaaattaaaaattcaattgctctgacacacaaaccataatgcaagtgttcaatagctacatttggctactggctgccttattggctagcacagatagaatatttccattgttgcagaaagttctattggatggtgctgttttaaaagcaaggataagcagaaagggacatggattttagttgatggatgactcactcactacattcaactgaactgaatctgctctataccagcaaagggacaaattcagaaaataaattgaagatggccatgctgtaacttctaaacatggtttgcttctcagatttacctaaactaagaaaggtttgctttaagaaatagtgctcccttcagaatggaagaatttatctgcctcttatttgatgtggatcagagctaagatggctgactaaataaacatgggggactggaatctccttggagatactctggaggaagttcacatccactccaccatgattggaaagatctggctcaccatcctgttcatatttcgaatgcttgttctgggtgtagcagctgaagatgtctggaatgatgagcagtctggcttcatctgcaatacagaacaaccaggctgcagaaatgtatgctacgaccaggcctttcctatctccctcattagatactgggttctgcaggtgatatttgtgtcttcaccatccctggtctacatgggccatgcattgtaccgactgagagttcttgaggaagagaggcaaaggatgaaagctcagttaagagtagaactggaggaggtagagtttgaaatgcctagggatcggaggagattggagcaagagctttgtcagctggagaaaaggaaactaaataaagctccactcagaggaaccttgctttgcacttatgtgatacacattttcactcgctctgtggttgaagttggattcatgattggacagtaccttttatatggatttcacttagagccgctatttaagtgccatggccacccgtgtccaaatataatcgactgttttgtctcaagaccaacagaaaagacaatattcctattatttatgcaatctatagccactatttcacttttcttaaacattcttgaaattttccacctaggttttaaaaagattaaaagagggctttggggaaaatacaagttgaagaaggaacataatgaattccatgcaaacaaggcaaaacaaaatgtagccaaataccagagcacatctgcaaattcactgaagcgactcccttctgcccctgattataatctgttagtggaaaagcaaacacacactgcagtgtaccctagtttaaattcatcttctgtattccagccaaatcctgacaatcatagtgtaaatgatgagaaatgcattttggatgaacaggaaactgtactttctaatgagatttccacacttagtactagttgtagtcattttcaacacatcagttcaaacaataacaaagacactcataaaatatttggaaaagaacttaatggtaaccagttaatggaaaaaagagaaactgaaggcaaagacagcaaaaggaactactactctagaggtcaccgttctattccaggtgttgctatagatggagagaacaacatgaggcagtcaccccaaacagttttctccttgccagctaactgcgattggaaaccgcggtggcttagagctacatggggttcctctacagaacatgaaaaccgggggtcacctcctaaaggtaacctcaagggccagttcagaaagggcacagtcagaacccttcctccttcacaaggagattctcaatcacttgacattccaaacactgctgattctttgggagggctgtcctttgagccagggttggtcagaacctgtaataatcctgtttgtcctccaaatcacgtagtgtccctaacgaacaatctcattggtaggcgggttcccacagatcttcagatctaaacagcggttggcttttagacattatatatattatcagagaagtagcctagtggtcgtggggcacagaaaaaatagataggggcagctctaaagaccagct

SEQ ID NO: 409563 - DNA, 466 bp, Homo sapiens
actattataagcattctttatctgtgctgtccaaaaaagcagccattaggtagatgcagctctttacatttttattaaaattatttaaaattaaaaattcaattgctctgacacacaaaccataatgcaagtgttcaatagctacatttggctactggctgccttattggctagcacagatagaatatttccattgttgcagaaagttctattggatggtgctgttttaaaagcaaggataagcagaaagggacatggattttagttgatggatgactcactcactacattcaactgaactgaatctgctctataccagcaaagggacaaattcagaaaataaattgaagatggccatgctgtaacttctaaacatggtttgcttctcagatttacctaaactaagaaaggtttgtgttaatctctctgttttagcttattaagaaagagttgtttgaaatgtttt

SEQ ID NO: 409564 - DNA, 276 bp, Homo sapiens
caggaagtagccagaaagagcacgtcgcccctcatccttttataactatagggtctggattgacaaagcaggagcatcaacattttggacaaacagcagcattttaagttccccttgattaaaaaccgcctaaatccagcccccaaaaaatcagcctaatggctgtcagcatgaccataaaccacaaatgacacctccaatcagaaacattccaaccctgagataaagcgccctccaaccagaaacattcctaccccgaaatcaaacactcctctg

SEQ ID NO: 409565 - DNA, 993 bp, Homo sapiens
atccaagatgaagaaaaacatcagaaactgccaaccttcctccacttccttcagcaagggtcgagagtgcgccatggcaccacccaccctgaagatgtcatcttcagaagcagcggacacagcctccttcatggccttgtccagctcctcctcagcggtgagatctccagagatggcccgtcggatctcaggcccgatgtcatgcagtgtgcgcaagccagcctggaatccaaggggaggatggtgaggaccacgctcctttcctccaagctccccagccagccacagcctcgggccaagacctgtccctccagggccctggcatcctccacccagccagtcgaccctccggaagagagaagcttgtttggcttggtactggacttgggatgagagctcttccttctacgttccaagagagaagcttctttggcttggtactggacttgggatgacagctctgtttctctgagggccgtcctgaccagggcaaacagggtggcattgaacatgactgtcccgtcgctgttcagaggcatgttcatggagaccaggcgctgcaggcgaagagaagcaaagctggtgatgatggcaggcggtgcttaggggaccgcagaacaccgtggcagagtgatatggtttggctctgtgtcctcgcccaaatctcatgttgaattgtaatccccagaattggaggtggggcctgatggaaggtgattgcatcatggggtggatttctcataaatggtttggtaccatccccttggtgagtgagtactcatgagatctgcttgtttaagtaagtgtgtggtccctcccccttctctcttgctccctgtctgtccatgtgacgtacctgcctcccctttgccttccaccatgattgactggaagcttcctgaggcctccccagaagcagaatgctagtgccatgcttcctgtacagcctgctgaactgtgggccaattaaacctgttttcttataaattaaaa

SEQ ID NO: 409566 - DNA, 529 bp, Homo sapiens
ttgatgttggcgttggagccggtggacgagtagctgctcggggtgaaggtggagtccaccagcttctcgtgggatggcgactcagtgtcgccctggctgctgcccgccttgttgatgtgcagcgggcgctgagtggtgaaggtctgggggaaggcgctccggccgtcgctttggtagtagctgacgtggttgccgaacaggccaccggccctctcctgaagatgtcatcttcagaagcagcggacacagcctccttcatggccttgtccagctcctcctcagcggtgagatctccagagatggcccgtcggatctcaggcccgatgtcatgcagtgtgcgcaagccagcctgcagagacagcgcgttcctctgggagggcttgcccacaaggccctgctctttgcgcttcttgaacttccggaagtactcctggatcaggaacgtggcgtagaacttgccaacggtgacctcatcatcacctgcagggggcaccacctggtccagcagcttcatgctggtccgcttcca

SEQ ID NO: 409567 - DNA, 2447 bp, Homo sapiens
tccgcagtctcagtggcgagctccgggtgctgtggcccggccttggcggggcggcctccggctcaggctggctgagaggctcccagctgcagcgtccccgcccgcctcctcgggagctctgatctcagctgacagtgccctcggggaccaaacaagcctggcaggacaaaattagaagatcaaaatggaaaatatgctgctttggttgatatttttcacccctgggtggaccctcattgatggatctgaaatggaatgggattttatgtggcacttgagaaaggtaccccggattgtcagtgaaaggactttccatctcaccagccccgcatttgaggcagatgctaagatgatggtaaatacagtgtgtggcatcgaatgccagaaagaactcccaactcccagcctttctgaattggaggattatctttcctatgagactgtctttgagaatggcacccgaaccttaaccagggtgaaagttcaagatttggttcttgagccgactcaaaatatcaccacaaagggagtatctgttaggagaaagagacaggtgtatggcaccgacagcaggttcagcatcttggacaaaaggttcttaaccaatttccctttcagcacagctgtgaagctttccacgggctgtagtggcattctcatttcccctcagcatgttctaactgctgcccactgtgttcatgatggaaaggactatgtcaaagggagtaaaaagctaagggtagggttgttgaagatgaggaataaaagtggaggcaagaaacgtcgaggttctaagaggagcaggagagaagctagtggtggtgaccaaagagagggtaccagagagcatctgcaggagagagcgaagggtgggagaagaagaaaaaaatctggccggggtcagaggattgccgaagggaggccttcctttcagtggacccgggtcaagaatacccacattccgaagggctgggcacgaggaggcatgggggacgctaccttggactatgactatgctcttctggagctgaagcgtgctcacaaaaagaaatacatggaacttggaatcagcccaacgatcaagaaaatgcctggtggaatgatccacttctcaggatttgataacgatagggctgatcagttggtctatcggttttgcagtgtgtctgacgaatccaatgatctcctttaccaatattgcgatgctgagtcgggctccaccggttcgggggtctatctgcgtctgaaagatccagacaaaaagaattggaagcgcaaaatcattgcggtctactcagggcaccagtgggtggatgtccacggggttcagaaggactacaacgttgctgttcgcatcactcccctaaaatacgcccagatttgcctctggattcacgggaacgatgccaattgtgcttacggctaacagagacctgaaacagggcggtgtatcatctaaatcacagagaaaaccagctctgcttaccgtagtgagatcacttcataggttatgcctggacttgaactctgtcaatagcatttcaacatttttcaaaatcaggagattttcgtccatttaaaaaatgtataggtgcagatattgaaactaggtgggcacttcaatgccaagtatatactcttctttacatggtgatgagtttcatttgtagaaaaattttgttgccttcttaaaaattagacacactttaaaccttcaaacaggtattataaataacatgtgactccttaatggacttattctcagggtcctactctaagaagaatctaataggatgctggttgtgtattaaatgtgaaattgcatagataaaggtagatggtaaagcaattagtatcagaatagagacagaaagttacaacacagtttgtactactctgagatggatccattcagctcatgccctcaatgtttatattgtgttatctgttgggtctgggacatttagtttagtttttttgaagaattacaaatcagaagaaaaagcaagcattataaacaaaactaataactgttttactgctttaagaaataacaattacaatgtgtattatttaaaaatgggagaaatagtttgttctatgaaataaacctagtttagaaatagggaagctgagacattttaagatctcaagtttttatttaactaatactcaaaatatggacttttcatgtatgcatagggaagacacttcacaaattatgaatgatcatgtgttgaaagccacattattttatgctatacattctatgtatgaggtgctacatttttaggacaaagaattctgtaatctttttcaagaaagagtctttttctccttgacaaaatccagcttttgtatgaggactatagggtgaattctctgattagtaattttagatatgtcctttcctaaaaatgaataaaatttatgaatatgacttaaaa

SEQ ID NO: 409568 - DNA, 467 bp, Homo sapiens
atcagagttaggtcaatgtttcttaaactttaatatgcacacaaatcatctggggattttattaaaatgcagattctgattcactaggtctggggtggggcctgggattctgcatttctagcaagctcccagggaattccagtgctgctagtcagtgaaccacatgttgagttgtaaaagttctgggtggtatcagagaggggcagaatcacagtgaactgtaaagttttgtgctactttaaaattttgttgaaaatgcaattttaaataagaaattaaaaacaaacttctacccctaaacattctaactcggaggaagttcttttccctgtaaactttagtaatgtccttcaattctataatctcttgttttatttctgtaattcatttttagttacgttttgttcttgattctcataagcataaagtcccgattggctcataataaactctgagtagacgaggcc

SEQ ID NO: 409569 - DNA, 1175 bp, Homo sapiens
ggggcgagtcctgtcaccaaaggggctggactttctttcctggcaggctcagccgcacctgggatgtggaaaccttggcgggggtgagcacccaggccattttcactagcagcaaaacaaaaacaaaacttcagctggtttccaatcactcaccatgcttcttctttataaatcattttaaagtgatttcgccaataaaattcagcatgtacagcgttttatttttaatgtacacattttaaagcataatgttacatacattatggaaaggtgcataatgagagaaatcatttccataatatatcaactccctgactaaaaattctttggataaaaatgcaatatttatttgatatcaatggacacctatgtcaatgtggttttcactgagggaccttagagggaaactttgaagtgggaagatggtctgtgttcttgaatagaaagacacatttttctaaaattctgagctctttctgtgtttataaattttacataatcccaataaagttattaaagtgttaacatttttgaattactcatgctgtcttttactattgtgatgacattaagaaaacttttgaaatggagtcaaaaaagacttgcctttctagatatgaaaatgtgctgttaatttccacaaggtatttactaacagctgaaacaacaaatcagtgaacggaacaggttagaaaatccaggaacacaccaatctaatagaattggataatggtgacatttcatattagtaggaaaagatgaattactcataaatgaagtgcctgctaactacttggataaatctggctagatttttatgtcacagaaataagttcgttatggaatgtagattaaaaattttaaatgcacaaaataagaaagataacagaaaaaaacacaaatgcctacttatacatgtttatattcctacaaatatcacaagcacacattctgaaggttgatttagcaaaataaaaaaaattcagtttataagaaaaaattaacaaaagacaatatgtgtatatacatattagataaaaaagtgattttcattttacagagaattcttcaaataaacaagaactctcatttaaaatagagcaaagcatttttttttcagatattcaagcaacctatgcacataggaaaaaatatttagtgttcctgggaggaga

SEQ ID NO: 409570 - DNA, 1715 bp, Homo sapiens
  misc_feature (1705)..(1705): n is a, c, g, or t
  misc_feature (1707)..(1708): n is a, c, g, or t
  misc_feature (1710)..(1713): n is a, c, g, or t
taggtggacagactgcattgcttgttgttgcgcttcggaggcggcgatccccgaaggcgagctgaaatacggctggagcgttcccaggctacagtttgtagccgacgattgtggaagactaggagccggagaggtggcccaccctcagggagcgcttgtgctcggagggcttctcatttccccaataccacattaaatcgtctcatctgaggaggatccacagagctgtcttctatggtaatctggagaaactggagtaccttctgctcacgtatcatgacaccaatgagagagacaaggaggaaagcttaccctgaaagaagcagatcccagttcaaaagtagccataagaaggaaggattcaccacctccaggaaaagtgtcttctcagaaacaaccagctgagaaggctgcaagtgacgagaaagattctgtttcgaatatagccacagaaataaaggagggaccaatatctgggacagtgtcttctcagaaacaaccagctgagaaggctgcaagtgacgagaaagattctgtttcaaatatagccacagaaataaaggatggacaacaatctgggagacataattttgcaaagcagatttaatgtcatgttcagccaagatagacaagaacttctcttccccgaataaatcagcgggggactctttgaagctgcacattctgattcagcaggcctgagattctacatttgtagtaagttctcaggtgacactgatgctgctggtcttcgacatgaactttgcagtaagattatagacttccatacattgaaattgggaagaagaaaggttggagagccattaaagacataaggagtcaggggacagcataattttgctttaattctacagcatgttttcaccaagggtggaaggagaaagagatgaagtatagatttacagacgtcacatcgtattgctaaaaacagatggagaaatgattgtaaaaacccataaacgctgtagaacgagaactaaggagaccattgatgtagcaatgactttcctcaaggaagaggattgtcaggcaggaaggagggaaaataagaagttatttatgtaattttgggatttcttctaaggaaacctgagttcagttgcatattcgaacattttcctaaaagaaggtttgattttggctgctttaggaaccagtggaagcaggaaggagtactagaactgggacaagccacagtgactcattactcctctttgttactgttgggcatcagagatatacattttgtttatattagttattcaaatgagataaacatgaatatgcatatattggctttgcttttcaattagctaacttttggataaaaatagcaatttaatgaaaatgctttagagaataacatgatattttaaaccagactattttagaaagaaaataatggtgaattcattaattgacttttaaaattcttattttcaatgaatattggagtgatttccaaatgtaaaaggttattcatatctaatgcttgtagcaactttattttgtataagtatgtcaaatttaatcatttattatactttttgataaggtttatgtattatactttgttgccatgagtggatgaagaacctttctgtagcctaaactagagggcacaacaaatgtaggcacattattacaccacatgggtttgagaaataaagaatattatatacanannannnnaa

SEQ ID NO: 409571 - DNA, 555 bp, Homo sapiens
taggtggacagactgcattgcttgttgttgcgcttcggaggcggcgatccccgaaggcgagctgaaatacggctggagcgttcccaggctacagtttgtagccgacgattgtggaagactaggagccggagaggtggcccaccctcagggagcgcttgtgctcggagggcttctcatttccccaataccacattaaatcgtctcatctgaggaggatccacagagctgtcttctatggtaatctggagaaactggagtaccttctgctcacgtatcatgacaccaatgagagagacaaggaggaaagcatccggtgaaagacagagatcacatttcaactagattcttaggaagtatggattcactaacttcagcgaagagaaaagctatacctgctgacgttacaattgttttagaacttcaactcctttatgtcagtgttgttacattgagaatctttacttaatcacatcttctgattaccagattgagtttctgcatgtgtgtgtgtatctctgattaaaaatgaataaaatgattaatcattcttttgta

SEQ ID NO: 409572 - DNA, 1067 bp, Homo sapiens
taggtggacagactgcattgcttgttgttgcgcttcggaggcggcgatccccgaaggcgagctgaaatacggctggagcgttcccaggctacagtttgtagccgacgattgtggaagactaggagccggagaggtggcccaccctcagggagcgcttgtgctcggagggcttctcatttccccaataccacattaaatcgtctcatctgaggaggatccacagagctgtcttctatggtaatctggagaaactggagtaccttctgctcacgtatcatgacaccaatgagagagacaaggaggaaagcatccggtgaaagacagagatcacatttcaactagattcttaggaagtatggattcactaacttcagcgaagcttaccctgaaagaagcagatcccagttcaaaagtagccataagaaggaaggattcaccacctccaggaaaagtgtcttctcagaaacaaccagctgagaaggctgcaagtgacgagaaagattctgtttcgaatatagccacagaaataaaggagggaccaatatctgggacagtgtcttctcagaaacaaccagctgagaaggctgcaagtgacgagaaagattctgtttcaaatatagccacagaaataaaggatggacaacaatctgggagacataattttgcaaagcagatttaatgtcatgttcagccaagatagacaagaacttctcttccccgaataaatcagcgggggactctttgaagctgcacattctgattcagcaggcctgagattctacatttgtatgtcttctcagaaacaatcggcctggaaggttatatttaaaaagaaagtttctcttttgaatattgccacaagaataatgggtggtcagaaatctggaacagagtatcctgagaatctgcccaccatgaaggctacagttgaaaataaagattctgttctgaatacagccaccaaaatgaaggatgtacaaacatccacaccagaagaacaagacttagaaatggcatcagagggagagcaaaagaggcttgaagaatatgaaaataaccagccacag

SEQ ID NO: 409573 - DNA, 1436 bp, Homo sapiens
taggtggacagactgcattgcttgttgttgcgcttcggaggcggcgatccccgaaggcgagctgaaatacggctggagcgttcccaggctacagtttgtagccgacgattgtggaagactaggagccggagaggtggcccaccctcagggagcgcttgtgctcggagggcttctcatttccccaataccacattaaatcgtctcatctgaggaggatccacagagctgtcttctatggtaatctggagaaactggagtaccttctgctcacgtatcatgacaccaatgagagagacaaggaggaaaggctcagccgcacctgggatgtggaaaccttggcgggggtgagcacccaggccattttcactagcagcaaaacaaaaacaaaacttcagctggtttccaatcactcaccatgcttcttctttataaatcattttaaagtgatttcgccaataaaattcagcatgtacagcgttttatttttaatgtacacattttaaagcataatgttacatacattatggaaaggtgcataatgagagaaatcatttccataatatatcaactccctgactaaaaattctttggataaaaatgcaatatttatttgatatcaatggacacctatgtcaatgtggttttcactgagggaccttagagggaaactttgaagtgggaagatggtctgtgttcttgaatagaaagacacatttttctaaaattctgagctctttctgtgtttataaattttacataatcccaataaagttattaaagtgttaacatttttgaattactcatgctgtcttttactattgtgatgacattaagaaaacttttgaaatggagtcaaaaaagacttgcctttctagatatgaaaatgtgctgttaatttccacaaggtatttactaacagctgaaacaacaaatcagtgaacggaacaggttagaaaatccaggaacacaccaatctaatagaattggataatggtgacatttcatattagtaggaaaagatgaattactcataaatgaagtgcctgctaactacttggataaatctggctagatttttatgtcacagaaataagttcgttatggaatgtagattaaaaattttaaatgcacaaaataagaaagataacagaaaaaaacacaaatgcctacttatacatgtttatattcctacaaatatcacaagcacacattctgaaggttgatttagcaaaataaaaaaaattcagtttataagaaaaaattaacaaaagacaatatgtgtatatacatattagataaaaaagtgattttcattttacagagaattcttcaaataaacaagaactctcatttaaaatagagcaaagcatttttttttcagatattcaagcaacctatgcacataggaaaaaatatttagtgttcctgggaggaga

SEQ ID NO: 409574 - DNA, 875 bp, Homo sapiens
ggggctgagagtctgtgcgaaggatccacagagctgtcttctatggtaatctggagaaactggagtaccttctgctcacgtatcatgacaccaatgagagagacaaggaggaaagcatccggtgaaagacagagatcacatttcaactagattcttaggaagtatggattcactaacttcagcgaagcttaccctgaaagaagcagatcccagttcaaaagtagccataagaaggaaggattcaccacctccaggaaaagtgtcttctcagaaacaaccagctgagaaggctgcaagtgacgagaaagattctgtttcgaatatagccacagaaataaaggagggaccaatatctgggacagtgtcttctcagaaacaaccagctgagaaggctgcaagtgacgagaaagattctgtttcaaatatagccacagaaataaaggatggacaacaatctgggagacataattttgcaaagcagatttaatgtcatgttcagccaagatagacaagaacttctcttccccgaataaatcagcgggggactctttgaagctgcacattctgattcagcaggcctgagattctacatttgtatgtcttctcagaaacaatcggcctggaaggttatatttaaaaagaaagtttctcttttgaatattgccacaagaataatgggtggtcagaaatctggaacagagtatcctgagaatctgcccaccatgaaggctacagttgaaaataaagattctgttctgaatacagccaccaaaatgaaggatgtacaaacatccacaccagaagaacaagacttagaaatggcatcagagggagagcaaaagaggcttgaagaatatgaaaataaccagccacag

SEQ ID NO: 409575 - DNA, 911 bp, Homo sapiens
cagctttctgtaatgtgttggatttaatacctctagttcttctagtcccagtcttcaaaatttgcagttgctcttttgttcttcccaaccttgtaggctctttccttgcatcacttcttactttctaaaaaacaccttttctgtaggtttagtgaggtttcaagaaggagagaaattagatgttttggttcagtctgacatcttttacctgaaagttcctattaatctggattcctaagccagatttggatattttaaaaaaattcattctgtatttatgcttccttcagtatctatatttgtagttaaaggtataagtgctaatgtttagtggaggactcaatagaagggccaggaagtgagatatttaccacagccagcctaggacagtaagggtttggtttgggaccagaagagaattgacagcaaacaaggagaatgatgaaagtggatgcatttagatgtaggtaggatgattagagacttaattttaagaatcttggatatctgagacctaatacataaataaagctccagtaacatttatctccctggactcctgtgtttttgttgttgttgttgttgttgtgtgttgttgttgttaacttgtcatgatctaggaacttattctatatttcagagaatacacacaactaatgatacaattaaaaaatgactactgaacaaagctgtttgccaacatagaatctgtaagaacacacatagtattaactaagtaaacaatacactctgaatatactgtagcagcaggtttctattttaataattgagcttgctgtttgagtgttgtattggattctaaaaccgttttgcttgtactgactgggctgtgattcactttgctggttgttgctgccctctgttggactagctcaggaaatgcagctttt

SEQ ID NO: 409576 - DNA, 440 bp, Homo sapiens
cgtaccatatgtgatgaaggccaagcagagagggcttttcaatttctgtccatcaaaaaaaactccaattctacttctgctttatataccaagattctttttgtaagagtttgtttgggagaagggagaaagaactctactgctaaaaaagtgaaaatggcaaatgaaccaagcagcatcccatcttatattttaaagtcttctcccaagttaacccaatttccccatttatttctactttaaggcacatattagcaaatgcccacagtcattcattcaacatacactggatgctatcaaatttaagtgctatgaaaacaatggtccagcattaaaagtcatctgagatcaaaatcagaaaaaaattaactaacaaatctaaaggcaaaacctaccatttatgtctcttccaaaatctccgagttattttcgtggagtta

SEQ ID NO: 409577 - DNA, 435 bp, Homo sapiens
gtgatgataattaattttttttccttataccttacacacttgtttgggatatctgttgtagactgaattgcatcctacccaaatttataagttgaagctctaatccctagtgtgactgtatgtggagacagagcttttaaggaggtaattaaggccataagaggggctggtaatataatatgattggtgtccttaaaagaaaaggaagagacaccaggaatgcaggtgcacaggaaaggccatatgaggacaggatgagatggccctttgcagccaaggagagaggccatagaagaaatcatccctgcgaacacgttgatcttggacttccagccttcagaactgtgagcaaacaaatttatcttgtttaagccacccaggctgtgtattttgttatgccagccctaggtaactaataaaatgttcaaaggaaat

SEQ ID NO: 409578 - DNA, 428 bp, Homo sapiens
tccattgattcatatagatcatttgatggtctaatgccggtccctcattttacagaggagaaaatggttctagagggatttgaagtgactgtccagaggccacatgcgcagttagtggaaacccaggacccagatctaggtctgcagacactgtgtttagcctttctacggccctgttcagccaccaagtattttaggattgaaaatgaaaaagcaccttatcattatgcttgtctcttttcaatagcattcagtaatcttcttcatatgtctttttactgaaattaaattattgtactttgtaaaatgtgattagatatatcaaccaaagattttatttgttgatgttttgtgagtttttaaccattgactataatttgttatttaactgttaatttattgcaaataaattatttaagaaaacaaat

SEQ ID NO: 409579 - DNA, 365 bp, Homo sapiens
tacgataactctggactaaaaaaatcaggatcattaaaagaattaaaaactatgtatttcagcattcaacaaagcattaaatcaattctactggaaatgtgggataagaaatattttggtaatcaccttatccaccaggctgccacgtgtgagctgtagcttggaatagcagcaaggtgcaattggccatggaagtgcatgagcagacccacatctggacttgcatgctgcccgctggcgacatagatatcccgcccgctttgttgcaagctttgtcatttatcagcagatcagtttgacactggtccccctcactcaccctgtgccttgtacacagtaggcactcaatcagtaggtattggcta

SEQ ID NO: 409580 - DNA, 1796 bp, Homo sapiens
agactagacgcgtcttacagtgggagagctcagcctcactgatagccggggatctctcctgttcgagggctgagatctccggtcccacaaccgcccacaaccaggggcacttctggaagtcccctttctagggacatttttcttctaagctctgtaacgcgggccgaggcagaccgaggcttctttcccggatccaatcccctgcccccatgcctaagaaagaaaaaatggccaagacgcccctgtccgatgagaagcagctgcttctgtttcagcagaagttgctggcagaggaggagatggccaaaaagaaggagaggctcctcagccagttcttgaaggacaagctggccaaggaggaacacaacagtgctctgaaccttaataagattaacacacagtggagaactgtccttcgggaagtcaagaccagagaacttcataaggacattgagatcctcagccaaacatttgaacgagtggtggactgtaaggacaatgtcatcaagtctttagctaaagacctgtccgaagccgaggagcagtacgcccatgccctgcgcagccacttgcacaatgttgaccagctcttggccctgcagaggcaccggctcagtctcctggaggaaagttacaacatggagctggaagccctaaccaaggagtttgagacagaaaggaagacaattattgaccaacatgagaaagagattcactatctgcaagatatcttcatggccatggagcagaactatatagattctgagtatgaaagcaagctggagttccagagcatgtggaatgatctcaaagacatgaatttagaagagaagcactttctaagactgcacctggagaacagagtagaagatctgtggagaaagttccaggatgtactcaagaattacactgatgccacagaggatcgaaagactgcctttgagaccctgcaggtgaaggatgagaagagctccaaagagattgaagtacagatgaaaaaaatacagaaactacaggatgccataactatttcaaaaggcaagatcatgatacacagccgtgagagtgaagatgagaaccggtatatccgtaatgacaaggaattggtccttgtacaactgcgaaaacttaaggcccaaagaactcaggcccgggcagcatcccagaagaacttagtcagactcaccctggaaagtaatgccaccctcaaggccctgagaaagattgttgataagggtgaaaagatccttaaacttgctgaaatatgtaggaaatttgaaaccgaagaagaaaaagtgctgcctttttattcatcagtattgactcctaaggagcaggaggggattcagaagaataatctagaagagcttactgaggagctcaccaaggtgatggtggactacataggaatggagaatttctggaaaaggtacaacaaagtgaaactggagcaactgagcctccaacatagacgagcccagctgctagatatcaatgggaagctgcgggagatgctgaagcagtacttggatggcatctcagtgagtgacgaagtgctgagccagctcaacccactctttatagtcaactatcaaagcaacttactccagcccttgtccatacgtatagcccatccaggtgataaacaacatccaaccacttaaaatataattgaagcagcccagatgatcttccacaacctgtgatctaaggaaaaaaatctttcaactcctagagatttttttttttttttgagaaatgtagggatgttgctattaaaaatttccatggagttt

SEQ ID NO: 409581 - DNA, 2334 bp, Homo sapiens
agactagacgcgtcttacagtgggagagctcagcctcactgatagccggggatctctcctgttcgagggctgagatctccggtcccacaaccgcccacaaccaggggcacttctggaagtcccctttctagggacatttttcttctaagctctgtaacgcgggccgaggcagaccgaggcttctttcccggatccaatcccctgcccccatgcctaagaaagaaaaaatggccaagacgcccctgtccgatgagaagcagctgcttctgtttcagcagaagttgctggcagaggaggagatggccaaaaagaaggagaggctcctcagccagttcttgaaggacaagctggccaaggaggaacacaacagtgctctgaaccttaataagattaacacacagtggagaactgtccttcgggaagtcaagaccagagaacttcataaggacattgagatcctcagccaaacatttgaacgagtggtggactgtaaggacaatgtcatcaagtctttagctaaagacctgtccgaagccgaggagcagtacgcccatgccctgcgcagccacttgcacaatgttgaccagctcttggccctgcagaggcaccggctcagtctcctggaggaaagttacaacatggagctggaagccctaaccaaggagtttgagacagaaaggaagacaattattgaccaacatgagaaagagattcactatctgcaagatatcttcatggccatggagcagaactatatagattctgagtatgaaagcaagctggagttccagagcatgtggaatgatctcaaagacatgaatttagaagagaagcactttctaagactgcacctggagaacagagtagaagatctgtggagaaagttccaggatgtactcaagaattacactgatgccacagaggatcgaaagactgcctttgagaccctgcaggtgaaggatgagaagagctccaaagagattgaagtacagatgaaaaaaatacagaaactacaggatgccataactatttcaaaaggcaagatcatgatacacagccgtgagagtgaagatgagaaccggtatatccgtaatgacaaggaattggtccttgtacaactgcgaaaacttaaggcccaaagaactcaggcccgggcagcatcccagaagaacttagtcagactcaccctggaaagtaatgccaccctcaaggccctgagaaagattgttgataagggtgaaaagatccttaaacttgctgaaatatgtaggaaatttgaaaccgaagaagaaaaagtgctgcctttttattcatcagtattgactcctaaggagcaggaggggattcagaagaataatctagaagagcttactgaggagctcaccaaggtgatggtggactacataggaatggagaatttctggaaaaggtacaacaaagtgaaactggagcaactgagcctccaacatagacgagcccagctgctagatatcaatgggaagctgcgggagatgctgaagcagtacttggatggcatctcagtgagtgacgaagtgctgagccagctcaacccactctttatagtcaactatcaaagcaacttactccagcccttgtccatacgtatagcccatccaggtgataaacaacatccaaccacttaaaatataattgaagcagcccagatgatcttccacaacctgtgatctaaggaaaaaaatctttcaactcctagagatttttttttttttttgagaaatgtagggatgttgctattaaaaatttccatggagtttatgagctctttatatcttttccatattggacagagcagttctctttgaggacactaggaacactgtggtcccagggaacagagagaacagctaggcaactaccaggaggctcactgctcaattaagcatccctcctcagaatcagggcaccatgagagccaaaacccataccttaaggacctagagatcctatgggaagactcaagaccaggtccttaaagtcagttaggacagcaagaggaggccaggggaagaggtgatccagggcctacaaccacccccatgccaggcaagatgcaattcacaatgcttttttcctcagccctttacctcattcccactttcaaaggcagtctcagaaaatatcagatgaagaatgcaaataagttttttaaaatttattatttattatttctttttgctcttgtttcgtttctcttccttgagcttctttttggagactttgggtctattggcctttctgtataggtgatacccaatgaggcccaggagggctggcaccatggccatccctacc

SEQ ID NO: 409582 - DNA, 1865 bp, Homo sapiens
  misc_feature (1544)..(1544): n is a, c, g, or t
  misc_feature (1558)..(1558): n is a, c, g, or t
agactagacgcgtcttacagtgggagagctcagcctcactgatagccggggatctctcctgttcgagggctgagatctccggtcccacaaccgcccacaaccaggggcacttctggaagtcccctttctagggacatttttcttctaagctctgtaacgcgggccgaggcagaccgaggcttctttcccggatccaatcccctgcccccatgcctaagaaagaaaaaatggccaagacgcccctgtccgatgagaagcagctgcttctgtttcagcagaagttgctggcagaggaggagatggccaaaaagaaggagaggctcctcagccagttcttgaaggacaagctggccaaggaggaacacaacagtgctctgaaccttaataagattaacacacagtggagaactgtccttcgggaagtcaagaccagagaacttcataaggacattgagatcctcagccaaacatttgaacgagtggtggactgtaaggacaatgtcatcaagtctttagctaaagacctgtccgaagccgaggagcagtacgcccatgccctgcgcagccacttgcacaatgttgaccagctcttggccctgcagaggcaccggctcagtctcctggaggaaagttacaacatggagctggaagccctaaccaaggagtttgagacagaaaggaagacaattattgaccaacatgagaaagagattcactatctgcaagatatcttcatggccatggagcagaactatatagattctgagtatgaaagcaagctggagttccagagcatgtggaatgatctcaaagacatgaatttagaagagaagcactttctaagactgcacctggagaacagagtagaagatctgtggagaaagttccaggatgtactcaagaattacactgatgccacagaggatcgaaagactgcctttgagaccctgcaggtgaaggatgagaagagctccaaagagattgaagtacagatgaaaaaaatacagaaactacaggatgccataactatttcaaaaggcaagatcatgatacacagccgtgagagtgaagatgagaaccggtatatccgtaatgacaaggaattggtccttgtacaactgcgaaaacttaaggcccaaagaactcaggcccgggcagcatcccagaagaacttagtcagactcaccctggaaagtaatgccaccctcaaggccctgagaaagattgttgataagggtgaaaagatccttaaacttgctgaaatatgtaggaaatttgaaaccgaagaagaaaaagtgctgcctttttattcatcagtattgactcctaaggagcaggaggggattcagaagaataatctagaagagcttactgaggagctcaccaaggtgatggtggactacataggaatggagaatttctggaaaaggtacaacaaagtgaaactggagcaactgagcctccaacatagacgagcccagctgctagatatcaatgggaagctgcgggagatgctgaagcagtacttggatggcatctcaggntgaggttggaaccngggaaaaagggcttgggcccttttggaaaggggcccaagggccgttcccaaaagcgcccccgaagccttccttttattatggtccaaaagcctaattcaagagcgaacgttatctcccaggcccttgtccatacgtatagcccatccaggtgataaacaacatccaaccacttaaaatataattgaagcagcccagatgatcttccacaacctgtgatctaaggaaaaaaatctttcaactcctagagatttttttttttttttgagaaatgtagggatgttgctattaaaaatttccatggagttt

SEQ ID NO: 409583 - DNA, 952 bp, Homo sapiens
tgagacagggtctcgctcagttgcccaggctggagtgtggtggcaccatctcgtctcactccagcctctgcctcctgggctcaagtgatccttccatctcagcccccccagcagctgagactgtaggcatgtgccaccatgcctggcttttaaataattttttgtagagatggggtctttccatgtttcccaggctatgaatcaattttacaataagaaaatacttggaatagtgtgtgttacatggtaacctccatttgctatatgtatttattgctattgtttcccacttggatgagtagcttccctgggttcaaacaggggaaccaactccactagcttccctcttcactccctttcctaatataaactctcttcccgcttcaaatagggtgaaaagatccttaaacttgctgaaatatgtaggaaatttgaaaccgaagaagaaaaagtgctgcctttttattcatcagtattgactcctaaggagcaggaggggattcagaagaataatctagaagagcttactgaggagctcaccaaggtgatggtggactacataggaatggagaatttctggaaaaggtacaacaaagtgaaactggagcaactgagcctccaacatagacgagcccagctgctagatatcaatgggaagctgcgggagatgctgaagcagtacttggatggcatctcagtgagtgacgaagtgctgagccagctcaacccactctttatagtcaactatcaaagcaacttactccagcccttgtccatacgtatagcccatccaggtgataaacaacatccaaccacttaaaatataattgaagcagcccagatgatcttccacaacctgtgatctaaggaaaaaaatctttcaactcctagagatttttttttttttttgagaaatgtagggatgttgctattaaaaatttccatggagttt

SEQ ID NO: 409584 - DNA, 536 bp, Homo sapiens
ttgtttgtttttgtagagatgggggggtctcattatgttgcccaggctagtcttgagctcccaggctcatgtaatcctcccaccttggctacccaaagtgttgggattacaaatgcgagccaccttgctcagcccttgccatcactcttgctttacacaagagtgagggggacagccagcattcttaaagtcaaagaattggcattaggaacaaagaaaaaactgccagctgaatatatttttattttctcacagagatgctattcagctggaatggtaactctctctttctggcctagtctttagctaaagacctgtccgaagccgaggagcagtacgcccatgccctgcgcagccacttgcacaatgttgaccagctcttggccctgcagaggcaccggctcagtctcctggaggaaagttacaacatggagctggaagccctaaccaaggagtttgagacagaaaggtatgggggcctaagagaagatggggaattgaatccaggggagtgcccagagtccgtgtcaaggagt

SEQ ID NO: 409585 - DNA, 720 bp, Homo sapiens
gagggagaccgtggaaagagagggagagggagaccatggggagagggagaccatggggagagggagagggagagggagagggaccaactacccactttcaactatcaaaatcctacccatttggcagggaacagggatgggagagagacttctcactgtaaccttttgtactttttttgtatcacatgaatgtattacccattcagaaatcaaaataaaataaccttactcattctttctagccctaaaaagagtaaagccttccctctctcttttctccatcagtacctaagagtttgtaccattcacatagattacatactgctttgaattgtcattattggtcaatatcctgtatccctcagagcagggacagtgtcttgtctcctacaggaagacaattattgaccaacatgagaaagagattcactatctgcaagatatcttcatggccatggagcagaactatatagattctgagtatgaaagcaagctggagttccagagcatgtggaatgatctcaaagacatggtacggagggagagtagataggcaagaagtgggaggaggtgatagaaaaatgctcaaggaggctgggcacagtggctcacacctgtaatcccagcaccttggtaggccaaggcaggaggatcacttgagactgggagttcaagactagcctgggcaacatagggagtcccccccatctctaccggccc

SEQ ID NO: 409586 - DNA, 214 bp, Homo sapiens
taatacttatgtccggccgcaccccttccgtaggccactggtgtgggtgctatcaatctagtcaggatttgattgttactgtagataccttcccaacaccacagacctcaaattcctccagcagacagtgggcttggtgtagggtctcgggtgctggagggtttttctcagtgtcctgattgctcagctgtcactgaggccttgacacgtgtgc

SEQ ID NO: 409587 - DNA, 720 bp, Homo sapiens
ggaagtaagtggagacacgtgctttggcctgttggaggggaaacccgctctcgcctcctggtggtcgccgactcgcagtccgcaggatgactcagggcagccctgaccacagttccgccgccatcggccctagcctgcggaattgggctcgccccgggacgataacagagctctgccgggggctggaggcactgaccgggtgaccagagacccagagaccagaccccctccacggcgcccgggatttcggggacggcttctcccatcgcaagtttcaacagaaaatgagaaatatcgcccgacgattggctgaaaacatgcagcaaccactattttcttcctgcccctcgttgatgagagcattcgaagtgacctcagcagggcatccaggtatgtcaagcatggtgacaaagtgttcaggtcagacggtctggggaaaggctcctgtgttgttgagcctgccaagttgtgggtgcagcatggtaccaggcagcccaaccctgacctaaagtaaattcccggaagaagtctttcctgggttttgaatttgcagtaacaggtgtgagcattctagcagcagtttgatgatcatgtatgatactgcaaacaggacctacgtttaaagaaaatggttgtagttagtatcagagagcccttgcttttcaaaacttcataaacaatgttactgtcatgtctttcattcaataaacatttgttgat

SEQ ID NO: 409588 - DNA, 2137 bp, Homo sapiens
  misc_feature (1891)..(1891): n is a, c, g, or t
ggaagtaagtggagacacgtgctttggcctgttggaggggaaacccgctctcgcctcctggtggtcgccgactcgcagtccgcaggatgactcagggcagccctgaccacagttccgccgccatcggccctagcctgcggaattgggctcgccccgggacgataacagagctctgccgggggctggaggcactgaccgggtgaccagagacccagagaccagaccccctccacggcgcccgggatttcggggacggcttctcccatcgcaagtttcaacagaaaatgagaaatatcgcccgacgattggctgaaaacatgcagcaaccactattttcttcctgcccctcgttgatgagagcattcgaagtgacctcagcagggcatccaggtcagtttctggaagacttgtgtgtgtgatgaatgaatatctggttttgtctctgctgggcctgtgtgcctggaaaggaattgttttggcctaggatcatccaggtttgtttggtttagttcttgaccacatattttttgaatggtgactgcttaagaccctgttgtgtatggctataaatagatacacgccaaggtgaccacatactctgtggttcctgtgcccgccggccatgtgtctgagtgtgtagcctctcatcatctaaaggaactttggctgcagaggggaggcctggtcccatgggaagttttgggagcgcagcagcaggtgggttcaaacgacccagcaagtgcctccttagcacttagaggcggaggccaccacgttgtccacgtggggtttctgatcccagctccccaccagcctgctggacctcgggcaggtccctccctgtttgtacctccattacttcttcagtaagatggggacactgaagatgaccatgcctcccaccagattggtgctttttttgttttaataagggacagagtctcactatgttgcctataggctggtctcaagctcttggcctcagttttcctgcctcagccttcaaatatgctggggtgacaggcatgagccactgcactggcccagattggtacatttgagggttaaatgagcaaatcctataaagcactcaggagagggctgtggggtttgggctggggcctgggagcactttagacgtggtagctatgttgttgtcacctttctcctctttcaaagcattttttgtttgtttgtttttgtttttgagacagagtttcgctcttgtggcccaggctggagtgcggtggtgtgacctcggctcactgcatcctccgcctcccgggttcaagtgatgggattacaggtgcctgccacaacgcccagctaattgtttgtatttttagtagagacgaggtttcaccatgttggccaggctggtctcgaactcctgacctcaggtgatccacctgccttggcctcccaaagtgctgggattacaggtatgagctaccgcgcccggcacaaagcattttcagctgtgaaattccctggggtgctgcagtagaggaaggtttggggtcttgacgggtgctatttgccacggaaagatgccttcctgctcccagggcaggagagccgaggtaagacttactgtaggctgtcgttttttttgtttgttttttgtctttgcgatggagtctcactctgtcgccaggctggagtgcagtggcatgatcttggctcactgcagaacctccacctcccaggttcaagcgattctcctgcctcagcctcccaagtaactgggattacaggcacatgcccccacaaccagctaattttttatttttagtagagacagggtttcacatgttggccaggctggtcttgaactcctgacctcaggtgatccgcccgcctcggcctcccaaagtgctgggattacagncatgagccactgcgcccagccaggctgttgtttttttacctccttgtttgcacaatttgggccactcacaagagtgtataccctgtgataaacagttacctacattctcctctgcatgcttgtctttagaggaaggaaatgtattaattgcccaaagtaatatattgtgttaagatgtgatatatactggggaaaaaaaaagtgtatattgacatttctggaataaaccactttgattcccagtta

SEQ ID NO: 409589 - DNA, 1801 bp, Homo sapiens
ggaagtaagtggagacacgtgctttggcctgttggaggggaaacccgctctcgcctcctggtggtcgccgactcgcagtccgcaggatgactcagggcagccctgaccacagttccgccgccatcggccctagcctgcggaattgggctcgccccgggacgataacagagctctgccgggggctggaggcactgaccgggtgaccagagacccagagaccagaccccctccacggcgcccgggatttcggggacggcttctcccatcgcaagtttcaacagaaaatgagaaatatcgcccgacgattggctgaaaacatgcagcaaccactattttcttcctgcccctcgttgatgagagcattcgaagtgacctcagcagggcatccaggtcagtttctggaagacttgtgtgtgtgatgaatgaatatctggttttgtctctgctgggcctgtgtgcctggaaaggaattgttttggcctaggatcatccaggtttgtttggtttagttcttgaccacatattttttgaatggtgactgcttaagaccctgttgtgtatggctataaatagatacacgccaaggtgaccacatactctgtggttcctgtgcccgccggccatgtgtctgagtgtgtagcctctcatcatctaaaggaactttggctgcagaggggaggcctggtcccatgggaagttttgggagcgcagcagcaggtgggttcaaacgacccagcaagtgcctccttagcacttagaggcggaggccaccacgttgtccacgtggggtttctgatcccagctccccaccagcctgctggacctcgggcaggtccctccctgtttgtacctccattacttcttcagtaagatggggacactgaagatgaccatgcctcccaccagattggtgctttttttgttttaataagggacagagtctcactatgttgcctataggctggtctcaagctcttggcctcagttttcctgcctcagccttcaaatatgctggggtgacaggcatgagccactgcactggcccagattggtacatttgagggttaaatgagcaaatcctataaagcactcaggagagggctgtggggtttgggctggggcctgggagcactttagacgtggtagctatgttgttgtcacctttctcctctttcaaagcattttttgtttgtttgtttttgtttttgagacagagtttcgctcttgtggcccaggctggagtgcggtggtgtgacctcggctcactgcatcctccgcctcccgggttcaagtgatgggattacaggtgcctgccacaacgcccagctaattgtttgtatttttagtagagacgaggtttcaccatgttggccaggctggtctcgaactcctgacctcaggtgatccacctgccttggcctcccaaagtgctgggattacaggtatgagctaccgcgcccggcacaaagcattttcagctgtgaaattccctggggtgctgcagtagaggaaggtttggggtcttgacgggtgctatttgccacggaaagatgccttcctgctcccagggcaggagagccgaggtaagacttactgtaggctgtcgttttttttgtttgttttttgtctttgcgatggagtctcactctgtcgccaggctggagtgcagtggcatgatcttggctcactgcagaacctccacctcccaggagaatctcttaaacctgggaggcagaggttgcagtgagccgggattgtgccactgcactccagcctggcgacagagcaagactccatctca

SEQ ID NO: 409590 - DNA, 1269 bp, Homo sapiens
ggaagtaagtggagacacgtgctttggcctgttggaggggaaacccgctctcgcctcctggtggtcgccgactcgcagtccgcaggatgactcagggcagccctgaccacagttccgccgccatcggccctagcctgcggaattgggctcgccccgggacgataacagagctctgccgggggctggaggcactgaccgggtgaccagagacccagagaccagaccccctccacggcgcccgggatttcggggacggcttctcccatcgcaagtttcaacagaaaatgagaaatatcgcccgacgattggctgaaaacatgcagcaaccactattttcttcctgcccctcgttgatgagagcattcgaagtgacctcagcagggcatccaggtcagtttctggaagacttgtgtgtgtgatgaatgaatatctggttttgtctctgctgggcctgtgtgcctggaaaggaattgttttggcctaggatcatccaggtttgtttggtttagttcttgaccacatattttttgaatggtgactgcttaagaccctgttgtgtatggctataaatagatacacgccaaggtgaccacatactctgtggttcctgtgcccgccggccatgtgtctgagtgtgtagcctctcatcatctaaaggaactttggctgcagaggggaggcctggtcccatgggaagttttgggagcgcagcagcaggtgggttcaaacgacccagcaagtgcctccttagcacttagaggcggaggccaccacgttgtccacgtggggtttctgatcccagctccccaccagcctgctggacctcgggcaggtccctccctgtttgtacctccattacttcttcagtaagatggggacactgaagatgaccatgcctcccaccagattggtgctttttttgttttaataagggacagagtctcactatgttgcctataggctggtctcaagctcttggcctcagttttcctgcctcagccttcaaatatgctggggtgacaggcatgagccatgcgcccagccaggctgttgtttttttacctccttgtttgcacaatttgggccactcacaagagtgtataccctgtgataaacagttacctacattctcctctgcatgcttgtctttagaggaaggaaatgtattaattgcccaaagtaatatattgtgttaagatgtgatatatactggggaaaaaaaaagtgtatattgacatttctggaataaaccactttgattcccagtta

SEQ ID NO: 409591 - DNA, 1834 bp, Homo sapiens
  misc_feature (1588)..(1588): n is a, c, g, or t
tagagagtatctcatggagctcacagttttaaatattcagacttggtaaagtagaataagaactgatgcatatacttttctttgcaggtcagtttctggaagacttgtgtgtgtgatgaatgaatatctggttttgtctctgctgggcctgtgtgcctggaaaggaattgttttggcctaggatcatccaggtttgtttggtttagttcttgaccacatattttttgaatggtgactgcttaagaccctgttgtgtatggctataaatagatacacgccaaggtgaccacatactctgtggttcctgtgcccgccggccatgtgtctgagtgtgtagcctctcatcatctaaaggaactttggctgcagaggggaggcctggtcccatgggaagttttgggagcgcagcagcaggtgggttcaaacgacccagcaagtgcctccttagcacttagaggcggaggccaccacgttgtccacgtggggtttctgatcccagctccccaccagcctgctggacctcgggcaggtccctccctgtttgtacctccattacttcttcagtaagatggggacactgaagatgaccatgcctcccaccagattggtgctttttttgttttaataagggacagagtctcactatgttgcctataggctggtctcaagctcttggcctcagttttcctgcctcagccttcaaatatgctggggtgacaggcatgagccactgcactggcccagattggtacatttgagggttaaatgagcaaatcctataaagcactcaggagagggctgtggggtttgggctggggcctgggagcactttagacgtggtagctatgttgttgtcacctttctcctctttcaaagcattttttgtttgtttgtttttgtttttgagacagagtttcgctcttgtggcccaggctggagtgcggtggtgtgacctcggctcactgcatcctccgcctcccgggttcaagtgatgggattacaggtgcctgccacaacgcccagctaattgtttgtatttttagtagagacgaggtttcaccatgttggccaggctggtctcgaactcctgacctcaggtgatccacctgccttggcctcccaaagtgctgggattacaggtatgagctaccgcgcccggcacaaagcattttcagctgtgaaattccctggggtgctgcagtagaggaaggtttggggtcttgacgggtgctatttgccacggaaagatgccttcctgctcccagggcaggagagccgaggtaagacttactgtaggctgtcgttttttttgtttgttttttgtctttgcgatggagtctcactctgtcgccaggctggagtgcagtggcatgatcttggctcactgcagaacctccacctcccaggttcaagcgattctcctgcctcagcctcccaagtaactgggattacaggcacatgcccccacaaccagctaattttttatttttagtagagacagggtttcacatgttggccaggctggtcttgaactcctgacctcaggtgatccgcccgcctcggcctcccaaagtgctgggattacagncatgagccactgcgcccagccaggctgttgtttttttacctccttgtttgcacaatttgggccactcacaagagtgtataccctgtgataaacagttacctacattctcctctgcatgcttgtctttagaggaaggaaatgtattaattgcccaaagtaatatattgtgttaagatgtgatatatactggggaaaaaaaaagtgtatattgacatttctggaataaaccactttgattcccagtta

SEQ ID NO: 409592 - DNA, 369 bp, Homo sapiens
attgttttggcccttttcttgaagtcagtgaaacattagtatgatattggggtagaaaaattcctcatagttgaaatattttaattgtgtttattggtcttgtggtgttggctgccagttgagttgtctactccaaattgacagtaactccataagtcacaagcatctgagatatattttgtgtattttgagggtctttagtgaatatataatattccatatggttttagaattctaaagtgattaggattaatttccatcccagcatcattgaatttaggacctcaattttctaaccacacatcagactgtgcagtcgaccctctgcatccacaagttccacatctgtggattcaaccaactatagat

SEQ ID NO: 409593 - DNA, 559 bp, Homo sapiens
ccttcagtcgaatgcaacagctttgctttgctgcaaagcaaatttaaagaggatttccaatttaaaaaagtctcctaccctaccatcaccaactttttcccacgaattttctacataagtgaacatttcttacatgtgttggccagattgtttctctgaccaattatatgacaaagtcagaatttttcatgttagctagaacttgaatgtccctatgcatagaccaaaacagtatgggacagcagtctaaaatatttgtgttgtccgtcacaaggggacttagcaagagtcaacacaaatgcatcactaatactataaaaataaatctccttgccgcctgcctgtggctcagcagcaatctcttcatgtacatgcatttgctttagcattatcatccttaaatatgtttttttcagatatgtgtcctctctagggatgaagcagtatgtcaatattcccgcctgtgaaatggaaaatgagggcttggaggttactgaaaagagaactggtgctcattatgtatacaaagtagaagaatgtcaggcacatgctaccatat

SEQ ID NO: 409594 - DNA, 531 bp, Homo sapiens
cactgcgtacatacccggggcctatgtgtgcctggcaaggccaagctgatgatgttaccaagctcaaactaccactggccaccttggtgagggtggggcagaaacacgtggaccagccaccaacctcatccattcaaggaagcagaaatggtcaggctcctgcaggataagtggccaccaccagaccaccaatggggcagagttctgaggcccaagcagatggcactggggccctgcttccagggtccacaatctgctccaggacacaagactgaagaaaactaagcaaatgagagtccaggaggctggatccctcatctgccattcttggcagttgcattttgtggtcagaaaaagtcaggaaacttggctctactcactgcaggaggctccaaggtgggaccagagcttccagcatagattcaacaatgcctaagaatgcctcttcttggggaaaaggaccccttccttggcctcaaagcccccacttattttgattaaagcacaataaagtctttgttgttaaaaaaa

SEQ ID NO: 409595 - DNA, 777 bp, Homo sapiens
agcggcttcttgcgcgggatagggcacctgaggaagcgggctgcgcctgtggcacagtggtacggggccggaagataacttacctgaagaggcgatcaatccctgagaatcgcgggcgacccgttttttgtgtgcccgggtgcggggtgccgggacacggcgttgaaggcgctgagcggagggatctcagggcgagctcgagcggcgacggcgcgctctgtgattgcaccgcgagcgcctgaggtgatctcggcctacatcgcgtcagcggggccttgggcgtgagcaccgccccctgtccggacgcagggtactggggcacctcgaactgtggcacctcacccttctccggggccacgtcttggggactccgacagccccaaataagccctcggggactggggttgtgaaaagcgaggtcgtgaagacgccggcctcataccgaagggtaggacggtgaggtcagccccgtcccactccaactaaaatcaacctgacaggtattaatatgccaccatgaagttaacaaatgttggtgattaagtatgctaggttttacgaaaacagattttccaaaataaatgtacatgttttaggacgtcgcgagccgtttgaggcagcattccccaaggacgccacttagtctgtaggtttagcggctagaaagattcagaagctgagttcagtcctgccgccacaatcaatcttcgctcctatggcttcacagaagcgtctcccatgactaccaaatttaactccttccagatcacccacggg

SEQ ID NO: 409596 - DNA, 822 bp, Homo sapiens
agcggcttcttgcgcgggatagggcacctgaggaagcgggctgcgcctgtggcacagtggtacggggccggaagataacttacctgaagaggcgatcaatccctgagaatcgcgggcgacccgttttttgtgtgcccgggtgcggggtgccgggacacggcgttgaaggcgctgagcggagggatctcagggcgagctcgagcggcgacggcgcgctctgtgattgcaccgcgagcgcctgaggtgatctcggcctacatcgcgtcagcggggccttgggcgtgagcaccgccccctgtccggacgcagggtactggggcacctcgaactgtggcacctcacccttctccggggccacgtcttggggactccgacagccccaaataagccctcggggactggggttgtgaaaagcgaggtcgtgaagacgccggcctcataccgaagggtaggacggtgaggtcagccccgtcccactccaactaaaatcaacctgacaggaggtggttcaggaaaacggtcccatttggcacctcaagtctaggtccctcaagtctctacaacagtatgcaaagaaaatgttcatcttcattcttcttatagttttctggtaacttactgaaccaagcgcacacacactctccaaggacaaacatttttcagtgctgggacaatgcaaattcagctctcggcagactactacacactgtgcatgatataccaagactaaaagactcataacctacccgcagaaagagtgcatcttccatagtagctctgcaaaaagatccaaaagaaactgttaatggcctggcttaagtc

SEQ ID NO: 409597 - DNA, 250 bp, Homo sapiens
tttgcaaaacataataaatctgattttttccgtaggaggtggttcaggaaaacggtcccatttggcacctcaagtctaggtccctcaagtctctacaacagtatgcaaagaaaatgttcatcttcattcttcttatagttttctggtaacttactgaaccaagcgcacacacactctccaaggacaaacatttttcagtgctgggacaatgcaaattcaggtaagggaagacaaacatttccctaagtgc

SEQ ID NO: 409598 - DNA, 342 bp, Homo sapiens
caaaggaatacagtaaaaactcaatagataaacaaaaatagagcactgaaaatattcaaataattcaaataaaattaggaaaggaaaaacaggaacaaaatgagggaagaaacctaaaataaatcataaagggtagatttaaatttcaacgtataactaattatattaaatataaatgatctaaacatacaaattaaatgacagagattgtcataatggattttttttaaatgaccaaaggatatgctatctacaggtaatacattttaaatataatgaaatgaatgtgttaaaagtaaagtgatatacactaatcataaggaagctggaggggccatatta

SEQ ID NO: 409599 - DNA, 549 bp, Homo sapiens
cttagtatatataaatgtgcatatgtatatatatatacacacacacacacacacagaaacacacacattttaaaaatctacccatccttttttccaaaggtaaccactgtaaacattttagcatcttttctgtccctctctgtatatagaactccattcctaggactgcagtagtgaaacacatggagtctggagccagactgccaggagggtgaatcctggctttgccatttacactatgaccatgagcaagttaagtaacttttttatatctcaatctttatctgtaaaagaagggttgtgatagaacctagttctataaataggattgttatgaagattaaaagttcaataacatacataaagctcttagaacagtatctggcacagaaaaagtgacatgtattattaaactgaatgaggcctttaggggaaatcatgataatttggtactctgtcaaacagtatgttgtttaaaataacaaaatctgcaggcaaaagaggctttttaagagaatcagataggatgtagaagcctacatctcagac

SEQ ID NO: 409600 - DNA, 415 bp, Homo sapiens
aaaatgtttacatttacctatagcctgtacagtaacccccctactacccgcctcaccggcttagaattgtctctcctttctggaccaaatcaatgtatttcttaaatatatttaaacgtatttgactgaagtctcatgcctccctaaactgtgtaaaaccaagctgcaccccaaccattttgggcacatgttcccaggacctcctgaggtctgtgtcatgggccacagtcaatcatatttggctcagaataaatctcttcaaatattctacagagtctgactccttcttgtaaacatctggaccatctcatttctttttcatattcagaaacttacagatactaaccaaacacacacacacaaattattagtaccactgcactccagcctgggcaacagaatgagactccttctc

SEQ ID NO: 409601 - DNA, 910 bp, Homo sapiens
ttcatatatggcttttattatgttctggtagtttcctactgttgctaatttttaagtttttatcatgaaagagttttgaattgtcatttttttcctgtatgtgttttttccctttattctgtttatattatgtgttacactgattgattttcacatgttgaacaatcagtccttgcgtcctgggaataagtcccacttggtcatggtgtaaaatcctttacagcaggggcgctgctaaatttggattgtaggcttttgttgattttgcatctggattcatgaaggatattggtcagtacttttcttgtagtgtctgtctggctttggtattggcaatactggcctcacagaatgagttatgaagtgttcatttctttattttccttcttacagcctagattcttaagtccattattaaaatcacttcctggcacatgtcttcaactaccattctctcccctgaatcccattctcctggaaaaatagcagtcttgatttatctctgtgcctcaagcagctggccatgactggataaaatacacaattgcactcactagttttacttccagtgactgaacctcaggtgggttcttagcacagcacagtgttcttaatactttccccctagtttcagtttctctaagtcaactatttcccacttcttttctcttcaaatttatagtgctccccaactccaatcttaactgatgactacttctttctttggtgagaaaataaaagcagcccgagagaattcctacttgctcccatctccaaatccgtactctgctttccctctctcacctacacaaaaactgtgttcttcagttaccccagacttacctacatcactgactcttctctacttgaccatttccatctgtagataaactacgttttcacccccaaa

SEQ ID NO: 409602 - DNA, 630 bp, Homo sapiens
gaatgggctttggttcgaaggatggtgagcagatggtcaccggcctcacagagaagaaggttgtgcaacagggcctggaggccctctgaagatctgagacaaggggaagaggacaactttaccagggacaagacagcctgagcttcagcaaaacactataaaagagtatccttggttccatatgacccaggcagagggaggagtgatgggttttcaaggactgagaatgcacatatggatagaacaaatctagaaattcaagctacttctattgctaaacaagtatagagtttcatataaatataattcataaaaggtataaacggcaagagtttctacccaaagattttgtgaaacacctggcattctagctacagcagcaaattatggcatcccttagcccctcagagacctctgtcctcagcagatgtgaccgccttcttggatctcagcagtgcaagggttcagtgtgccagcatctctacatctgaggtcttgctgtcttctgcaggccttccagctgctttgagagagaagtgaccaaagtattctcacttttgaagggagtgaaataaaacctggacaaaccaggttctcaaattaaaattcatggatcttcctattttccca

SEQ ID NO: 409603 - DNA, 2413 bp, Homo sapiens
ggattttcagtgttccaggactgggtgttctgctggtctccctctcccctcccttccccgattccccggtgccctccctgcgcgcagacccaggggactctgagaatggaagggagctctcattcccgggaggaaaagacaccaggttccctgggctgcctgcactcagttctcagcctccttcctcatgcctccagccactgcccgggtctgcggcacgggcgcgatttgaaatacccctccttcccgctttgaagaaggctgggctggctgggggttattttgggagcagcttctgagatccaatggccttgttagggcaacactgacctttccgtcccagaaggagggcaggattggagaagggggcggggcagcggcggggagaccgacagccccgcacacccactggggtggagaagggggccagcgggctgcgggaattcagcctccggcgggggctgccaccgaggggaatttcccctctttgaaaaggctggggacccctccaccccaccctttcactgggcttcttaaagagatcacaccgttttcccttggacttcttggaaggcagacttgggacgctttgtggggactttgaacctttccttcctgctttctttccagcaggcagccttgctctggctggtggagtcggggctcccgggcatggcactgactagccgacccggtgctgacttggcgccggggctctttcagcctctgctggcatcctgcttcccccctcctggggtgcagtggtgagtctgggggcctgcccccgagggcactggaggagtgttgcaggcatcacccacgccctctgcacccacgctggaggacggggaggttgtcaggggctatgatgagatgagtgggggccgcttcgactttgatgatggaggggcgtactgcgggggctgggaggggggaaaggcccatgggcatggactgtgcacaggccccaagggccagggcgaatactctggctcctggaactttggctttgaggtggcaggtgtctatacctggcccagcggaaacacctttgagggatactggagccagggcaaacggcatgggctgggcatagagaccaaggggcgctggctctacaagggcgagtggacacatggcttcaagggacgctacggaatccggcagagctcaagcagcggtgccaagtatgagggcacctggaacaatggcctgcaagacggctatggcaccgagacctatgctgatggagggatgtgttaaaatcgccctcagaatatggtcgagacaatgaaacaagacaatgaagcactgagcatcatgcctggcacataggaaatgccaaaatatatattcccgtatttccttcacattccaaagggtgaattaattcaggatggcctgaaccatagctgtcactgtcttcgggaggatatttgaggacaaaaacgagtttttgactttggaacagtaaataagacaagactttgattcgcttagttctgccttgagtcctgccagtgtagatggaatccatgccagacatgattccatttcgaatgtagaatcagcataatttaacctcatcttggaaatctcatgtcccagttcacagccaggcatcagcgtgacagtcagctgagctgctgtcttggcagcttctgggcattctatggagaccccaggagagcacagcagacccttagcagaacagaaaagcggaccgtattagtctttcctgtccacggccttgttttcagtgattcatgtgcccgattggccaaatctctgcagacgtgcccctgtccgaggccaggcttctgggattcatcgagcttgcttgtttccgggacctgctaattccgtgcccagcagctgttccccggagcaggccctgccctccacaccctcatgaggaatgccgagtctcattttctgagggccctggttgagggtggggtgtggggcgagggggacagggttgcttcctgccatagacttcctgccttggagggttatccttgttctcacctatcccttcccgagctgaagccacagagtaggagagaagttagggctggcacacctccctcccgtgtaactttcactccctgcttaaagggaactgatgagagttgcctggcacagatctgtgcctggcagaatccacagagcagcccaggtgtgctaggaactccagagtgacccctgctccaggccaggaatgagcaccttgtgcctggaggtcttcctgccactgctggctgcccattgctgtggatggggtagagctggagtcacacatggaggctggacagctgcatgcagcctgcaggggacactctggatggcatgtaccatgtttttattatttctatttttaattaaattggaatcctttatggataccttt

SEQ ID NO: 409604 - DNA, 1508 bp, Homo sapiens
ggattttcagtgttccaggactgggtgttctgctggtctccctctcccctcccttccccgattccccggtgccctccctgcgcgcagacccaggggactctgagaatggaagggagctctcattcccgggaggaaaagacaccaggttccctgggctgcctgcactcagttctcagcctccttcctcatgcctccagccactgcccgggtctgcggcacgggcgcgatttgaaatacccctccttcccgctttgaagaaggctgggctggctgggggttattttgggagcagcttctgagatccaatggccttgttagggcaacactgacctttccgtcccagaaggagggcaggattggagaagggggcggggcagcggcggggagaccgacagccccgcacacccactggggtggagaagggggccagcgggctgcgggaattcagcctccggcgggggctgccaccgaggggaatttcccctctttgaaaaggctggggacccctccaccccaccctttcactgggcttcttaaagagatcacaccgttttcccttggacttcttggaaggcagacttgggacgctttgtggggactttgaacctttccttcctgctttctttccagcaggcagccttgctctggctggtggagtcggggctcccgggcatggcactgactagccgacccggtgctgacttggcgccggggctctttcagcctctgctggcatcctgcttcccccctcctggggtgcagtggtgagtctgggggcctgcccccgagggcactggaggagtgttgcaggcatcacccacgccctctgcacccacgctggaggacggggaggttgtcaggggctatgatgagatgagtgggggccgcttcgactttgatgatggaggggcgtactgcgggggctgggaggggggaaaggcccatgggcatggactgtgcacaggccccaagggccagggcgaatactctggctcctggaactttggctttgaggtggcaggtgtctatacctggcccagcggaaacacctttgagggatactggagccagggcaaacggcatgggctgggcatagagaccaaggggcgctggctctacaagggcgagtggacacatggcttcaagggacgctacggaatccggcagagctcaagcagcggtgccaagtatgagggcacctggaacaatggcctgcaagacggctatggcaccgagacctatgctgatggagggacgtaccaaggccagttcaccaacggcatgcgccatggctacggagtacgccagagcgtgccctacgggatggccgtggtggtgcgctcgccgctgcgcacgtcgctgtcgtccctgcgcagcgagcacagcaacggcacggtggccccggactctcccgcctcgccggcctccgacggccccgcgctgccctcgcccgccatcccgcgtggcggcttcgcgctcagcctcctggccaatgccgaggcggccgc

SEQ ID NO: 409605 - DNA, 478 bp, Homo sapiens
cagaagagtatttagctttattctcctccactcccttgtctgatgagttctcataaattgctttctgaaatgacaaaacattgggatttggaaagccttgagaattcatcagttttatctttttctccagtgttttttacaaaggacccatttagtcgtgatatttataggatatgaggaaggcagtgatcctggcattcgtggactccagaaaacattttggagaaaaattaatgtaaggtaagggtgtagtaggtatacattgctgtattcattttattgtcccttccttccttccttccttccttccttccttccttccttccttccttccatccttccttccttccttccccttgaagatcttgttgcataccaatttattcattttagtatagcagtgactatttaaatgggtccctttctaaccacctttccctccaacctcaaaatccctggttaaaatgcttttctttaa

SEQ ID NO: 409606 - DNA, 444 bp, Homo sapiens
gtgacactgatgataaaaatccatccaagaatttatatgtgacatctgcagcaggttcaaatctctcagctatgagacaaactggatacttcctaaggattgccatctattatgcacagagagccaaaatccgttactgaaattgtctggtgttttttacaaaggacccatttagtcgtgatatttataggatatgaggaaggcagtgatcctggcattcgtggactccagaaaacattttggagaaaaattaatgtaagagacggagtttcactgtgttagccaggatggtctcgatctcctgacctcatgatccgccagccttggcctcccaaagtgctaggattacaggcttcagccactgcgtctggcccccttaatgcactgtttctatcaggccttccctttcctcatctccccacagacagctagtgttctgatttc

SEQ ID NO: 409607 - DNA, 321 bp, Homo sapiens
gtgacactgatgataaaaatccatccaagaatttatatgtgacatctgcagcaggttcaaatctctcagctatgagacaaactggatacttcctaaggattgccatctattatgcacagagagccaaaatccgttactgaaattgtctggtgttttttacaaaggacccatttagtcgtgatatttataggatatgaggaaggcagtgatcctggcattcgtggactccagaaaacattttggagaaaaattaatgtaagacacagggtcttgctctttcacccaggctggactgagtgcagtgtcatgattctagctcac

SEQ ID NO: 409608 - DNA, 1067 bp, Homo sapiens
gaaagaaagagagaaagaaagaaagaaagaaagagattggtttgaaacattgggagctgagcttaatgagaaaaggccattcctaactgctaagctaccgtattaaacagtggcaagtaccttggaaaataaaacagaaaccactgcccatctttttctaacggagaaagacaagagatggcttgaccagagtggagatttagaacttcaggtgctgataaatatggtaacatcatggggtgctttggcagctggatagattttatttattcagggctcctttaagccagaggagattcctggaggctgctaaaatagaatgctccacctggatagttaacatctggattttattttgtttcaaaaagttaattacaaatagttcgaattccttctggtatccctctgagaagagtttcttactgggtggctcacaagcggggagacagaaagggaaaaaaactagattgatattgctcaggagaaacaggattgtggctacacgtgagccatgtatgcaattttgaattttcccatagtcatgtttaaaaaaacgaggaaaaagtgaaattaattttaatactaaacccaatatgtataaaatatgaccatttcaatatgtaatcaattttacacttattaataagatcttaatatttttaaaattaagtttttgacatccattatgtattttacactcatagcatatctcagtttggactagttgcgtttcagctacctgtggttagtggccgccatgttaatactacagcacaggtcaagataacatttgcaaaggcaaggcatcttcccctccccatttctagtttcatgaactgtgcacagggatatggggctgttcgaggtacttttgggctgaccaaggctcagaggctactgacagctttgctgcaagtaacttctaggccttgtgggtcccagtgcagggaacccatgtgcggtgacactggagaagccatctgatccaggtctctcacttgacagatggggaaactgaggtccaaagaggtacagcagcttggtttaagagatagagatggaactgg

SEQ ID NO: 409609 - DNA, 665 bp, Homo sapiens
gcggttacgaggaggccgcctcctgcttgccggcctgcggtcctactcgacaacgcaagatttcaaaaggggaattccttcagggcttgattacaaggaagaaagcgatttcctccgcctcttccaaagcggtttggaaattgctctcttcatgtcatcataataaaccactagaaacttgcatttacttttgactgattattgaagtgtctggttatggagaacaaagaaattggagaaatgtgaagcttaagcttctgctgtgctgcagcgaagaagtctgggaagtttaggaagatatcctcttgactaaatggggctaaatgtcagcagaattgaagaaaagtaaaggaacttaccaatacttgatcgagacagtgctaaaataaaacacatcaaaagaagaatgagttctgtttgtcccagggagaacttagatgccatagacactatattgcagaaaggttgtggaaaagaagatagaaatgagtcacaacttatttcctggtatcaattgcaatgcaatgtggtgagcagctggatatctacatatggattccaatacttttgtggtaaggtgggactacaagatctatgcaacctgtctttcaattttggtaagagaataaaaatatttttggagattgctagtttctcaatctgag

SEQ ID NO: 409610 - DNA, 1421 bp, Homo sapiens
tggctcgcctcggcgtgcagtgcgcgtgcgtggagctgggagctaggtcctcggagtgggccggagatggcggcggccgacggggctttgccggaggcggcggctttagagcaacccgcggagctgcctgcctcggtgcgggcgagtatcgagcggaagcggcagcgggcactgatgctgcgccaggcccggctggctgcccggccctactcggcgacggcggctgcggctactggaggcatggctaatgtaaaagcagccccaaagataattgacacaggaggaggcttcattttagaagaggaagaagaagaagaacagaaaattggaaaagttgttcatcaaccaggacctgttatggaatttgattatgtaatatgcgaagaatgtgggaaagaatttatggattcttatcttatgaaccactttgatttgccaacttgtgataactgcagagatgctgatgataaacacaagcttataaccaaaacagaggcaaaacaagaatatcttctgaaagactgtgatttagaaaaaagagagccacctcttaaatttattgtgaagaagaatccacatcattcacaatggggtgatatgaaactctacttaaagttacagattgtgaagaggtctcttgaagtttggggtagtcaagaagcattagaagaagcaaaggaagtccgacaggaaaaccgagaaaaaatgaaacagaagaaatttgataaaaaagtaaaagaattgcggcgagcagtaagaagcagcgtgtggaaaagggagacgattgttcatcaacatgagtatggaccagaagaaaacctagaagatgacatgtaccgtaagacttgtactatgtgtggccatgaactgacatatgaaaaaatgtgattttttagttcagtgacctgttttatagaattttatatttaaataaaggaaatttagattggtccttttcaaaattcaaaaaaaaaagcaacatcttcatagatgaatgaaacccttgtataagtaatacttcagtaataattatgtatgttatggcttaaaagcaagtttcagtgaaggtcacctggcctggttgtgtgcacaatgtcatgtctgtgattgccttcttacaacagagatgggagctgagtgctagagtaggtgcagaagtggtaggtcagctacaaatttgaggacaagataccaaggcaaaccctagattggggtagagggaaaagggttcaacaaaggctgaactggattcttaaccaagaaacaaataatagcaatggtggtgcaccactgtaccccaggttctagtcatgtgttttttaggacgatttctgtctccacgatggtggaaacagtggggaactactgctggaaaaagccctaatagcagaaataaacattgagttgtacgagtctgatca

SEQ ID NO: 409611 - DNA, 1859 bp, Homo sapiens
  misc_feature (2)..(5): n is a, c, g, or t
  misc_feature (423)..(423): n is a, c, g, or t
  misc_feature (882)..(882): n is a, c, g, or t
annnnatggttgcctaatttttcttagcctaagtcttgattaaaaatgggatggaagatgagtaagtggattttgaatccaatattctgaacacacatcacaagtgcagagaagagaaagaaatcctcccaaagaagttaaaaggagaaaacacaaaaaacttacctcatacatttttctagaacttctcttacaaacttcggtttgggactttcaggatcttgactaagacaatctgacctaaggaggaaatgtagttttatcaatgcttacatataatctgcacttacacccatttgtactataattatctgttaacttataacaacttacaagttttgttaagttataattgcacttgtaactatttgtacttaactacaaatagtttccaagaaattaaatatttcagacacttttatnttacagttttaaacattagtagttttttgactacagaaaaagataaaacaaaccatcacttaccaatcttcccagctccaacggaactggaagttacttagatgatgagaaaaccaattaataaacctacgtagagaagggggaggtaggcagagaaaaaggaagaataactgggatttagaacagaaacttatataagccttcaaacagataaaacccgactttacagagttaatgaaaagcatattcccctacatgcagttgtatcttctgccaactctctttatcctttttaggtcaatgacagatataattctagtacctgttttgtgcgggcacctaacatgtttattatttaattctcacaacttccaaggtacatattattttctccatataaaagatgatgaaactgaagcaagaaaaaaaaaaattttatgaaattgtaggccaggtgcngtggctcatgcctgtaatcccagctactcgggatggagactaaggcaggaggattgcttgagcccataagttcaaggttacaatgagctatgctcatcccactgcactccagcctgggtgacagagcaagaccctgtctcaaataaaaaaaagaaattgcagataaaacattttataaatggcagagccaaagtatagtctttgatacttgactagagaatgaaattaaagaaaatcatagcatggacatcaaaaaacgtaatgttacattaagtatgagtctggttattatacaaaggttattttgggaggcaagaaaaaaactaaacatggaaattcttaaaaatgtctttctcaaattcctttatgaagtacaggaagtaaaagctgctaactcagctcagcagtaaagcgattactgtacctgtctacacaggtagtgttcattgtgtccaaacgcatgtatagcatttcagttgcctgtgcaagctgtgaatttaggataaggaaaactattctccacttttatcccaaataagttgtaatagacaagaatagaaataaaacatttcaagtctttataatgattaataatgctgaacatcttttcacacaatcaatcttgtttttgttttttcttacagctttgaaatatcagtgatgtataatgaatctgacctgcatacactcgtgaaatcaagataatattttcatcacctcccaaatttccccatgcccctccatacgcacaggcatacattgtttcattgtgcttagcagaaattgcttcttttttttttttttaactgaaggtttgtggcaaccctgcaacaagcaagtctactggcaccatttttccaatggcatctgcttgcttcttgtctctgtgtcacatactggtaatttttacaataaaacaagcttttccattattaattgctgcaatcccataataaaactttaaaaaataagaagat

SEQ ID NO: 409612 - DNA, 1652 bp, Homo sapiens
tggctcgcctcggcgtgcagtgcgcgtgcgtggagctgggagctaggtcctcggagtgggccggagatggcggcggccgacggggctttgccggaggcggcggctttagagcaacccgcggagctgcctgcctcggtgcgggcgagtatcgagcggaagcggcagcgggcactgatgctgcgccaggcccggctggctgcccggccctactcggcgacggcggctgcggctactggaggcatggctaatgtaaaagcagccccaaagataattgacacaggaggaggcttcattttagaagaggaagaagaagaagaacagaaaattggaaaagttgttcatcaaccaggacctgttatggaatttgattatgtaatatgcgaagaatgtgggaaagaatttatggattcttatcttatgaaccactttgatttgccaacttgtgataactgcagagatgctgatgataaacacaagcttataaccaaaacagaggcaaaacaagaatatcttctgaaagactgtgatttagaaaaaagagagccacctcttaaatttattgtgaagaagaatccacatcattcacaatggggtgatatgaaactctacttaaagttacagattgtgaagaggtctcttgaagtttggggtagtcaagaagcattagaagaagcaaaggaagtccgacaggaaaaccgagaaaaaatgaaacagaagaaatttgataaaaaagtaaaagaggttgttcccgccttcctgaataggccacaaagggctgagactggagtagacactgtagagattagacacaaggagcttactgtgcagttttctcagaaggctcagaacagagaggaataaaagcaagtctaaaagtattttagttgaaaagaaattggaacctggttcctcttggtcttctgattttgatccacaaagaagctgacacagtttacttctttatgggaagaattgcggcgagcagtaagaagcagcgtgtggaaaagggagacgattgttcatcaacatgagtatggaccagaagaaaacctagaagatgacatgtaccgtaagacttgtactatgtgtggccatgaactgacatatgaaaaaatgtgattttttagttcagtgacctgttttatagaattttatatttaaataaaggaaatttagattggtccttttcaaaattcaaaaaaaaaagcaacatcttcatagatgaatgaaacccttgtataagtaatacttcagtaataattatgtatgttatggcttaaaagcaagtttcagtgaaggtcacctggcctggttgtgtgcacaatgtcatgtctgtgattgccttcttacaacagagatgggagctgagtgctagagtaggtgcagaagtggtaggtcagctacaaatttgaggacaagataccaaggcaaaccctagattggggtagagggaaaagggttcaacaaaggctgaactggattcttaaccaagaaacaaataatagcaatggtggtgcaccactgtaccccaggttctagtcatgtgttttttaggacgatttctgtctccacgatggtggaaacagtggggaactactgctggaaaaagccctaatagcagaaataaacattgagttgtacgagtctgatca

SEQ ID NO: 409613 - DNA, 1212 bp, Homo sapiens
tggctcgcctcggcgtgcagtgcgcgtgcgtggagctgggagctaggtcctcggagtgggccggagatggcggcggccgacggggctttgccggaggcggcggctttagagcaacccgcggagctgcctgcctcggcatggctaatgtaaaagcagccccaaagataattgacacaggaggaggcttcattttagaagaggaagaagaagaagaacagaaaattggaaaagttgttcatcaaccagagatgctgatgataaacacaagcttataaccaaaacagaggcaaaacaagaatatcttctgaaagactgtgatttagaaaaaagagagccacctcttaaatttattgtgaagaagaatccacatcattcacaatggggtgatatgaaactctacttaaagttacagattgtgaagaggtctcttgaagtttggggtagtcaagaagcattagaagaagcaaaggaagtccgacaggaaaaccgagaaaaaatgaaacagaagaaatttgataaaaaagtaaaagaattgcggcgagcagtaagaagcagcgtgtggaaaagggagacgattgttcatcaacatgagtatggaccagaagaaaacctagaagatgacatgtaccgtaagacttgtactatgtgtggccatgaactgacatatgaaaaaatgtgattttttagttcagtgacctgttttatagaattttatatttaaataaaggaaatttagattggtccttttcaaaattcaaaaaaaaaagcaacatcttcatagatgaatgaaacccttgtataagtaatacttcagtaataattatgtatgttatggcttaaaagcaagtttcagtgaaggtcacctggcctggttgtgtgcacaatgtcatgtctgtgattgccttcttacaacagagatgggagctgagtgctagagtaggtgcagaagtggtaggtcagctacaaatttgaggacaagataccaaggcaaaccctagattggggtagagggaaaagggttcaacaaaggctgaactggattcttaaccaagaaacaaataatagcaatggtggtgcaccactgtaccccaggttctagtcatgtgttttttaggacgatttctgtctccacgatggtggaaacagtggggaactactgctggaaaaagccctaatagcagaaataaacattgagttgtacgagtctgatca

SEQ ID NO: 409614 - DNA, 867 bp, Homo sapiens
ctccttttcctactgtggcattctgttatctgaagtcaaacgtacctgaatgtgtcctattgtgttactcaactcacttctgaatatggttctgttttgcataccaccaacccacataaccatttctgaatctcttgtttcacactgctccagtgacaacttgattcacaggccgaactagtgagaattgcggcgagcagtaagaagcagcgtgtggaaaagggagacgattgttcatcaacatgagtatggaccagaagaaaacctagaagatgacatgtaccgtaagacttgtactatgtgtggccatgaactgacatatgaaaaaatgtgattttttagttcagtgacctgttttatagaattttatatttaaataaaggaaatttagattggtccttttcaaaattcaaaaaaaaaagcaacatcttcatagatgaatgaaacccttgtataagtaatacttcagtaataattatgtatgttatggcttaaaagcaagtttcagtgaaggtcacctggcctggttgtgtgcacaatgtcatgtctgtgattgccttcttacaacagagatgggagctgagtgctagagtaggtgcagaagtggtaggtcagctacaaatttgaggacaagataccaaggcaaaccctagattggggtagagggaaaagggttcaacaaaggctgaactggattcttaaccaagaaacaaataatagcaatggtggtgcaccactgtaccccaggttctagtcatgtgttttttaggacgatttctgtctccacgatggtggaaacagtggggaactactgctggaaaaagccctaatagcagaaataaacattgagttgtacgagtctgatca

SEQ ID NO: 409615 - DNA, 1171 bp, Homo sapiens
tggctcgcctcggcgtgcagtgcgcgtgcgtggagctgggagctaggtcctcggagtgggccggagatggcggcggccgacggggctttgccggaggcggcggctttagagcaacccgcggagctgcctgcctcggtgcgggcgagtatcgagcggaagcggcagcgggcactgatgctgcgccaggcccggctggctgcccggccctactcggcgacggcggctgcggctactggaggcatggctaatgtaaaagcagccccaaagataattgacacaggaggaggcttcattttagaagaggaagaagaagaagaacagaaaattggaaaagttgttcatcaaccaggacctgttatggaatttgattatgtaatatgcgaagaatgtgggaaagaatttatggattcttatcttatgaaccactttgatttgccaacttgtgataactgcagagatgctgatgataaacacaagcttataaccaaaacagaggcaaaacaagaatatcttctgaaagactgtgatttagaaaaaagagagccacctcttaaatttattgtgaagaagaatccacatcattcacaatggggtgatatgaaactctacttaaagttacagattgtgaagaggtctcttgaagtttggggtagtcaagaagcattagaagaagcaaaggaagtccgacaggaaaaccgagaaaaaatgaaacagaagaaatttgataaaaaagtaaaagaattgcggcgagcagtaagaagcagcgtgtggaaaagggagacgattgttcatcaacatgagtatggaccagaagaaaacctagaagatgacatgtaccctttgaaatatcagtgatgtataatgaatctgacctgcatacactcgtgaaatcaagataatattttcatcacctcccaaatttccccatgcccctccatacgcacaggcatacattgtttcattgtgcttagcagaaattgcttcttttttttttttttaactgaaggtttgtggcaaccctgcaacaagcaagtctactggcaccatttttccaatggcatctgcttgcttcttgtctctgtgtcacatactggtaatttttacaataaaacaagcttttccattattaattgctgcaatcccataataaaactttaaaaaataagaagat

SEQ ID NO: 409616 - DNA, 1202 bp, Homo sapiens
tggctcgcctcggcgtgcagtgcgcgtgcgtggagctgggagctaggtcctcggagtgggccggagatggcggcggccgacggggctttgccggaggcggcggctttagagcaacccgcggagctgcctgcctcggtgcgggcgagtatcgagcggaagcggcagcgggcactgatgctgcgccaggcccggctggctgcccggccctactcggcgacggcggctgcggctactggaggcatggctaatgtaaaagcagccccaaagataattgacacaggaggaggcttcattttagaagaggaagaagaagaagaacagaaaattggaaaagttgttcatcaaccaggacctgttatggaatttgattatgtaatatgcgaagaatgtgggaaagaatttatggattcttatcttatgaaccactttgatttgccaacttgtgataactgcagagatgctgatgataaacacaagcttataaccaaaacagaggcaaaacaagaatatcttctgaaagactgtgatttagaaaaaagagagccacctcttaaatttattgtgaagaagaatccacatcattcacaatggggtgatatgaaactctacttaaagttacaggtctctaataagttgtatttattatttttcactctggtaaattcttaataacaaactagtcataattggtttggcttttgcttacagagtgtggaaaaactcttttccctagttttgcatatgcttcacagtcatgtataatgacatttaataacatgttttctcattttgcttttttcttttcttttttcaaacaataaggtctcactctgtcactcaggctggagtgcagtggtgagatcatggctcactgcagccttgacctcccgggctcaggtaatccttccacctcagccttctgagtagcacctggctagttttttgtattttttgtagagatggggttttaccatattgcccaggctggtctcgaactccagggctcaagtgatcctcctgctttggcctcgcaaagtgctgggattacaggcatgagccgccacgcctggcctcattttgcttctaatatggcactttgaaagaaacctgttgctattgggtgatgttaagagtacaatttggaaactaaaaaaggttggaatgggagtcaggccctgtttccttaccctctttcacctcca

SEQ ID NO: 409617 - DNA, 413 bp, Homo sapiens
ctttatgttacttccttttcttttttcctctttaatttttttttttagataaacataaggtcttattttgtcttttacttaaatgtatttatgtcaggcattgcatacatgctgataagctaataaaatagaggaaaatatattgttctagtcataaaaaaggaaactagagttcattttccttttcttaggacctgttatggaatttgattatgtaatatgcgaagaatgtgggaaagaatttatggattcttatcttatgaaccactttgatttgccaacttgtgataactgcaggtacttattttagatggtgttcttaattgctaatgtttatgtgtaggtttagggcaaaacaagttatatctgtttggatttgatattttcttagtaattatgaatttcattttggg

SEQ ID NO: 409618 - DNA, 746 bp, Homo sapiens
agttttaaagcactacaaaagagtagaaataagaccacccttcatccaatccttccaccagctctcagagctcatcttagaagagccagggtcacagccatttgggggaaagaaatgggatccttggtgctgcccgccaccaggcctgcagcagccccacagccttccgtaccaacgaccatgatgttgaagtcgaaaccggtcttcatggtcttcttgcgcatctgctcgatgatggtgtcgatgccgatgtagcccagcagaatcatacaaagttgggcctggaagggatcttagtatcatccagtccaggtccctcatttcatagacaaagagactgaggcctggaggagaaagaactcaactaagaacacagagcaggtcagaggtaaaatctgggccagtgccaggttctctggttgctgggcactttcaaatgcacctcactgctctgaagcccacatctgtgcatctaacccaggggctgctccatcttggcactaatgacatttgagtaattattgtgggaggctgtcacatgcattacaggatgattagtggcacccctgatcttagtagccccccaggctgtgacaacccaaaatgtctctagatggtaccaaatgtcccctgggaagcaccattgccctggctgagaaccactggtctaagaaatgtctggggttgttcagacctgagtcatgcctccctccccgaataaagggcaaagactttttaggatcctg

SEQ ID NO: 409619 - DNA, 387 bp, Homo sapiens
gtctctctgtgttacccaggctggtcttgaacccctaggctcaagtgatccttctgccttggcctcctgaaatgctggtgacaggcatgtgccactgcacttggctgaaaatagtaatttaagagttctgtggtaggttagttcatctgtatttttgactagagctataggagattatcttaaggggtttctaaattggtgcacactaaaagataatattcaaggtactttggagcttttgaatttaggtgtatttaacttatgtatgtgttatagtttctgaccaaacaagcttgtgaaggtggcttgactgtattctggttttttgttttgtttttttttttagtttctcacaattatatatatactgttttctatctacattgt

SEQ ID NO: 409620 - DNA, 930 bp, Homo sapiens
cggaagggaagctaaagtcgttaccatggtgaccgcgacacactcagaaacgtctactagtgacggtcaagccacctacaaccggtcccaaagccgcaaacgagtcaggcatcgtggtaggacctggcgagtggggccggggagagcgggacgcctggatcgggaacttgtcgcattcacattggctgctaggaggcctcggcgaccacttccggatccggggcgggggtcgcaactcccagcccttgctcagagggctgaactagaattcccagaagcctctgcggccgccttcctgctccttcactcctgcttcccccacaaataacacttcttctttaggcattgaagactgttcctttctgggtgaaggagaatcacgtagcaattgggagcaagatgcatccatgtaacccagtactggaggtcaagatggagacaatctccacagccaccatggcctttccctgagtgctactataactcaggaggaaagccacccagatactgcagaacaccaacatgctgaaggcaaaccaaagagaagaaagactttgtgcttgagagttgaaaatgagaccaccttgccatgtcaattcaggtctcttaaagtcttcccttgcaggagaagagggaagtgaaaagatcttcttgtgaacagggtctggtgtggacctccagcaaactccaacagattaattcattgacagaatgggattgtcttgtgaaagggaaatatcttggatcccttcaagctgggaacccctcagggcaaatctgcctacttctgtcaattcatcaatctcattctccgtccagttttgtgcccttgctggagaggagttgccatcatttgtcatacacaagtatcaatagccaaattgatcacgcaaaagaaacgatatcagagattgaagatcaacttactaa

SEQ ID NO: 409621 - DNA, 239 bp, Homo sapiens
gatgttaacagttagcatttgtccttactttgtgccaggtactgttttaagcagttcacatgtaattattcatttaatcctcctagaagatagtattttaatatccgcattctcagaagaagaaacatggacacagagatattagggtggaattcaaccaagggtgtaatggctttgaagcaggctggcctcactttgaactcaggagaagtggaacagagttgcatattttcttaagg

SEQ ID NO: 409622 - DNA, 335 bp, Homo sapiens
tcccccaaaaaagatcagctccgaggagttggttctgagttcaaattctccatgaattttctcacttttctttgtaggcgtacttgttttcctagttgctggaattgtcatcgttggcagttttatttatgtgtagcctggaaaactcagtattttcagatttgaaagtgaattgtgattatttttatacattatttttattaaatatttgtctttatttaataaaggcaacttgcatcttcgaccaaccttttcattccccagtgttgtttcattttagacaatatatatggtagaatctgaataaaatatgccctaaattgagccttgttgaa

SEQ ID NO: 409623 - DNA, 555 bp, Homo sapiens
ggtgatcttcccacctcaacctctctcagtagcagggactacaggcatgcaccaccatgcctgtctaattttttgtagagatggagtttcagcatgtttcctaggctcgtcttgaacccctgagctcaaatgatccacccatcttggcctgccaaagtgctggaattataggtgtgagctaccatgttgggccaatgatttgatttgatataaaatgtggagattttgtctttgcagcactaaaagtctgaaaaacccagagttgacttatgcttattttggaagagaagttttcagcatatgtgttgcaaagggcatcgacttttttagaccaattcagcatcttccaattaagttgactgttattaaaaactgagacaaacatcacagaatttcctaggatttcataacttacagacaaaacggcttgtttcataccagaaagacaagagacagctgctttttaattactactcttgccatttgctttctactagagatgtgtctcaaacgtggaatctaattagaaatcttaattgaaaatggattcttaaa

SEQ ID NO: 409624 - DNA, 553 bp, Homo sapiens
gccctccacttctaccaccacgagtaacaccgcccccacgggaccgctctcgaggtcccccaagccaaggtgaggcaagtcccagttgaatgtcatcccgttcctcttgggcacggcggaccgctctcgcccttaaaggtgcgttgacgtggaaggtgaatgtctctttgcgtgacagtgcctcagcgcacgggcgacgaggggcacacctatccccctggctcgctctctagctggattcaggtggaacggaggaccatgaaccctctggaccttttctgccttggtcctatgcttgtaaggtttccggcctaagaggcccatcgactccttctgccttctttcagttgattacaaaataaataaataaataaataaataaataaataaataaataaataaaaaagcaggacattaaacctgccacctccagagggtcctctagcttccttctccactcctgaattgagcgaagcggtgccgacctccaccctttgggcacgagcccctgcgcacttgggagactcctgaacaccctcggagaagccagaaa

SEQ ID NO: 409625 - DNA, 520 bp, Homo sapiens
agtcttagcagagaatccacatcaacccctgcacagtcagtgaaatgggcttggctccatttctctgcaattactgatcacatccaaccctttacctaacgtgttatattgtgagacaatgtagcaaatgtaagaagccttgcttgctcatttcggcttgctagcatactttcacaaagcccctgctgtgatgacctgcagttctccagaaagatgcttcaaagacaaaacaagattgagcacacggcctcccatctctcttgcctgagtcactctactccttaaaagataagcaataatagtccttgccttttcctacacataagataacgtctgattgaaggatacctctgtaacctataaccagatctgctcatacacccaaacgttgatgtagttcggcttcaatgtagcttctgagctaatttgatgtagtggttaatatgtaacctcctgacatcgaaaaggatatggatttgtttctgaatcataaagttttactgattgttttgtgcatgaa

SEQ ID NO: 409626 - DNA, 605 bp, Homo sapiens
gcccctggcagcaaggtctctgccacatccacgtgtcctggggtggtttcagaggggctcatgcttcctagggcagctgaacccatccccaggaagacaggccatgggcagcatgcacaggtagcctggtagcactctcctccttgtccctttttgattgaaacatggctgtagctgggggtaggggcagtgccaggcccatcaataattcagcaagatggggaaaagctgcagctcctccagcaccccctgctgctggggccaggctagtgttcgcaagcatgcctcagtctggcatgtgacttctcgccctgcaggtgccctggcaggagggactggcttacgccaccctgtgcaggatcgtcttctcagcttacagagcctagtgtgattcaacaaccctccatctctgcccccaacatgcccaactgatctggtggagggaactgaagatgaaggcctctcaggcaccatggatgggatgggtgtgtgtgaagggggcagggtccccaggagctgccccaggtctggctggacagttgcacgggaagtcctgtttgtgaactcaacgtttccacggcttttccattaaactttaccccaaa

SEQ ID NO: 409627 - DNA, 640 bp, Homo sapiens
tggagagcgcggagggccgacctgacccgccgaaagggcctgaggcgaggggagcccgggtcccggggccttggggaaggacccgcagccgcacgccggccccaagtgcaaagcattgacacgaccccgagcggagagggggcgccctccttctcccgcgcccagaggcccggccgctctggcccgagccccagcctggcctccgacccagctccgggtcgtggcgccgcctgggggtccctgcgccccggaaagagacagcaggcactggaaagcgaggccggtgggcgggcgagtcgggaggctcgggcggccgaggtccgggagcggatcccaggtggcgggagctgaggtgccctggcaggagggactggcttacgccaccctgtgcaggatcgtcttctcagcttacagagcctagtgtgattcaacaaccctccatctctgcccccaacatgcccaactgatctggtggagggaactgaagatgaaggcctctcaggcaccatggatgggatgggtgtgtgtgaagggggcagggtccccaggagctgccccaggtctggctggacagttgcacgggaagtcctgtttgtgaactcaacgtttccacggcttttccattaaactttaccccaaa

SEQ ID NO: 409628 - DNA, 757 bp, Homo sapiens
tggagagcgcggagggccgacctgacccgccgaaagggcctgaggcgaggggagcccgggtcccggggccttggggaaggacccgcagccgcacgccggccccaagtgcaaagcattgacacgaccccgagcggagagggggcgccctccttctcccgcgcccagaggcccggccgctctggcccgagccccagcctggcctccgacccagctccgggtcgtggcgccgcctgggggtccctgcgccccggaaagagacagcaggcactggaaagcgaggccggtgggcgggcgagtcgggaggctcgggcggccgaggtccgggagcggatcccaggtggcgggagctgttgccacgctggctcccaccggcctctttccagatcatgaagatatttttccttcatcaaattgagaggaagtccgtagtaaagctgcccgttgaccaggtagtgccgagagaatcgaggtgccctggcaggagggactggcttacgccaccctgtgcaggatcgtcttctcagcttacagagcctagtgtgattcaacaaccctccatctctgcccccaacatgcccaactgatctggtggagggaactgaagatgaaggcctctcaggcaccatggatgggatgggtgtgtgtgaagggggcagggtccccaggagctgccccaggtctggctggacagttgcacgggaagtcctgtttgtgaactcaacgtttccacggcttttccattaaactttaccccaaa

SEQ ID NO: 409629 - DNA, 476 bp, Homo sapiens
agagcaagtccaaacccactcctaagaagccggtgctgctgagctgcctacccctgctcctacagcaagttgccacgctggctcccaccggcctctttccagatcatgaagatatttttccttcatcaaattgagaggaagtccgtagtaaagctgcccgttgaccaggtagtgccgagagaatcgaggtgccctggcaggagggactggcttacgccaccctgtgcaggatcgtcttctcagcttacagagcctagtgtgattcaacaaccctccatctctgcccccaacatgcccaactgatctggtggagggaactgaagatgaaggcctctcaggcaccatggatgggatgggtgtgtgtgaagggggcagggtccccaggagctgccccaggtctggctggacagttgcacgggaagtcctgtttgtgaactcaacgtttccacggcttttccattaaactttaccccaaa

SEQ ID NO: 409630 - DNA, 396 bp, Homo sapiens
ccgccttcaccggaagactcggaaggaacctggagttctccgcaggcccgggccccgccctgagctttccagcggccgggaggagcggatcctcggggccaggaagaggtgccctggcaggagggactggcttacgccaccctgtgcaggatcgtcttctcagcttacagagcctagtgtgattcaacaaccctccatctctgcccccaacatgcccaactgatctggtggagggaactgaagatgaaggcctctcaggcaccatggatgggatgggtgtgtgtgaagggggcagggtccccaggagctgccccaggtctggctggacagttgcacgggaagtcctgtttgtgaactcaacgtttccacggcttttccattaaactttaccccaaa

SEQ ID NO: 409631 - DNA, 410 bp, Homo sapiens
gcccctggcagcaaggtctctgccacatccacgtgtcctggggtggtttcagaggggctcatgcttcctagggcagctgaacccatccccaggaagacaggccatgggcagcatgcacagaggtgccctggcaggagggactggcttacgccaccctgtgcaggatcgtcttctcagcttacagagcctagtgtgattcaacaaccctccatctctgcccccaacatgcccaactgatctggtggagggaactgaagatgaaggcctctcaggcaccatggatgggatgggtgtgtgtgaagggggcagggtccccaggagctgccccaggtctggctggacagttgcacgggaagtcctgtttgtgaactcaacgtttccacggcttttccattaaactttaccccaaa

SEQ ID NO: 409632 - DNA, 984 bp, Homo sapiens
gcccctggcagcaaggtctctgccacatccacgtgtcctggggtggtttcagaggggctcatgcttcctagggcagctgaacccatccccaggaagacaggccatgggcagcatgcacagaggtgccctggcaggagggactggcttacgccaccctgtgcaggatcgtcttctcagcttacagagcctagtgtgattcaacaaccctccatctctgcccccaacatgcccaactgatctggtggagggaactgaagatgaaggcctctcaggcaccatggatgggatgggtgtgtgtgaagggggcagggtccccaggagctgccccaggtctggctggacagttgcacgggaagtcctgtttgtgaactcaacgtttccacggcttttccattaaactttaccccaaaaaaaaaaaaaaaataaagaaaacaaagacaaaaaaacaacaaaaaaaacaagacagggggggggcgcgccgcgccacaagaaatactccccagcagagggggcgcccagagtaatccggcgctaacccaccagagttttgtgggacacgaaggggggccccccataatattggaggaacgcaggattctataaaacggacgaaggacaaggggggccgacgagcgaataatacaacacgcctgctggccgcggcggaacaaaccgtggcctgccgcggaggagcacactcttgtgggagagaggagaaccaccacttatacagtcgcagggccgggggggcaccaaattatggtggggcaccagcacatctcctctaacgagaaagatatttaaaacacccccaagagagccaccaatccatatcacactttttcagcctgctacaacagctggcttttaaaaccccagccggccgacattatctgtagactggtcggaaaacatttgttggtccaaccaacggagcatgatacgtgcgagacaaatattttttacccggagcccatacacaac

SEQ ID NO: 409633 - DNA, 335 bp, Homo sapiens
gcggccgcgtggcagagcggacgacggacttgcgtccgagtgacggggcgcgggctgcagactggcttaagccctcggtggcagacgaatgtgcccaggctaagctcaggggacgtgtgtggccccgtgctatgggcccgctgtgagggtgccgccaggccgtcgatcactgcctggacgtgaggagtgtggtggtgaaggacactccctggacagagtcgcttcccatcacggcttccccgccggaccgcacctcccggagccctggcgccagccagcccggtttagcggccggaccgggctcccccgcggtcccaggtctggttggggtgggg

SEQ ID NO: 409634 - DNA, 570 bp, Homo sapiens
gcccctggcagcaaggtctctgccacatccacgtgtcctggggtggtttcagaggggctcatgcttcctagggcagctgaacccatccccaggaagacaggccatgggcagcatgcacaggtagcctggtagcactctcctccttgtccctttttgattgaaacatggctgtagctgggggtaggggcagtgccaggcccatcaataattcagcaagatggggaaaagctgcagctcctccagcaccccctgctgctggggccaggctagtgttcgcaagcatgcctcagtctggcatgtgacttctcgccctgcaggtgccctggcaggagggactggcttacgccaccctgtgcaggatcgtcttctcagcttacagagcctagtgtgattcaacaaccctccatctctgcccccaacatgcccaactgatctggtggagggaactgaagatgaaggcctctcaggcaccatggatgggatgggtgtgtgtgaagggggcagggtccccgaatgtcaaccctcagggttcggttgtctctgttagtgtggaacaatcatccctaagtc

SEQ ID NO: 409635 - DNA, 975 bp, Homo sapiens
gcggccgcgtggcagagcggacgacggacttgcgtccgagtgacggggcgcgggctgcagactggcttaagccctcggtggcagacgaatgtgcccaggctaagctcaggggacgtgtgtggccccgtgctatgggcccgctgtgagggtgccgccaggccgtcgatcactgcctggacgtgaggagtgtggtggtgaaggacactccctggacagagtcgcttcccatcacggcttccccgccggaccgcacctcccggagccctggcgccagccagcccggtttagcggccggaccggggtccccaggagctgccccaggtctggctggacagttgcacgggaagtcctgtttgtgaactcaacgtttccacggcttttccattaaactttaccccaaaaaaaaaaaaaaaataaagaaaacaaagacaaaaaaacaacaaaaaaaacaagacagggggggggcgcgccgcgccacaagaaatactccccagcagagggggcgcccagagtaatccggcgctaacccaccagagttttgtgggacacgaaggggggccccccataatattggaggaacgcaggattctataaaacggacgaaggacaaggggggccgacgagcgaataatacaacacgcctgctggccgcggcggaacaaaccgtggcctgccgcggaggagcacactcttgtgggagagaggagaaccaccacttatacagtcgcagggccgggggggcaccaaattatggtggggcaccagcacatctcctctaacgagaaagatatttaaaacacccccaagagagccaccaatccatatcacactttttcagcctgctacaacagctggcttttaaaaccccagccggccgacattatctgtagactggtcggaaaacatttgttggtccaaccaacggagcatgatacgtgcgagacaaatattttttacccggagcccatacacaac

SEQ ID NO: 409636 - DNA, 489 bp, Homo sapiens
gtatgtacatatgttttcaattttcttggatatatatctaagaattagaattgctggatcatacagtaattctgcttaaccttttgaggagctgccaggctgttttccaaagtggctacaacattttgcatttccaccagcatgtgtttgagggttccattttctcctcattcttgacaacatttattactccctttttaaattttagtcatcatagtgtgggtgaagaagtgtctcactgaggttttgatttgcatttccttaatgactgatgatgtggagcctctttccatgtgtttattgactttttatatattttggagtaatatctgttcatatcctttgtccattttcaatttgtttatgttcatatcctttgtccattttcaatttgtttatctttactgttgagatgtaagagtttttttatatattttctggatactaaaccattatatattgatttgcaagtattttattccattctgt

SEQ ID NO: 409637 - DNA, 380 bp, Homo sapiens
cccagggccacttagggtgcgtccacgctgggtgtgccaggcatgcacgtgggctgcagacgcccaggaggcagagccgagcctgccaaggttatgcgtgcacctctcagctccctgcttaacactgcgttcccgggagagagatttctccctggctgcttcacatccagaggagaacatcagctctcagcagaacataaggccctcttcacctgccagctgggcaacagcagttactctcattggagaccctttcccttcgccacttcccaggctactccagactgaatgcattcagggagtcacctcccaggtcaaaacctgctgtgataccatcaccctgcagcacagaccacagtcccaagcctcccattcttgac

SEQ ID NO: 409638 - DNA, 481 bp, Homo sapiens
aaaaaattccgtggaacacttatagaatatgttagataggtcatttttttagtgcagtttacaatggtttattcaacatagcaaaaactatctgctgagaaaaatttagaacagacatgagttgtgcaaaaagcaaaaagaacttcactcaaaagcattttttgctttaaaatttggtagttaaaaacagggcttcctttcagttgtttcattttgtttggaaatatttactttttagtcttaattatatttgacataacttacttcttaaagaagaagggtaataataccccaattcttataagtttaatttttcttggtgaggacttattcaaaatcaactttaaaaaaaccactcaggccaggtgcggtggctcacacctgtaatcccagcactttgggaggctgaggcaggtggatcacttgaggtcaggagttcaagactagcccggccaacatggtgaaaccccatctctaataa

SEQ ID NO: 409639 - DNA, 348 bp, Homo sapiens
tgggattatagctcacttcgccagttcccactcttagtctgtgtattgcccgcaccacaccctcaacgtgtcatctacgttcccttcatccacctgctcagatccgtgattgtttatagcatcctccagtgccccggccaggattagcaaggatttcgtgacccaatgggcgtggaggaagcgtggctttctttcatttcaccaggaaatgactgacgtcttgtcttggcgtgcatccagatgtgggaagtgcagcgttgcttgataacagaatcttattttgtgcagcttcccaggcactgaagcggggctgctgggagaagggcgtgaagtggtgtgacatcattt

SEQ ID NO: 409640 - DNA, 385 bp, Homo sapiens
taaagtgaaaatttgcatttagcagttatcaaaagatgaatatttgtttgctaaagaagggtcaataggaaaagccttgtcaagttaatatttatttaatatgctgatttttaaaaattcattttctaagagctgataattccctttgagaaacattatagttctgtgggtttattttgttaagtaaatgcattctattcagagcaagagacagttcaaccccatgctattcctagtaagtaaaaatacctagttgcttaaagttggagataaagcatttatcttttttcttatctaagttctagatttgtgcactcactatagttcttttagtgctgttggggttgggtgactggggcctagtagtacagtgacactttctgag

SEQ ID NO: 409641 - DNA, 671 bp, Homo sapiens
cgtctgccgctatctccgccccaatacggaagcggcctagtcctccggctccgacagctgggtgtccaggccatggggcagccctgggcggctgggagcacggacggggcgcccgcgcagctgcctctcgtgctcaccgcgctgtgggccgcggccgtgggcctggagctggcttacgtgctggtgctcggtcccgggccgccgccgctgggacccctggcccgggccttgcagctggcgctggccgccttccagctgctcaacctgctgggcaacgtggggctcttcctgcgctcggatcccagcatccgtggcgtgatgctggccggccgcggtctgggccagggctgggcttactgctaccaatgccaaagccaggtgccgccacgcagcggacactgctctgcctgccgcgtctgcatcctgcgtcgggaccaccactgccgcctgctgggccgctgcgtgggcttcggcaactaccggcccttcctgtgcctgctgcttcatgccgccggcgtcctgctccacgtctctgtgctgctgggccctgcactgtcggccctgctgcgagcccacacgcccctccacatggctgccctcctcctgcttccctggctcatgttgctcacagcaccttccagcctgaggaacagtgatttgcaggcaacgtg

SEQ ID NO: 409642 - DNA, 1775 bp, Homo sapiens
cgtctgccgctatctccgccccaatacggaagcggcctagtcctccggctccgacagctgggtgtccaggccatggggcagccctgggcggctgggagcacggacggggcgcccgcgcagctgcctctcgtgctcaccgcgctgtgggccgcggccgtgggcctggagctggcttacgtgctggtgctcggtcccgggccgccgccgctgggacccctggcccgggccttgcagctggcgctggccgccttccagctgctcaacctgctgggcaacgtggggctcttcctgcgctcggatcccagcatccgtggcgtgatgctggccggccgcggtctgggccagggctgggcttactgctaccaatgccaaagccaggtgccgccacgcagcggacactgctctgcctgccgcgtctgcatcctgcgtcgggaccaccactgccgcctgctgggccgctgcgtgggcttcggcaactaccggcccttcctgtgcctgctgcttcatgccgccggcgtcctgctccacgtctctgtgctgctgggccctgcactgtcggccctgctgcgagcccacacgcccctccacatggctgccctcctcctgcttccctggctcatgttgctcacaggcagagtgtctctggcacagtttgccttggccttcgtgacggacacgtgcgtggcgggtgcgctgctgtgcggggctgggctgctcttccatgggatgctgctgctgcggggccagaccacatgggagtgggctcggggccagcactcctatgacctgggtccctgccacaactgcaggcagccctggggcccgctgggcctcgtctggctctggccttcctggcctccccattgcctggggatgggatcaccttccagaccacagcagatgtgggacacacagcctcctgactccaggaagagccagagctgtgcagggaggaaggggtgagaggggggcccacacctagactcagtaaggaagtcgggttggaccttaacatctgcattggacaactccaccccttccttggccttgcccctgcccgcctacactcctacgtgtccagggcttgggccgtgacttaggcagaggagtgcagaggagggtctggcaggggctgctcaggccgcctagctgcccctttgccaggttaataaagcactgacttgtttctcagcctccctccatctttgcatagtttctggcccctcactttgttgctggggctgtttctgggaccctctgtagggcctggaaactgcaggatgcctgagggtctcaggggctggggctctacctcccctggcctgggtgagttgggggtggggcaccagcacgccaaggcagtgtcctactgatccaggctatgagaatccaaacattctttcccaggtttggcattttatagttagaagcatttctgcaacagcagtttcatggaacctctcttagctaacctggtccatggggcagcagttacgctctaagaatccatgtggtaagatcatggtgcggcaaatggaggcagggtccaacccaggtctttgtgcttttgcctttacccttgcacagctggaggaaatgagtaggaaagaaatcaaggtaaagaaatgcgctggggctgtttgggcatctgtggagggtggtgctgacagggctaggcctgcacctctctggcctcctcaagagctgcttgttaaatgtttccgtgtaaatagaatgaatagagaccgccatttccacatggcaggcctaaacac

SEQ ID NO: 409643 - DNA, 331 bp, Homo sapiens
tttaaacattatgccccgttgtattttccaatatttcttatccttctcagaaacgttatattgcgattcattcatagagcaaatacagttgccccttgaacaacatgggggttggggtgctgacccctcatgcagtaagaaatccataacttttggctcccccaaacttaactactaatagcctactgttgagtggaagccttaccaataatataaacagttgattaacacatattttgtatgttgtacatattatatactatatttgtttttttcacatgcctgctgtgtcaaatatatactgtattctgacaataaagtaagttgaaga

SEQ ID NO: 409644 - DNA, 321 bp, Homo sapiens
aataaaaataaaaaaaattatgtcttctgaggaaattactaaagttcagacactgataaatggataattaaaatgtagtgtgtccttacaatggtatattacttggtgataaaaataaatgaattacttatatatgctacaacgtggttgaacttgaaaacattatgttaaagaaaagcagccagtcacaaaggaccatgtatgtattgtgtgatcctatttgtatgaaatatacaataggcaaaacaggcaaatctgtaaagaaagtagagtcatgattttctagaatcggtggagtttggggaaatgggcggtgactgc

SEQ ID NO: 409645 - DNA, 494 bp, Homo sapiens
aatagaaccaggaaaaaaaatgggctatacctattctggcccacttaggtcaccatcgtctccttgcttctacttcaaagccccgtggctgcctcccacccagtggcggggcatcatttaaaagggaccatttttctactgaagcccctccatgcacttagtatgaaatccaaatcctctggcctggtggacgtgccctccttcttttgaatgttgttctcactgtcctttacctctgtgcccctcattgtctgtgccgtccccatgtgggagacatcccgtcccctcaatcgttagagctgtggagagctggccccgtaccctccacccctttctctacgttacacctgctttactctcagaacagtcttaccaccatctgcagttatcgtttttagttacttgttcactgccctttcccactgagagggtcagcgtcatgagatcagaacttgtcaagtcggtgcttcgtcggcgaggtgaggagtgagctc

SEQ ID NO: 409646 - DNA, 476 bp, Homo sapiens
gcaaccccagagagatcctgccctccagcatgcagcagactgctggcccagtcctggctccattgggtgctgtgtgggcccaagcaagttgaccaacctccctgaaccttaatttaatcctaggtagcccaattccagtagccattataggactgcctgcagggacagttacttaactcaggaaaagcaacctagctccaagtttagcaaccgggagctccagttgattccattagcgcaccccctgaggcattcccaagctggagtctggtggaagatgaggctcagggtgattggactgaagcaccaacctatcaaggagaagtcccacccagtctgccctgtgcgtatataaaggcgacgcgtggcggccgcagcactcattgaagccgccagttgggagaggagcagagccaggccggtgctcccgaaggcagcaagatgttgcgagccacagctccctgctggttcccacc

SEQ ID NO: 409647 - DNA, 530 bp, Homo sapiens
gcgggcacagtggctcacacctgtaatcccagcactttgagaggccgaggtgggcagatcaggaggtcagcagaccaagaccatcctggccaacatggtgaaatcccatctctattaaaaatacaaaatttagctgggtagggtggcacgtgcctgtaatcccagctactcgggaggtgccactgcactccagcctgggcaacagagcgagagtccttctcaaaataaaaaaaagaactgaagttgaatttcttatatgtgacttcaaagtccacagtctttccagctggtgaatgtgtcagtaatttaggcttctgggtttgtttagagtggctaattttgaaatgctttagtaactgttttacatagttgctttgttcatttattgattacataagtactcaagagatatggccgggtgcggtggctcatgcctataatcccagcactttgggaggccaaggcaggctgattatgaggtcaggagattgagaccatcctggctaacatggtgaaaccccgtcgctact

SEQ ID NO: 409648 - DNA, 490 bp, Homo sapiens
agcaaagtaaagaaacagtttggttgctaattgagactttaagtacttttcctgcactggaacatcaagtagagaggtggggaatgatggagtattaagagaataagactagctaagtgagatcagatctcattggcctgtccagctctgttaagaaacttaggtctaatccctgaaggcaatgggaaagcaaggaagagttttaaacacccacaagtgaaatgatcagatttgtgcttttgaaatctccttctgctgaactgtggaggaaaagcggaagagtggtactaatggaaataggacagccagataggaaactgaagctgtagttcaggaaagagacaaggatggcctgacctagtggaacagagagaaggatgttgagaaatgttttaggtttaaatggcagccctcatcccagcctaagcctctggaaaaataaagcaataaaacaaatgattggaagacaggctctaaaacatttattgct

SEQ ID NO: 409649 - DNA, 541 bp, Homo sapiens
gagctgcatgtccacaggcccctctggctgctgcttctctcctttcctggacgaaggcagccagggtggcccgcccagagttccccctgatgcacaaataaacagaggcgggctctgctggaggagtctttctctgccgggggccaggcagggcggcaggcagaggggtcgccagcagctcagaaacacaggctctttcttcctccctccaggcctgaagtggcttgttgtgtgggactgaattcagtgcaggcaggatggtcacctttgtggggcctcggggagtcacggcgcagcaccccactccccaggtcccactcgctgcctcagcagggctctccaaaggggtctgtgtgtggtgggggcagggacctgccatgggcatcccatgggcatgggcaaccccaggggagaaggaatctggaagagagacccctacctgcaggccacacccggagaaggtgccagctcgcataggacaggtccccctgtgttggtgggacccccacattgggctacaaaagcatttccgggaggaaca

SEQ ID NO: 409650 - DNA, 438 bp, Homo sapiens
ttgaactcctgacctcaagtgatctgcccgctttggcctcccaaagtgctgggattacaggtgtgagccactgcacccagcctctagaggcgatttctagagactctggcgtgggaggctttgtcttctgggccattgtcttccatcttcctcctcagccaggctagtagatttgggccaaccagacagagtaggaggtaaaagcagagagaacagaaggattcaggaaggaactcgatgcccaactccaccacgggctgtggcctgggcaagaggctcctcctaggcctcgcaggcctgaagccatttcctggctgtctccatgtttgcacaggggacggtgcagagctgaggaaagttaaatatagtctagcgtccccgctgaacggctccctgcatcggtgcccgagagtgccaccttgtggtccactcctggct

SEQ ID NO: 409651 - DNA, 355 bp, Homo sapiens
tattaacagtttggggtcatagctgaaaaactttattaagtcacagataaaatgggaaaatcaggaaattgtatgaaatatacaataacactatgtgtgatggctcaggtctgtaatcctgtgatagttaatacagattgtcaacttgattacattgaaggatgtaagcattgctcctgggtgagtctgtgagggtgttgccaaaggagattaatatttgagtcagtagtctggggaaggcagaccccctgcttaatctatgggcaccatttcatcagctgccagtgaatataaagcaggcagaaaaaaagtgaaaaagtgagtctggcccagcctcccagcctacatctctctc

SEQ ID NO: 409652 - DNA, 461 bp, Homo sapiens
ataatatatactgaccaagaaaatgtcaacatgaagtcttaaagtccttggtttcagcaggggtcgtttactgaagcctcagcaattaaatacatttatatgaagataggcattatttgatttagccctcataattcccttttgaatcttgctctatgtaacctatattcttacttggaaagacattgtggtgaggaaattgagccaggaaggaattaagtagactcaaccagtgagaggaagagctgaggtttgaagtgacgatgtttgactccagcatcttcagtcacaagcactacactacactgagtatgggttgtagacctaatcaccaatctttagcttgatgagttgaaaacttgtgaaccaatttttgcatggtgaatgtttctgtgaacagacatacagtttcaggaaggcattttagcaggcagcatgaaggaagtatttgacaccaaaat

SEQ ID NO: 409653 - DNA, 388 bp, Homo sapiens
aaatgtggacctgcccaagacacttcaccccctgcaggtggggagagtgtggcgtcctcctgagatcttttcaggttgcagaactgagtcattgctctgagacccgttccccaggacaactctctctgtgtcacccatggcatcacaggcaccctgggccatgggccctcccgagctgtgcaggttagcttgtgtgccagaaggacctgaggaccagaaaagctgaaagccagcaccacgctgagatcgtggcacacctgaggagggcagaaaggtggccccacaagcttcccaagatgaaactaaactgtatatggattgagtgggagcttttatcgttggttggttggttggttggttggttggttggttggtcgatcgacagaga

SEQ ID NO: 409654 - DNA, 394 bp, Homo sapiens
cagaagaaagtcatattcattctctaaaggagaaagaatgtttcttcttccacaactgtggtgctatggatggtttagagcaggggttttcaaaccccaggccacagaccggtaccggttcgtgacctgttaggaaccgggccacacaggaagaggtgagtggccagtgagcaagcactactgcctgagccctgcctcctgtcagatcacaggtggcattagattctcatagagcgcaaagctgcacatgcgagggatctaggttgtgctttcctcatgagaatctaaggcctgctgatctgtcattgtctcccattacccctagacaggaccatctagttgcaggaaaacaagcttagggctcccactgattctacctgatggtgagttgtat

SEQ ID NO: 409655 - DNA, 380 bp, Homo sapiens
atttggtaccgctcccacgaaagataaatttgcagaatgtactcaaattggaaacattaaataaattctataatgtaaaattagcacatcctgttgtccacactatagaaatatctgcacaagtgaccgaagatatgtgtacaagaatgatggtgattgcagcatcatttgtaatcctaaaactatgaaacgcacctcacttcaaaaacattttgaaaagggttaaataaatcatgcacaaactcaagaagaaatgctgttctcacaaacactggcgatgatcaccatgaggatgactgattccactggtcacattattgatagagcaatcagtaaacccaggcacatcctggggataggatactactgtaataggcctc

SEQ ID NO: 409656 - DNA, 278 bp, Homo sapiens
gaagaggcagtatcttgtgatgaagagagtggggtctgaaatacagagcctgggttagagccccatgttggccactttctgtgtgatcctgagaaatggatgtaacttctgtgggctttgttgtctttgtctctaagatgaggaagatgataagaatgccatcacaggattattctcagggtgaaatgcattagtacaaataaagggctttgaatacttcgagggagaaggctctgattctttcaatggacccacgcagctgctccatgggtccgtgg

SEQ ID NO: 409657 - DNA, 263 bp, Homo sapiens
ccagggcacctgacacaggttaagtagccagcccaggacggtgctagtctgcttgggaagtgcggcaaggcaggtggaccaagggggaggaaggaccacgaccgggtgaaggggcctccagttgggtagagggctcccctgggtctcttgtgcccttgggaggagggtgatataggacctgacccctagaagggcaaataggttgggtgaggttggtttaggagtcacccaggaggggcaggcctggagtgctggggcaaggt

SEQ ID NO: 409658 - DNA, 394 bp, Homo sapiens
gtggctgtacactgaggagcaggcacaacgccttccggaaggacctgcctgcggacagggagatgcagacattcacctgtgggaccctccaggagccatccaactgcagtgtgcttccgcagagcctgatcttgagccaaacaggcaacatggcttagaggaagccctggagggaaaatcagagaggcgcgggtttcccccttgagtatctctttctcctgtacaggagcctgggtcaatcctagaagcttccaccccagcaggggttgaagtcggggagggctgcgggaatgtcatgcatggtgcaaaaagattctgctatagtcaggatacagctaaagttcacatctctagccctgaaagcctgagtaagccaggttgtgggaagatagta

SEQ ID NO: 409659 - DNA, 388 bp, Homo sapiens
tcttctctttactggaatggtatccctattgctgtttccagaatttgcatgttatttatgcctcgccataaaggaggacaagtctcaggcattgggctgcctccattcatttagcccattcgtgggtaaacattcattaagtatctcctgtgctcagaccagtgttacagttatgaagggggatatagctactacagaaagagagtgcacccttgtcctctactggtggtcagtttcaccaggaagatgacataaaaggggagaaaaagaggaccgttaccagaagtcaacgaagcacagattaacaccagcttatgtattagctgtcttcatgaaaactgcatccaaagatcattttggtacacaaaaattgtattagaagtatact

SEQ ID NO: 409660 - DNA, 322 bp, Homo sapiens
acgtcatctactgttgcaaatgttaacagcatagataagtacaaatgtaacaccctttccacatgacattggaggtagttttaggtttggattggcatactcattcatacagctcatgggccataatctggcactatgttcactttagttttctgcaaaaatatagatcagggatttcaatatatctgacagcttcaggagaattgtcttcacggggaatgcatagagtacataagaaaattattcaggctacctaagtatcttcccatttataagggataaagccacgtgtgttgatgcagagaccatcctggattcgaat

SEQ ID NO: 409661 - DNA, 441 bp, Homo sapiens
aaggtggtggagagggcagttaatcccaggaagagtcaggggttagagagtaaactaagactagatccattccttggagccagcctactgcccctcccccacctccctgcccaaacccctctggagttccccattgttcccagagacaatagctagtttcctttacctgcctcatcatcccaggcccaggaatctctcactctgtttacaagaggcagcggtggggtaggagtatctgggccttaccccagggtccaaggatctcaccgctggaagatcccacagctatggaaactgaggctgggaggagtgggatgtgacttagccaaggtcacagcaaccacagatgtgggccagtgcttggtggggcctccacggttccccgtggagtacgcactttggtggttctcagagggagccatcagggcctgccgttcctcc

SEQ ID NO: 409662 - DNA, 609 bp, Homo sapiens
gcatggacccaaacgccagcatagcaccacacccccaaatgaggggggaacaggctcagcaccccaagacatccaagcaccatggcttttacagctagatgcactctccacaagccaacaggagtcgcgagtgagagccttcgaacacatccagtgtgaacatgcattcagcaaacatttcctgagccctgctttgtgccaggctgttctcagtgctcaggatacacaaggaagaaataaataaaagataaggtttctgtccttgtaaagcttatattcgtgtccgtgtgtgcatgcctgtgtgtatgtataagaatacattcaatagacacaattattaagtaaattaagtcatatgttagaaaataagtgctgtggcaaaatccagattaaaatcaccaatcactagtcaggagaccccatcagctacgcaaagaccatacaggtagtgtgcagagacaccagagaggtcaccctgtttgatcgacaaaagtatgctcattagaaggtaaaccacaggactatggggtctttatctcttttctccctgcaggattctcagctcaagaagagcacctggcacaggtcagggactcagaagcatttgtt

SEQ ID NO: 409663 - DNA, 413 bp, Homo sapiens
gcatggactcgtgtgcttcagctcctgtatattgttaggaatttacaatttagaagccagcatctggcacagtcggcaaagtattctaatttcccagctcccccttgctgcaacctggtcctcccgagtccttctgcagtgatctgtgaagcccaggatgggcttcccatgttcaggtttactataaactggcaaagaattaagtcaagaagactcaggcaatgaagagatgcacgggaatgctgaggcctgaccacaattgaaactgtctgagtcaaaagtcaagaagtcattcacatgccaagggccatttcctccacctcgcccccaccccgctatgctggaagtcaattctccacagtgcgtggtgagtcaggcatgagcactttgattacggctcagctgatgtcatt

SEQ ID NO: 409664 - DNA, 446 bp, Homo sapiens
cttcctgcctttcttattacccacatctcagccctcattcaagacctaactcccctgaagcagatcgtcgtgaccctcttgtgagaggtgccccccacaccagggaaagggtgcatccttagctccaaagatggagggaggccaagagggacctgaatggacaggcctcgccagggcccctcccggcccgtttcctgcgcttgctcatgtgctctcgtcctatcacacctttcaggaccccactcttcatcaaacctagcatcaaaacaccaagctcagctgtttcttgtcaagcaacgcttatatgaaatacatgagtatgcctttttcttgttaacctgtccttcgtgtctaatctgcagggccctggttggagaagctaggagggtggggaaacagtgttttctcctcccctctgaatctcacagtctcctccatgtcctctg

SEQ ID NO: 409665 - DNA, 337 bp, Homo sapiens
ccacccaggcccttgaccagctggccaaaccatttgttccatatatatcctaaccttgggttgcaccactcctgttttccacataatgtggataatcagtgtgctccccaaagccctgcctattgggaaaatttccccttgccacctctaagagggtctatactgccaacactgcatatctggattgtacccaagtatggagccaaccctcttgtgaacccagctctgtctttttccttctgcatcagcttaaggacccctccactctgcctagcagctctaggtgtgagttgagggagagacgctgaagcaccggcgtgggccactgtgtctgggg

SEQ ID NO: 409666 - DNA, 378 bp, Homo sapiens
tcattcatgcattcatgcattgctacttattcactaatcatttatgacacagctaaaatattcttgggatacaaagatgaataggatacaccatctgccctggataatatttacttctaattcgtagtctagtgaagaagaaatctaaatggtaagactatgtaaatctctaacagaaaccacaaagagctataatttgtttttgtaaaatcctgctgggttgaatactatctcttttgtattaaaatatattgttaatcctcaagaagttttcaaagataagagattgaacaatattttgggttaggtccatgatgtactgttattaaagtttctatggattcagattgccttggatgcctaggctggagtctaagg

SEQ ID NO: 409667 - DNA, 359 bp, Homo sapiens
atttcctcagatctaaaaggatcaggaggagaggcaaacacaccagagaggcctgccccggaagaattagaggaaatagaagtcaggagcaagacaatgggtgaggaggggccaacgtggccactgactcccaatctggaagtactttcagaaatggcatttcctattatctgaccacaattcctcctctttggaagagagcccccaccagcataatatatcatgcatgtgatcagcgtatacagagcaaacaagggaccccagagggccagggcacaccatcttagatgcaagtgccttactagccctgggagccctaactatcagacaggtgttgggtttgggggaatgatccatta

SEQ ID NO: 409668 - DNA, 874 bp, Homo sapiens
cgattatttgaagacgctcacggagcggctggctaggctgaggagagctcgccgggctctgaggcgcaggaattcaataaagaaaatggcagctcttactccaaggaagaggaagcaggattctttgaagtgtgacagccttttacacttcactgaaaatctgtttccatcacctaataaaaagcactgtttttatcaaaacagtgataaaaatgaagaaaacctgcattgctctcaacaagagcattttgttttaagtgcgctcaaaacaactgaaataaatagactgccatcagcaaatcaaggctcaccatttaaatctgcgctctccactgtatctttttacaaccaaaataagtggtacctcaatccactggagagaaagctgataaaagagagtagatctacttgtctaaaaactaatgatgaagataaatcttttcccattgtgacagaaaaaatgcaaggaaaaccagtctgctccaagaagaacaacaaaaaaccacagaagagtttaactgctaagtatcaaccaaagtatagacacatcaagcctgtatcaaggaattctagaaattccaagcaaaatcgagtgatctataagccaattgtggagaaggaaaataattgtcattcagctgaaaataattccaatgctcctcgggttctgagccaaaaaataaaaccacaagttacactccagggtggagcagcattttttgttagaaaaaaatcttctcttagaaaatcgtccctggaaaatgagccgtcactgggacgcacccaaaagagtaaatcagaagtcattgaagattctgatgtagagactgtcagtgaaaaaaaaacttttgcgacaaggcaagtgccaaagtgc

SEQ ID NO: 409669 - DNA, 446 bp, Homo sapiens
tccatatttttaggatgacattcaaggctcactccagtccacgtttctagcttccgtcttccctcccctgcacatactactgcatgtacctccacagtcttcccttttgctttgctggcatctcatgtctttgttgcctatccaagctccctgttgaaattctatccatacttataattaacatgtcccttgattcatacagactttatcagcctgcccttagtttctgtcagacagaattaagtcctctgttcccatataaagcagatctttatagctgttttagtagatattgtttatatatctctctctttcacagccccttgtaacccatctcattcccatattctctttcaacccccatctctgattacagatagaaagggtgataagtttgtgggctgtgtctctttaatcttgtacctccacagcatctaggacagtgt

SEQ ID NO: 409670 - DNA, 315 bp, Homo sapiens
agaccaggaaattccctttccatattgctgtgatgacacataaatacttccccttttccaacttgaggaaagcaaggagttcagaagatacatgtaaaagatgaaataattatttcaaacaaatctagagacgatttaaacccttggattgaattaagttttaaagtgaaatatactacatagaatttctttttcacttttccttgctactagctggtgtggttggggacaggctcatgagtaagaccacgttagttaatagactaagaaaaaaatacttcattttctttgcctttaataaattgtagtatagat

SEQ ID NO: 409671 - DNA, 282 bp, Homo sapiens
aaaaaatgtaataccattgtagaaattaccctatgtactgatatatttactacctcttctctagagaagacaatctgtctttaaagggaaaaacactggtcaataagtagtgatcaaaattatcactattctggctaaccttgctgcaaagctaaatacatagattattaaaatatgccttccctttagattttaaactgtttccaaaatgctgtttggcaccctttcatttcttccacgttagtgaagttttctttgaattggttcacagtttatcatgag

SEQ ID NO: 409672 - DNA, 536 bp, Homo sapiens
acacaacacaacacaaaaatttgggagagacacagctccaggaaagatctttacaaatcaggacatcctggtaagactccaggagtgctgacctcacagcctttaaggtccaaagccttcaccaaggcatctgcctgcaggcagtgcccagcccaggggaaggtgacagaccagatctcaggtgaaaaaaccctgacccggggaactgtgcttgctagtcagcctctgtgactaatgtactgtaccatgctgggtaagcctttagagcttcatttcctctgtctgcaaacagaaacagtaagatctgttattgtggctgtcaaataagatattaatggaaaatggttaatgtatcaaccatttattgggtacctattgtgtgcaggcgctgttctaagtactttcaggcatttttcctatctgcttctcatagtaacccgggaaggcattcctgtctccattttaccatgaggaaatggaagctcagagaggatcagagatttgtccaagcccacacagctagcaagtggtagagc

SEQ ID NO: 409673 - DNA, 610 bp, Homo sapiens
ggatgaagggtttcatgatagtaatcttggaaaaattcaaaagttagtagacaccagaaaaattaacagaagacgatttgatggagatgaatacttctaaaccagtaccaggtgatgaggaagaagacacagaagaagcaatgccagaaaacaagatgatattagacaatctggcagaagggtttccattattcaagactgcttttgacttcttttacaacacggtcctttctatgatataggcactaaaactaaagcaaatgatggaagaagaactggtagtgtataaaaatatttttagagaaaagaaaaagcaaaaaacatacatgatgtctaagaattaaatggaatgtgactgcctttcctgactcccttctctaccttctctgcctctgccatccttgagacagcaagaccaacccctcctcttcctcctcctcctcagcctactcaatgtgaagactggatgaagaccttcatgaaaatctacactcacttaatgaatagtaaatgctttttctctttcttatgattttcttaaaatcattttcttttctctagcttactttattgtaagaatacagcatataatacatatacaaaatacata

SEQ ID NO: 409674 - DNA, 417 bp, Homo sapiens
cacttatttcctctatttctatttttgcaagaaacatcattggagttacagggtttgcattgactctaggttgttttgggtaatggtcattttaacaatactaagtcttccagtctaataacaagggactgggttccatttacttatgtcttctttaattccttttagcagtgttttgtagtttttattagatgtctctttcaattaagttaattcctaaatgttctttttgatgttattgtaaatggaattgtttttgtaattttcattttagattgtttatttttagtgtatagaaatataattgacttttgagtgttgactttgtatgccgcaattttgcctaacttattctaatacattttttgggaggtgggatctttaggattgtctacataaaagatcataaatcactta

SEQ ID NO: 409675 - DNA, 426 bp, Homo sapiens
ctcctcacagctcactgtgaaccaaggggaatttcgcaggtatccatttccctatatgtccctacaaacaccttctattcaatgcagagtaggtattggccccatttcacagaacaggaaaccaaagggctttacgggctggttcattgagtctggcagtgagggcctctgcttcctcttcctggttaggccactgcactcttctttcaccaggaaccaggcagtcttctgggattttggttccccccccttacctgcactgtggaggggttggactggatattttatattttttccaagattttaaaggcatgaactttgttttctaaccctgaggagaactttttaagggtagtagggttgctgtattatttatcgcagcacctagaatatactgaagaataaatgaaaatctgactaacatca

SEQ ID NO: 409676 - DNA, 376 bp, Homo sapiens
ttttttttggttctttatagtaagtcttgctactgttcattgtttgggtcagccttgtgtgtatgggttgtaatactcgccgtgaaggtctgcattttcactcctgagctggtgaaactgggaacccactaatagaaaacaattctgaacacgtgatgaacatcagaaaaaaataaaggaacgcccagacatactgcttttagtgaaccgtaacactcactgtgagggtctgtggcttcattctttaagtcagaccaagaacccaccaattctggatgtagaaggatctactggattccaggagtgcaaatctagtttgagcaatacagcaaggttgtgtgtctgaaataaacgaataaataaatgggtgtttaaa

SEQ ID NO: 409677 - DNA, 482 bp, Homo sapiens
gccactgcactccagcctaggggacaagagcaagactccatctcaagtaaataaataaataaataaatctccaatcaatcaatcaatctaatgattagtattataattcaggtatgctctagatctccaagaatttagaaaatacaaggcagatgtcaactgtgtgcctatatatttagatatcacttttaataatagaaatgtggcacacgtaaaacattattttatatgggaagctaaaagactattaaatatacagatttatagatattgttagggcatatgtaaccactaataaggttttttaaatgtaatcttcagtgcagaacaccttacaaaaaaagcacttgaagttttgttgttgttgtttttttttcctgagccagagtcttgctttgtcacccaggaggcagagattgcagtgagccaagattcaccagtgcactccagctgggcgacagagcgagactccatctcggaaa

SEQ ID NO: 409678 - DNA, 513 bp, Homo sapiens
atagatccatgaaacagaatagagagcccagaaatagattcatacaaataaagccaactaatctttggcaaaggaacaaaggcaatccagtggagcaaagacagcttgttcaacaaatgacactaaaacaatcgtacatccacatgcgaaaaaattaacctggacacagaccttacattgttcacaaaaattaactcaaaatggtcacagacctaaatataaaatgctataaaactcctagaagataacaaaagagaaaatctagatgaccttggggatagaaatgactatttagttataacaacaaaggcactatccagcttaactggtaagctggacttcagtaaaactgaaaaattctgtccccactccaaactgccttttaattctgaatcttaagttttcattaactgagagaatactttgagctaacacaatgctaatctgctagacaggagtacaatttagtaaatgaaattagtgaatattttattgaattttgtctttatttta

SEQ ID NO: 409679 - DNA, 357 bp, Homo sapiens
tgacacatatattcacagtggaagacagatactcatttaaaacacatgactctcctaaaagcagaagtggaaagctcaagtgaatcattcattatactctctgtcacagcaatggggtagatttctttccagaggtatatctttgaatactttgtccactcttgtgtgaaataacttacaggatggcttttccactgcttccattgtgaggccattctacaatttaatagatattactattgggaaaactttgtagatacagagcctacatattctcttctcttattcaatttcatgccctgacttctagttatgcccccagggagcatcataaacaattctttcccttcatggcga

SEQ ID NO: 409680 - DNA, 687 bp, Homo sapiens
ccaagaaaacttgctgtttcgtaactgtcaatggagaaagattcttcgccaagcgcagtggcacatgcctaaaatcccagcactttgggaggctgaggcaggtggaccacctgaggtcaggagttcgaaatcagcctgggcaacatggcaaaacactgtctctattaaaaatacacacatacaaaaaaattagctggacgtggtggtgcacatctgtaatcccagctactcaggaagccaaggcaggagaatctcttgaacctgggaggtggaggttgcaatgggctgacattgcaccactgcactccagcctggatgacagagcaagactgtctcaaagaaaaaaaaaaaaagattcttaaaaaccatctttctattgaaatttaatattcatggaaacttgaaaaaattacagcatgcatgcgactgtaaaacatgataggggccttcagggtataataagctattgtagcataatatgccatttctattattccaggaagcctggtttactttaattcatacatcttgcttcattctacattttgaggtagtgaaacctttttttaaaaaaccttagaatctaatttacatcaaaatttggagctcaccagtcattgctatataaggacagatttttctgcttcaccagtaacttttctctaagaacagctacattgtttttgg

SEQ ID NO: 409681 - DNA, 475 bp, Homo sapiens
  misc_feature (42)..(42): n is a, c, g, or t
tcactcctctccactctatagcatcttcatgactacaggccntgctgaccaacagcagccctaggccgaccacaaggcactgggctgcagacctgaagacagtagcttcagaaaagcagagtcgttccacattcggcagtttccatagatttccccagcaagctcccccttcatagttccacttcagcagcttgggcatgcttggattatcagatttccctgcaagcttcaatttgtttacccacaccagtgcttcaaacagcctgctcagtcatcctttctctgatcctgactggcacgccacagtagagcaggctacatttttatcccttgccccatatactctgatccttcaattttccttttccagaccctcattttcccagctcctatatttggtaaaatgtaattcctgtgataagtaccttagtcccataattcttataatggctttgttttcctgatggatacggtc

SEQ ID NO: 409682 - DNA, 471 bp, Homo sapiens
ggtctggccatgtgggatgtctgttcctcgcttccctcctgccatggctgttaagtttcctgaggcttcaccagaaaccaagaggattccagcaccatgcttcctgtatagcctggagaactccaagaaggatcgtgtcagtcctgcaacttgtcagtggaattaaatttcaggcgttttaaagataaatggtaaaactgaactggaaatccatctggccggctgcctgctctaatgaataaccccactttggctcgtgcaatgacttcttccctttggaatgcaagtgcggtggcagtgtcaaggatgcctgtgtgtttgcagcaggttccttccagaagcagctgcaagtgccacctccaggccatctggccaatgtgaggaaaggaggctgcaagggcttggcaaaaacaactttctgttcctctggtatcccctgataactgatttcaagttatggccaaggactgc

SEQ ID NO: 409683 - DNA, 447 bp, Homo sapiens
actgtgaggaatgaatgtgtgttctctaaactaatctatgatatttttgttatagcagcctgaactaaggctcacatactcacaagaaagaagaaaaatggtagtgttgaaggaagccaactgatgagaaagacagggtctcactatgtggccccaggctggtctcagactcctgacctcaagcaaccctcctgcctcggcctcccaaagggctgagatgacaagcatgaaccacggtgcctggccagtcatttttattataataattataatatattataaattattatatagtacatatcatacattacatcatacatcactacatgctatataatgtataatatatacgttgtataaatgtatattaacataagttttattttgtaatttagaataacatgatctgtaacagtatataataaaacaatcagcggattcggaaac

SEQ ID NO: 409684 - DNA, 412 bp, Homo sapiens
ccgcgcttgccctggaagtatgtaaatcttaaagaacctgaaaatattaaggtgtgaaataaagttatatgagaaaaatagtcagaaagttctgtgtagagatattctaaaaaaaacctgatctttccttgctaagtaaaaatgagaaatttaaattggaaataaacttttttgtccacaaagattatgcttattatgatgaaataattcttaagaatttctagatgttatatcttgaagtattattattttttattttttttttgttttttagagacagggtctccctctgttgctcaggctagagtgcagtggcacagtcatagttcactgtaacctcaaatccctgggctccagcgatcttcctgcttccacctcctaagtagctagaactataagcacacaccaccac

SEQ ID NO: 409685 - DNA, 442 bp, Homo sapiens
atgcgagacactttcacagtaatatcctgtttctcagaacaaccctgtgaaaatgggtcattatccagttttctcaatgaagaaataggctcagcaaggtcctcagacttacgtaagtcagctgagctacactgactacactcagaccttcccactctcaagcctctttttttgtttttgagacagtgtctcactctgttgcccaagctgtagtacagtggtgcagtctcggttcactgcaacctccgcctcccaggttcaagcaattcttctgcctcagcctcctgagtagctgggaatacaggcacctgtcaccacgtccagctaatttttagtagagaaggggtttcaccatattggccaagccagtcttgaactcctgacctcagatgatctgcctcccttggcctcccaaagtgctgggattataggcacgagccac

SEQ ID NO: 409686 - DNA, 3160 bp, Homo sapiens
acagtttcacccagcaagcgtgagaacaggtactgcttcctgagcaccgccagccaccggcaccaagaccggccacatcccagcactgcccacctctgctcccagccgccagatgacggaggctctcgccagaccctcagcacgcagagctggcttctgatagaagtgctcgggaaagaaagcaaagcgggaggtgcctctttagaaaccacgaagtgcacgcggcgtcgacagtgatcacgccacctggacagccagagtccaaggcataaggaggaaaatgagtctcctcaaagagcggaagccaaaaaagccacattacatccccaggcctccaggaaagcccttcaagtataaatgtttccaatgtccctttacttgcaatgagaagtcacatctttttaatcacatgaagtatggtctttgtaaaaactcgattactttagtatcagagcaggatcgagttcccaagtgccctaaatctaactcactagaccccaagcaaaccaaccagcccgatgccacggcgaagccagcctcttccaagtctgtcgcaaatggactctctgccttcgactcgaagcttcagcacagctctgccagggaagacatcaaggaaaacctggagctgcaagcccggggaacccacaggtgcctgggacagaagccagccctccacagggcatcaccctgcaagagcccagctccggaagccgccctcggtgcccagcctgctctggaaggcgcagctcggccttctgcatttgttccagtcggcgagcacagactcaaggggccagacaacgccgagccgcccgagacactggctttacacaaccccactgccaaggccgtgtctttccacaccaagtcggccttccacactcctggctacccctggaaagccggctcacctttccttccaccagagtttccacataaaatctcatctacaaaggggcttggggccatttccccttacatgcaccccacaatcccagagtacccgcctcacttttacacagagcacgggctggccaccatctactcgccttacctgctggctgggagctcgcctgagtgtgacgcacccctgctgtcagtctacggaacccaagacccgagacacttcctgcctcacccggggccgatccctaagcacctggctccatctccagccacatacgatcactacaggtttttccagcaatatccctctaacctgccgattccttacggattttacaggccagagtctgcattttcctcctatggtctcagactcccacctgtcactggcctcacccgagatcagagctctcacctgcttgaagaagccaccctggtctatccagcctcgagtccttccaggttaaacccttcggaccccaacagaaaacacgtcgagttcgaaagtccaattcctgaggctaaagactcctccaaggctgggcagagagacacggaagggtccaaaatgagcccccgcgcagggagtgcagccacgggctccccagggaggccgagccccaccgacttcatgcagacgagccagacctgcgaaggcctgtacgacctctccaacaaggcagcctccagcgcactgggaagactctacccgccagagcaaagcctcacagccttcaggcctgttaagaaaagcacagaatgcctacctgcccaggctgctgagaccacagcagagtctccagtaagcctcaatgttgtgaacggagaccctcctgctccgaccggaagcgcctctctcgtctcggaggccgcgccttccagtccggacgacagctccgggatgggccccctcaacctctccaagaaatcagagataaacctggcagccacccacgaacccacgtaccaaggcagcccccaggcggaaaccgccagcttctcagagctgcaggaccttccactcaatctctcggtgaaggacccctgtaacacccaggctccgaggcccgccttccccggtcgaccacgagctgcggaacctgctgctgctgttccacagaagactgggacagaaggttctgaggatgggcccagccaccctgagaccaagccaggcagcctcgacggtgacggggccccacccacaggccccggcgaggaggctccagacgcatgcgcggtggacagcagcgaggagcagaagcagacggcagccgtggccctgtgccagctggcggcctacagccccaggaacatccgggtgggcgatggggatgctgcggccccggaacctgcctgccggcaagacacacccacactgagctccatggagagccaagaggcccagtgtgacctcagacccaaaggacaaaagaggacaagtctaagggatgctggaaaatcccagcaaggagctaagaaggcgaagctgcaggacacggccagagtgttcacactacgaaggagggcccgggtgtcctaacgccgggttcacacgtgtgttcacagagctacggccacacacacgccttccaaggtggcaagctacaacacctctgaactggcactttcacatttttacaaatgcagctgctgcttctcaaaaaaacaaacaaacaaacaaacaaaaaaccctccaattcagtttttataaatattaagcatgaatattaaaaggtgcttctacttttggttgtaaaaacacctgaatgactctaagactgatatgtattttcaagtctaagctgtcttacagaagatcttttataaatgtttccttataaatatctcaccattacaacaaattgttttaactgtttttctattagctctagctgcatatttgatgtaaatgacaattactgaaaaaatgtcagaaaaaacattttcagtactaacattaaagtgccatatgtaaaaaagaaaaatgtgatttgtataactaaataacacacaaacatcaagaggctatttatacaaataatttatttccactagggaaagtgcattactggtgaaggtattatcaatttattctacttgcttataatgttacagtgaatgttctggcttactctgcctcactttccattccccaaaatgatgtgtatgttgctaattttccaataaactcatatgaaccataaggaaacataaaatgcaaataaacataaatctatgttatccttta

SEQ ID NO: 409687 - DNA, 334 bp, Homo sapiens
ctgggtggcggacgtcagttggcggcacgggagtgggtgcggcggacggcggcggctccgcgagatgagtatagagatggcggatttcgaagagttgaggagtggctgtaccattttacatccctaccagcaatgtatggagtgatccagtttctcagcatcctcgccagcatttggtgttatcagtgtttttcattttagccattctgcccatagagccagttgcattaacatcctttgccaaataatgttatcactggaaatatgagatatgagacctcctagaaattcctctgagagtcaagcttaggtaggatgactttgtgctttgttt

SEQ ID NO: 409688 - DNA, 387 bp, Homo sapiens
ggcttaaagtaatgtgtcatccagagtttgttcgcctgttggatgattcattcattgatcttccaaacaaacagatggtgggtaggggagaagacagtggaaaaagaaaggaaagaaagtaacaaaaggggaaataatgttgacatgaagatgtctgttttgtgattttttttatctcttaaaaactagaaatgactatcttggtttcttctgtgaaaaattcaaactagtaataccataaacttgaagtaagttccatggtttaactgaaatatctgcagtattgtttgttttatggttgtcgttttcatctaaatgaagatgatatttatataggacagtgaggctagaacataagtaatacattggatttgatgactctggttg

SEQ ID NO: 409689 - DNA, 336 bp, Homo sapiens
ggcaaagaaatatgcaagaggaaggtgtaatgtgatgaccatcagactgagtattagatgtgaattctatactctatcctcccattttgggatggtgatgacaaaaacaaacaaatcaattaagttagaacaaaagccactggagatcacaccaacttccagataaccaccagccctcaaaatgcttcttgactcttgctactttagagaaattgtagaccaaaattcagatatatgtggggccagacactgtacactaaatgtgttactacatcttaccctttcaataaatacaaaatctaaagttgtgacccaacactgtacaaaaataaattg

SEQ ID NO: 409690 - DNA, 414 bp, Homo sapiens
ttaaattctttatagaggattgtaactttctaatttgccatactcatttttctttattttcccctctgatataattcagctgtgtctcaccaaaatctcttcttgaattgtagttcccaaagtctccacgtgtcatgggagggatctggtgggaggtaattaaatcacgggatggtttcccccatgctgttctggtgacagtgagtgagttctgatagtgagtgagttctgatggctttatcagcatctggcatttcccctgccagcattcattgtctctcctgccaccctgtgaagaggtgccttccaccatgattctaggtgtcctgtggcttccccagtcacttggaactgtaagtcaattaaacctcttttctttataaattacccagtcttgggtatttcttcacagca

SEQ ID NO: 409691 - DNA, 512 bp, Homo sapiens
ttaaattctttatagaggattgtaactttctaatttgccatactcatttttctttattttcccctctgatataattcagctgtgtctcaccaaaatctcttcttgaattgtagttcccaaagtctccacgtgtcatgggagggatctggtgggaggtaattaaatcacgggatggtttcccccatgctgttctggtgacagtgagtgagttctgatagtgagtgagttctgatggctttatcagcatctggcatttcccctgccagcattcattgtctctcctgccaccctgtgaagaggtgccttccaccatgattctaggtgtcctgtggcttccccagtcacttggaactgtaaatgaatagatcttgtacacaattcaatgtatatacctgtgaaaccactatcccaatgaagagaaagaaaatttttgtcattccagagagttcactcaggccctcttccagtcaatctccacactcctagacgatagctgaagaatgtgagaaaga

SEQ ID NO: 409692 - DNA, 402 bp, Homo sapiens
caactgctatgaacattcttgaacatattttgtgaacctgtggaaacatttctcttgagtatgtacctaggagtataccttggaggttatagggtaggctaatgtttagttttattagaaactcctaaacagttttccaaagtgcctataccattttgcattcttatttacagtacatgaaagttttagttgttttccatcctcaccagaactgatcagactctaatttcagacattctagtggatgtgtagtggaatctcaatcctccccaccaatgaggtgttccaagatgtaatttacatgtaataaaatgcactcattttaagggtatagtttggtgtgtttgtgaaagtgtttaaaaccacataactattcataccaccccaatccatttttaggta

SEQ ID NO: 409693 - DNA, 400 bp, Homo sapiens
atgaatctcacaaacataacagtgaacgaaagacaccaaatacaatcaagtacatcctgtgcgattccttactatcaagtacaaaaatacatctatggggttagaaatcaggattggggttgccctgaagggggcgcaacaggaaagtttctggggtctcagcatgttctgtttctagatctatgtgctggttacatggttttatcccatttgtaagaattcatcaagctgtacaaatacaataacgtacacttttctgtatgtatgttatatttaatttcaataattttttaattaaatacatatgtggccaggtgcggttactcacgcctataatcccagtactttgggaggttgagacagaaggaatgcatgaggccagaagtttgagaccagcctg

SEQ ID NO: 409694 - DNA, 1403 bp, Homo sapiens
aggcaaacaaaggtttgctgaataacatactggtgtaagaaaactccatccagaaacaaagtccagagaatttaaagagaaagaaaaaaacaggcttcacttctaaaaatgaggtctgctaaaaaaaatatgaagcagacaggatgggcaaagtatatatctggactcattcaaatactaatatttgaaaaatataacttatataaaaaaggataagctaccaatctgagactataggattttattaatttaatacaaagcaaaaagatttagaccactgcatcaatggtgaaaccttatgcactttctgaatgcatcattattgtcttggtactggtatttcagaggaagatcacccacccaacctcaccctccaagcacctgacaccggctgagacagaacgggagcctaaaaggacaactggtcttccctggcacaacacttcctatttctgaaatcacaggcagtgcatttagtctgacctgggacatccaggccatctgagtacagcagcctggatatgaaatgcaccatggtcttgcaggagcttaggaaggaaatgatatcaggaaagagatgctcaatatagtgtgctcaccttacgatgaacttattttattgcttacagaaggaactgaagcattcttttcactctgtcggtgtattcgtttctacacctactagatactgttttggcagagggaaaatggcaaaacaactaaaaaaggtgcacacctgtggcaccaccttcctgtacttctctccagagccctcaactcagtgctcaatagtttacttactttttcctttagggcaataaatgatgaagggaaccataaaacactttactttggaccaaatataacaagataccaccactggaagaaagtgacgacaggaccgtcaccaggaccccagagaagagctggtgttcaagcagcgccctgcgtggcacttcactcctgaccccatgcttatttttttgggttttgttttacatacgagttggttaccagcttttcttgctgtttccttggtattaaaacacagtagggtagggtacagccagataaagagcgttgaggaccctatggagggacacaatggcagcagaagtacagaggccacgtgaaacgcaacttctatgcagtacagtaaatgagtgtttttaatcacaaactggagtgttgaaaaggttaaattattccctggaaatggcagaattttaaaaggcctggaaataataatatgtttcagaaataatcttgaaagttctttgaggctgggggtggtggcacacctgtaattccagcactttgggaggccgagatgggtgaattacctgaggtcaggagttcgagaccagcctgatcaacatggtgaaactctgtctcaaaaaaaa

SEQ ID NO: 409695 - DNA, 1563 bp, Homo sapiens
  misc_feature (523)..(523): n is a, c, g, or t
gggaaggggagcttcacagggggttttctggaagtgcccagggtgaaactgtgcttgaaggaagctcagatgtcagtttttcagattgtgctgtctgtatatctaggcattcataaatactttctagaactttgtgtggtgttttgcaaatgtagttaaacagatttgcgaattcagtaatttataaaaacttaagcttgtgttcttctgaatcccgttatttttcttctgcctccgaattagacacttcccctatgcattaattccaagtacagtcaaagattaagtaaggaaatgatgtgcatgaaaaaagttctgcatgtttgctaataatctaatgactgtgacatctaaacactggaaacaccttgatttatggataatagggctatctagaattttcaagggatcatggacaaataattataggcaatttgatcaagtgaccatgtaagaccattggtgcagatacagactgattaaagtggaaaaagttcttttttcttcctagcttcctgctctnccattaccttgataatgtgagccaaggcctattggcctccacaggacaagccctaggctgtagtctgggcttgcttgaacctgcctgacctgtcacttcaaggccagccctgatcctctgagaatgggcctgggaaccatcagaaattatgtctatttgcagcaggcagggcctcttttggtctccagcatagcccttgccccatctgctcttttcactttacatggagtactaggcaaagtggcttcctctttgggttttgttacatactttaaccaagactgtgcatgcaaatggcctggcatgtactcggtgctcaggatgttgcagctactgaattattatcattgatttcttctgcgtgtgacctggatccacaagtcaaatgcaaaaatttgtcttgactgatggtcctctcctgtctccctccagtaccccctcttgaggcttgcaggggcagggaccagagggcccagcaccatgtcctgctaatgctcactcctgactgcaagggagtcagggttgggagacgctgtaacaggagaggctacagctgactgggatgcagaccgggggctgggtccttaggaaatttgttctaatcttagaaggtatgccctggcttcctgctgcagcctgaaggacaagtgtcccagacctcaggacacacacgcacactcacactgtcacttgactcctgcctgggaggcaggaatggcccctagtgaagggtacttgtgtgggcctccaggtggctgtaacataccccaggactccaggcaatcctggaaaggtggctcctggagaccaaccacccttcagactcagaggagctctctgtgaagtcaattttattattgaactaaccaacagtagagagtcagagtagtgcataacagggagattctgaacttaccttggagagtaacaaatcgtacatttacttgttggcttaggtgagtaaatccatctaaatcacccatgccagctatgaagagacacttctttcccactctttccctttgcaaaagaaaaaaaaa

SEQ ID NO: 409696 - DNA, 371 bp, Homo sapiens
cccaaaccatgctcatagtccttgacccacaaaccccacataacatagtatatatcttgagattttaaaaaaatcccatttttttttcaagaaagtcaaaagatgaaaaaaaagtttataaatataatttaacaacaaattataagcaacctaaagatccaaaagctagaagcataagttggtcagcaatgttgacaaggctcttgggaaacaatttgtgacaatgcacagtaacacaactcttctggcaaacaatgtaccactaaaaaaaagaaccaaaccatgctcatagtccttgacccacaaaccccacataacatagtatatatcttgagattttaaaaaaatcccatttttttttcaagaaagtc

SEQ ID NO: 409697 - DNA, 1377 bp, Homo sapiens
ttgctgaagtaaaggaaccctgcagccttcccatgctatctgttgacatggaaaacaaggaaaatggctctgtcggtgtaaaaaattccatggaaaatgggagaccacctgatcctgcagactgggccgtgatggatgtcgtcaattatttccgaaccgtgggatttgaggagcaagctagtgcttttcaggaacaggaaattgatggaaaatccctgctattgatgacaagaaatgatgtgttgacaggacttcagttaaaattggggcctgctctgaaaatctacgaatatcatgtaaaacctctgcagacaaagcatttaaagaacaactcttcatagtacagtcaaattggggtcttcgacctcaaaaaaatacataatgacataatttagtttcatgtaatgaaactttgtaaacagaatacatacatgtgtatatgtaaagaatttcaatcaaatgaaacgttatcctattggatagactaggcaattcatcagctcacctgaaatcagccaggaggagcaaggacaagatgcgcacagggtggttttcctcatggattttgtcaaatagatgatctttgacacgattagacactcctccccacaaaggctttgaaatcataaggattttcctcatctctttatagctttcccaaaatcttttaaaaaagaatttaattaaatgacagtcttttggttacagacttaggatgagtaaaaacaagaaaatttggggagggggagaaagaagaaagggattgctgtctcccttgaattcctctgttccttagagcttgtgttacttggacggaattgccaacacccttttttatagagggttctccacttgaccttattaaggttttattgggatatgctgcagtgtttgaaatgaacatgcatcatggccccttcaggagcagaatcatagctctgaaaagagaagctccgttgtgtactgaggatatccatccatattcagctagctttcaaatggggtaatgatattttctgcatagattttcttttaaattggttctttgtttctgaagaaagaattttttttaacttcatggttttatttataataatttgtttctgaagaaatttgccgagagttacaggtcaaaaagccttgttactagtacagaatatttttatatatattccttcatgatggtgtaattttttttaattgtcctatgctttgttcggttcctgggttaagtacttgtttttaagagcttggaaaaagtgggcttgctacatctctgttcaaagagacatttgttcaatctctgtgtgtcaacgccttgttgaattggtgctttgtggttgcaataaagcattgcttcagtttaaaaaaaaaaaa

SEQ ID NO: 409698 - DNA, 494 bp, Homo sapiens
ttgctgaagtaaaggaaccctgcagccttcccatgctatctgttgacatggaaaacaaggaaaatggctctgtcggtgtaaaaaattccatggaaaatgggagaccacctgatcctgcagactgggccgtgatggatgtcgtcaattatttccgaaccgtgggatttgaggagcaagctagtgcttttcaggaacaggataaagttactgacagagataaatacctagaatgcacaccaatcgagagctggagtggtcaaatcaaagggctgctgctatgataaggcctacttctgcctgcctaccctcagaaacaggatctcactatgttgcccaggctggagcatagtggttattcacaggcgtgatcccactactgatcagtacaggagtttcatctctttttgataaagaagactgaggatcccacacaggtgcacactgttttgtgctatagatgtacaactaataaaacaaatccttgtcaatactaa

SEQ ID NO: 409699 - DNA, 682 bp, Homo sapiens
aactgagaaccaaagtatccaaacaggagtggctccttcagagcacagctgagcatctgaagatcgacaaccagcagaaagagagcatggagcagttcattgtcagccagctaaccagaacacatgatgttttaaagaatgcaaggactaacctagagttaaggaaactactgcaccagtcagaggcaccaagcctgtccccaacccatcaccatctgttagcagatcttgtaggtgacgcttggcctgctttcgccttccaggagaagatttccagtccacttgtgaaatccctaagggctctgccatgtactccagccttgtgacccttgccttccaggaaccatgcaagaagtgcagccaccggaagtccttaagagcatctgggtctcattcctccaagtccactggagggtccagaagagggagtcagagttgtatcctggtggagctggcagaaaggcagaaagcctttctgacagctatggaatacgattagccaaggtccacttggcccagcactaagaagaagatgcatagtttgcacagaaggttttgtgatactgcctctcaacagccccagcagcttgggaactagcaagagcacatttcttgcctcatcagctgtcctgagatggaaaactcagtgaatataggaccctgattccgatgaatggggcac

SEQ ID NO: 409700 - DNA, 736 bp, Homo sapiens
aactgagaaccaaagtatccaaacaggagtggctccttcagagcacagctgagcatctgaagatcgacaaccagcagaaagagagcatggagcagttcattgtcagccagctaaccagaacacatgatgttttaaagaatgcaaggactaacctagagttaaggaaactactgcaccagtcagaggcaccaagcctgtccccaacccatcaccatctgttagcagatcttgtaggtgacgcttggcctgctttcgccttccaggagaagatttccagtccacttgtgaaatccctaagggctctgccatgtactccagccttgtgacccttgccttccaggaaccatgcaagaagtgcagccaccggaagtccttaaaacatcaggaaaggttggcctgtcccccttttgtgcagctacctatctgctgaggagcatctgggtctcattcctccaagtccactggagggtccagaagagggagtcagagttgtatcctggtggagctggcagaaaggcagaaagcctttctgacagctatggaatacgattagccaaggtccacttggcccagcactaagaagaagatgcatagtttgcacagaaggttttgtgatactgcctctcaacagccccagcagcttgggaactagcaagagcacatttcttgcctcatcagctgtcctgagatggaaaactcagtgaatataggaccctgattccgatgaatggggcac

SEQ ID NO: 409701 - DNA, 349 bp, Homo sapiens
attttcttctgtcctttttcctaaatagtatttttttcaatattgaaggtattatttccagtatatgcaactttatgtcttgtttttaaaaaaatgttcacatatcataagcatgttcccataaatgttagcaaaaactcctggtaatcattttcaacaactgcattatagtttatccaatgaatacaccatgctttatttaaccattcctctaatgtgagacaaatataagttgttaataactttttactctcctaaaaaatgctatgatgatatttgcctgcaaattatggagtaattacagagtattctcccctcagataaattcctaaaagggaaatcactggaa

SEQ ID NO: 409702 - DNA, 411 bp, Homo sapiens
gaccacactctccttcacgtccccttgacagtagaagtaagggtgactccaaatgcctttttctttctggcatgcgccccactcccccgccatcccaggggagccttccaagttgcccagctgccaaggcggtagctgtggcagttgcagggaccggggagcgcgccgtgcggaggcaggaagaggaggaggaggagaaaaaacgctgcactggctatcaattttgaggagagcgaccgctgccgctgccgtggaaggaaacgctgccaaccgcaacagaaatgccactctcggatacctaagtgagcatgtgtgcgactctgcgcacgcctagttgcgcagctcaatgacatcgggcttcttagcaagttatccagtttccgggttttgagtgtacccatcaggctccgt

SEQ ID NO: 409703 - DNA, 397 bp, Homo sapiens
caaatttgtatgtttgactcaaagatgttgccgtagctctgtgggtttctacttagcaactcttcccccgagttaccttcagcaaaggcaagagagggcatgtggcacttgggctgtagataaaattcctcttctgcccaggcctgggctggtggattgaaatctcattccatagtgcaggcaagcaagaaggacaattttcgtcatttttccgtcatataaattaatttcttctttcaccctttttgcctgttagtgaaaattaaatcccagttctgactcccgcccactttctcaggggctgtgtctgagtcccgggtgcctgctcatggggtgggtgacctgcctggtccccagtcaccaagatgtccattgtccttcccgggccttggtcccc

SEQ ID NO: 409704 - DNA, 448 bp, Homo sapiens
aggttccatgtcgcgtcgaccgtttcttccatgtgttacttgagtgaaaatttacgggctacataaatatggctgttgtttggaaagaaaatgttgtgacattagtatgcgcacaagacaatgggaagtacgaactaggattcctgtaaatacgagaaaggaaaagaatgcttttactatgttagaagacttaaaatcacatgaagtgattccagtctttctgttgttattccgatgttttagctattttagattttggggtttggcttttttttgtttcattgcctttctacataattggataaccttgttagtatctgcagaatgccctgattaggaaatgtgttaaccctatgtgtcaatttggtataatttcatattgttttcatattgttttatgtggagtcttccaataaatgtatattgtatatgtgtctgtaaaaggtgt

SEQ ID NO: 409705 - DNA, 376 bp, Homo sapiens
tctcaaaaatttatatgagtaagagttacgacttaagacttcttttggtcagtttttgcatcaattctgcatattgtatccctgatcctgtctaccttcctagaaacttgggtttctatcacaagggcttccagggatgagtttgggagtgtcagtcctagcatgactgcataattggcaaaataacactgaacacatctcctttagggtagtgggcccacactgtaaccccctcatatgaatgatgacacaatattactagtgtgcaaaaagaaacttagagtcataggtatactgacagtgtctgcattcttttaagtttttattattgaaatttctagacttatgtaaaagtagagagcatggtatcatggat

SEQ ID NO: 409706 - DNA, 512 bp, Homo sapiens
ggatcattctctatcttacttgatgttagttccatttttccagtcactctgaccaaaagccttgaggaatcatcctcagttacgttttttcaaactctaaatctagtccgtccacaaatccagtatctatggtacaacaatgtgtgtgaatctcagaatcttaatactgaatgacaaaaagccagatacaaaaaagtttatatagtgtatgctgtgtaattgtattcatatgaaattctaggctgggtgcaggtaatcccaacactttgggaggccgaggcaggcagatcacctgaggtcaggagttcaagaccagcctggtcaacatggtgaaaccccatctctactaaaaatacaaaaattagctgggcatggtggtgcacacctgtagtccgagcaactagggagactgaggctggagggtcgcctgaacccaggaggcagaggttggagtgagccgagagtgcagtactgcactccagtctgggccacagagcgagactctatcaaaa

SEQ ID NO: 409707 - DNA, 353 bp, Homo sapiens
gccttaacctcccagagtgctgggattacaggtgtgagccacagcgcccgacctaatttttgtattttttttagtagagacagggtttcaccatattggccaggctggtctcaaactcctgaacttgtgatcctcctgcctcggcctcccaaaatgctgggattagaggcatgaggcactgcacctgaccaaaatttagctttttaatatgggaaatgttttctatgtaagaaatatctgaatttttacttggtaaagtaaagcatttctacaggaggtccattgcctgtctcaaataaatctttcaattgtgcattttcctagagactttttttttttttttgagacagaat

SEQ ID NO: 409708 - DNA, 736 bp, Homo sapiens
gggaaacacagttattggttattacaaaggatattacaaaagatataaggaaaaggtcaaggagcttgcctgccttcttcaggaccaccacattccaggaacctctaagtgttcagctctctgaaggctctctgaaccctctccctttgggctttttatggagatttcattgcataggcatgattgattaagccacaggctattggctatcaacttaaattttaactccctcccctccccagaggttctgaagtagggctgaaagtcccaacgctctaatcccggccttggctttctggtgaccaacccccatcctgaagctggccagggactgccagccatcaatcaatcattagcatgcaaaaagacatactttggagactccaaggattttaggaattctatggcagaaaatggagatgaacaccaaatagaaggccgggcacagtggctcacgcttgtaatcccaacactttgggagaccaaggtgggtgatcacctgaggtcaggagtttgagaccagcctggccaacttagtgaaaccctgtctctactagaaacacaaaaaattagccaggcgtggtggcaggcgcctgtaatcccagctactcaggaggctgaggcaagagaatcacttgaacccaggaggcggaggttgcagtgagccgagatggcgccactgcattccagcctgggcaacaagaacgaaattccgtctcaaaaaaaaaacaaaaaa

SEQ ID NO: 409709 - DNA, 360 bp, Homo sapiens
tactactactaaattcgcggccgcgtcccaacgctctaatcccggccttggctttctggtgaccaacccccatcctgaagctggccagggactgccagccatcaatcaatcattagcatgcaaaaagacatactttggagactccaaggattttaggaattctatggcagaaaatggagatgaacaccaaatagaaggccgggcacagtggaggcgcctgtaatcccagctactcaggaggctgaggcaagagaatcacttgaacccaggaggcggaggttgcagtgagccgagatggcgccactgcattccagcctgggcaacaagaacgaaattccgtctcaaaaaaaaaacaaaaaa

SEQ ID NO: 409710 - DNA, 495 bp, Homo sapiens
tgagtctgttggaggacagggcttggagaggcaggctgccccagtgtgcacccagaaaggagggcaaaaggctgagcagctggactggggttggatgcagcagctatgcagctgatttggagagcctgacatgagaggacactgaggagtcgacaggttttggagaagattcccatctaatagttttaaaaaatattcttggtcgggcgcggtggctcctgcctgtaatcacagcacttcaagaggccaaggcaggtggatcacgaggtcaggagatcgagaccatcctgactaacatggtgaaatcctgtctctactaaaaatacaaaaaattagccgggcatggtggtacgcgcctgtagtcccagctacttcggaggctgaggccggagaatcgcttgaacctgggtggtagaggttgcagtgagctgagatcatgccactgcactccagcctgggcagcagagtgagactcgaggatccccaaaaaataaa

SEQ ID NO: 409711 - DNA, 355 bp, Homo sapiens
ttctctcggtgttaaactcattttaaacaaagtggaaagtaagggatttagtagggaaatcctttcaccttggcaaaacgatagtatacaactggcacagcataatccttggtggcttggcacaagcattccctgtcccccatcaagcacataatgtccctcagtaattccactgcatttttgtgcagcggctgtgtgctggagctgtggggaacccctcggtaatctcttgtctgctttttaggagcccctatctcctggtcttctcttacttcccaagctaccctgcttctttgaaaagtcttcaggcttgcctacctcttctcagcttgctctgcatgccttggggaagctg

SEQ ID NO: 409712 - DNA, 443 bp, Homo sapiens
gttacagcagccctaggaaactgatacagagatactgttcaaagttttcataccctgttcaactccatgcaattgacttgagtctttattttggaacagatggattcagaagaatctaaggtttgtccataaaaaattccccagaatagagaatggttaaaatgctgagattccaagcgcttctttataaagacacctcttctctgaaagttaatagggaatgttcacaggtttaaaagagaaatgttgctgggcaccatggctccctgtctctacaaataattttttaaaaattggctgggcatggtggcatgcccctgcagtcacagctactctggaggctgagttgggagaattgcctgagcctgggaggccaaggctgcagtaagctatgattacaccactgcactctagcctgggcgacagagcaagatccagtctca

SEQ ID NO: 409713 - DNA, 663 bp, Homo sapiens
gttttgccccgagctttgcaggcagaacaggcatggccctcgtggaacatttagcctggtttgattctgtccccagcctagccaagactcagcccatccttcaagagatgcctttgctgtttgtcaagctccctcctggctcagaccattttagtgtctgatctcttaactaaaacttgtagcctgtcgtgggttggcctgaactggtcaactaggctcttacatagtatggatcagccatcccaagtatttgagggtgttgtggagactctgcactgtgcccatcctggtcaagtgttgtaaaacccactgttctgtcgtctgtgggaacatttttttcagggcctctaccatcatcctaggcatctaaacttattccacatttcctgggggccttaggacagagtttagatttcacttcaagaaccctcaggaggctggggcggtttggatcaccttaggtcaggagttcgagaccaccctggcaaacatggcgaaaccccgtctctactaaaaatacagaaactagccaggcgtggtggtgcacggctgaggtaggagaatcacttgaacccaggaggcggagattgcagtgagccaagatcgcgtcactgcactccagcctgggcgacagaatgagactctgtctcaaaaacatgaaga

SEQ ID NO: 409714 - DNA, 442 bp, Homo sapiens
accaagtctcactctgtcacccagactggagtgcagtggtgcaatcttggctcactgcaacctctgcctcctgggttcaagtgattctcctgcctcagcctcccaagtagctgggactacaggtgcccgataccacaccacacctggctaattttcgtatttttagtagatatggggttttgccatgttggccaggctggtcttgaactcctgacctcatgtgatctgcccacctcagcctcccaaagtgctgggattacaggtatgagccaacatgcctggcctaagaaaaaattttaattaaaacttgccgctgcctacaaatctcacagcaccctgatgtcacatatatcagccgcaactccacctgctaacccagagctccagattcctgacatgaggtagtaggtgagactgttgaggcaggaatttgaagattggc

SEQ ID NO: 409715 - DNA, 999 bp, Homo sapiens
atttgtgacatctgtcttctaagctgcatctaatgcatttgatgttgcattctctgttcctttttaatagcagaggccttggggtaggggatgggagaacctgtctaagaaaacctttagctctttgttgtaggcctgaagactgttctttcccctctcaactttgaataaatactcctggggtctcattctcccaactctacatattgcctcaaaaattggcaagcccctggcagcccctcccagtgtctgcagaagagtagtgtataagggcttctgctcttgatggtgtatttccttgatttttcctctcaagctgcctactctacctgcatctccccatcttttaacagtgcctattaaatgatggcccatcaatattgttactgtaattcctaaactgattttcaaagcattcttatttttttctatcagagataaataaatcatttaggaagagattcatttgaacattcttgtttataagccaaagggtttccaaagaggaatagtttgaagattgacaaaaatggggataatttgtgagagtgaatgcctggagagtatcagggaacatctagaacatacaataagaggatacatggaagggcaacttttcctttgagacaggaagggaaagacatatggatgaaatgagtgaaattatacagagttgggatttcctcttgatggcttcttcttcaggtaaccacagagtctgagcactatcaaaaattcttcctgggccaggcatggactcctagtggattgcctgagctcaggagttcaagaccagcctgggtaacatggtgagaccccatctctactaaaaatacaaaaaaattagccaggcctggtggcatgtgcctgtaatcccatctacgtgggaggctgaggcacaagaaccacttgaacctgggcggcggaggctgcagtgaactgagatcgtgccactgcactctagcctgcgtgacagagcaagactctgtctccagaaaa

SEQ ID NO: 409716 - DNA, 461 bp, Homo sapiens
atttgtgacatctgtcttctaagctgcatctaatgcatttgatgttgcattctctgttcctttttaatagcagaggccttggggtaggggatgggagaacctgtctaagaaaacctttagctctttgttgtaggcctgaagactgttctttcccctctcaactttgaataaatactcctggggtctcattctcccaactctacatattgcctcaaaaattggcaagcccctggcagcccctcccagtgtctgcagaagagtagtgtataagggcttctgctcttgatggtgtatttccttgatttttcctctcaagctgcctactctacctgcatctccccatcttttaacagtgcctattaaatgatggcccatcaatattgttactgtaattcctaaactgattttcaaagcattcttatttttttctatcagagataaataaatcatttaggaagaga

SEQ ID NO: 409717 - DNA, 411 bp, Homo sapiens
atttatcttaacaggccatgtgattctagtgcaacagtcctcaaattgtggttcacagacccagaggtgctttcatggactctgtaaggtcaaaactactttataatactgaaatgttaagccaggcgcagtggctcacacctgtaatcccagcacttcgggaggccgaggcaggcagatcgccagaggtcaggagtttgagagcagcctggccaaccaacatgatgaaaccctgtctctactaaaaatacaaaaatgggccaggcgtggtggcgtgcacctgtagtcccagctgctcgggaagctgaggcaggagaattgcttgagcctgggaggcagaggttgcagtgagccgagattgccccactgcgctccagcctggctgacagagtgagactccttctcaaaaaa

SEQ ID NO: 409718 - DNA, 421 bp, Homo sapiens
gacactggtccctacataatggcttatgcctgaaaccccaacactttgggagactgaggcaggtggactgcttgaggtcaggagctcaagaccagcttgggcaacatggtgaaaccccatctctactaaaaatacaaaaattagccagacatggtggcatgcacctgtagtcccagctactcggagggtgaggcaggaggatcacttgaacctcggaggcagaggttgcagtgagccaagatcataccactgcactctggactaggtgacagagaccctgtctcaattaaaaaaaaaaaaaaaaaagatttggaactgtgtatgtgcagtggaagatgtaagggttgtttgttaaaccacaacaaaacctagcctgtccttactcataagatccttactcataagagaaggacagagagac

SEQ ID NO: 409719 - DNA, 915 bp, Homo sapiens
atcggaggaggggagaggagaggaaagtgggaggagaggctgcactctaaacagccctcttgcctgagcaatctgacgcagaggcacatgaggaatcagcacggaaccatcgacccacagggttaatcccaatgtcaatacctgctagatgtcagggatcccctgggctgctggcgagccatttgaaatgacccatctcctgccaccttggcctgctcctctgggccacctctctccacctgcacttgcttaccgctggagggctggggtctgccgtcacctgcctctcaagaaacctgtgcctccagcagccaccgggatccactgggactgtgaccctcctgccaagaagacccaggaaaagcctgctggccactgtcgatgagaggcaggctcccacctgcagggtgttcactttgtggctccttccaataagtcaagcaagatggaaacattcgagcgatgcaaggcagcgctacttggggaaagagacactggtatgccacatcagcgaggaccaccaggaaagacgattcctttccaaattccaagcctcaacaaaagcgaccacagcagtccagactcctgtctctaatccctacttccccatgtggacaaagagtggggctcttttggcctgagctcatggggtttcacatcagcccagcaggacagaatgcatccctcctgacagccaggcacaggctggggaccagagagacccagctggctccacagggcagggctgacacagagccaggggagggttgtggcggcccacactgcatgtctctacaaggtgaaggaactccttgtgttggctgctgagctgagaggtcacagctctgcctcacagcaccctggccaagttttccatgaaatcatccaaagccaacaggagttccgggaaccatc

SEQ ID NO: 409720 - DNA, 524 bp, Homo sapiens
atcggaggaggggagaggagaggaaagtgggaggagaggctgcactctaaacagccctcttgcctgagcaatctgacgcagaggcacatgaggaatcagcacggaaccatcgacccacagggttaatcccaatgtcaatacctgctagatgtcagggatcccctgggctgctggcgagccatttgaaatgacccatctcctgccaccttggcctgctcctctgggccacctctctccacctgcacttgcttaccggaagacggcaaggccaccggtgcacttcgcagtgccaggagaaaggcgcctcatgctattagctcaaataaggaaaatcatgccgggaagattgaattttctgcagacttgtttaacctggtgatttctgagcacttggcgctggcagccacgggggagtgggctgccagccggcactttatcagccacttctcaggactattcctaagcttattaaatcagcatgagtcactcccttgccttcctcacaagcatgaatcacgaatcat

SEQ ID NO: 409721 - DNA, 569 bp, Homo sapiens
ggcacccccagtttttccatcctcctcattcgtgtaggggcacccgaatcccctattccttatttcccctatcactcaggcactggcagggtccttttcccactcctgttggccgccgcggctccaaagcgagctgggcagatgtgcctgagacaggtttgaccaggcaactgaaaatatatccctaagagaagacaaaacaaagatatgaaaggaacacacttccctgactgactaggaggaacagagctgcctgctgactggaaccgcttcctcccagactaaggtttcccagaggaagagagagaatttggacaaatgaatgaggaacaacgctctcctgagggttttctttaaggggcaaggatcaaagcctctagatcctttgaaagcagagttaagaggcagtgcaggaaggcacagcaggaaggttcatggttagactacagagaaggaagcagccactgctggggacctaacctgtgctggtcactgacaagctgtctcattaaaccttcccggaccctcaacccctcctagtatcttatcctcattttacagatgagaag

SEQ ID NO: 409722 - DNA, 346 bp, Homo sapiens
ttgtatttttagtagagatgggctttcaccatgttggccaggcaggtctcgaactcctgacctcaagtgatccaccagcttcggccacccaaagtgctgggattacaggcatgacccaccgtgcccagcctcctttttcacttcccaccttcctccccacctctgggtgcacccttccctgagctcagcctgtattcctatgtgctggccacttaccagccagtcccttcagctgcaataccctttactcacctagaaagctcatatcaaaagtcgcctcctccagaatacctctcaagttctcctctctggtcccttggccctttgcaggtaccttttttcttgc

SEQ ID NO: 409723 - DNA, 352 bp, Homo sapiens
ctccagaagttcaagatcagcctgggcaacatggggaaacccccatctctacaaaaaattagaaaattagccaggcacagtggttcatgattgtactcccagctactcaagaggctgaggtcagagggtcccttgagcccaggaggtctacactgcagtgcatggtgatcatgccactgcactccagcctgggtgacagagtgagaccctgtctcaaaaataataataatgatgatgataaatttagagcaaatgcaaattaacatgtaataatacatcctctcttgtgaaaatgtattagttatttactattgcataacaaattatgtaaaatgtaccatttcaaaataac

SEQ ID NO: 409724 - DNA, 294 bp, Homo sapiens
tgtaaccagtacgacccgtacctccacaactactgaaattttaaaaagaagatctgttacctatatagaaagaaactgtaaattaagagactaataaaaatcttcttcacttttgtaactcacccacatattggtacaaccaatacattgctaagtcaagatagaaatgataaggttcctttgcttttaggtcttagcctagatatctttaaaatataagcattatcatattaaaagtacattaattattgtggacacttttttcattcctttttttttttttctattcagtca

SEQ ID NO: 409725 - DNA, 359 bp, Homo sapiens
tgcccactttctaattggagtgtttgcttctttactgtggtgttttaaaagctctttataggttttatttttattttattttatttttgatatgtgtttcgctcttgttggcaaggctggagtgcaatggcctggtctcaacttactgcagcctctgcctcccaggttcaagcgattctcctctctcagcctcccaggtagctgggattacagatgcccaccaccatgcctggctaatttttgtatttttagtagagatggggtttcaccatgttagtcagactggtctcaaactcctgacctcaggcagtctgcccatcttggcctcccaaagtgctgggattacaggtgtgagccac

SEQ ID NO: 409726 - DNA, 502 bp, Homo sapiens
ttttttttttttttgaggctgggtctggctcttgttgcccaggctggagtgcagtggcatgatctcagctcactgtaacttccacctcctgggcttaagccatcctcctacctcaacctctccagtagctggcactacaagtgtgccaccatgcccggctaatttttgtattttttgtagagacagggttttgctatgtcgcccaggctggtcttgaactcctgagctcaagtgatccgctggcctcagccacccaaatgctgggattatggggatgagccgctgtaacgggccccttttttcactataacgtttctctctatgtgtatatatatatatttttggagatggagtcttgctcttgtcgcccaggctgctcttgtcgcccaggctggagtacaatagcatgatctcggttcactgcaacctccacctcccggattcaagcgattctcctgcctcagcctcccgagtagctgggatgtcgacgcgcccgcaacca

SEQ ID NO: 409727 - DNA, 1063 bp, Homo sapiens
  misc_feature (600)..(600): n is a, c, g, or t
  misc_feature (602)..(602): n is a, c, g, or t
  misc_feature (604)..(604): n is a, c, g, or t
  misc_feature (606)..(607): n is a, c, g, or t
cttttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaaaaacaaaaacaaaaaanananannaacaaacaaaacccgggggccctacatcgccgggggcgcggagcacaaagcggtcacagcacatggcgccacactggcccaaacacgggagcaccagaacccacatcttcttgtgcacacgcggggcacaccaccgaggcaccacataagacacagccacaacaaatccagaaaacccggtaaaccggaatagaaagccgcgagcacaaccccgcacgagcgagcaccacgcacgagagacaagcacaacaggcggccaaaaaacatataaaaaaacaagcaaaaaaaaaaaaacaaccacaatacaacaaaaacaacaaacacaacagaaaacaaacccataaataataatcacaaaccatcaaaacacaacacaacaaacacacaacagaagaaaaacccaacaagccaccaatcacaacacgcccagagccacacagataaccaccaacatac

SEQ ID NO: 409728 - DNA, 305 bp, Homo sapiens
ttttttttcaaacaagcaattggaccatgcagcatagaacttctgaaatgtctctatccaggaggataagttagatgatcaggactgaatttggctcttttcatttcctggcacgttagctcattatggtagctagaatgcttcgtgatatgttaggcatctattctgtactaccaggcgttctagattgcagagctccacgtgaggcccattaataaccttattgtccatctctttaaataatcagtgtgtgtgtaggaggcaggggcatggttggaggtaagggagtggagaggtgttgcagt

SEQ ID NO: 409729 - DNA, 375 bp, Homo sapiens
tcagcgtcgcatctataaccctttctgtctctgactcctttctctctgtctatgagcaatttaaaagcgatttattctaatccacattggaaatggggaactggagcagccgagaagcagatgtctgcagcatgaatgggattcacacacttcttggactccttactggcaagagaagcagggctgacctcctcaagagagttagagacatagagagatgattgatgcttgatcagcttctgactcattatttttctttacaagccatctttgaatctctgcaccaatcttaggaaaccctctgctcagcagaattttgtccaggcatgccattaggggtgcaggcgtcattagtagcctcttgcttcagggaac

SEQ ID NO: 409730 - DNA, 512 bp, Homo sapiens
ctcgtgcctcagcctcctgagtagctgggactataggtgaatgatactattttatttaacaaacactcatattgtacctacagcgaggcaagcactggtctaagcactttgcaagtattaaactttaatctgcctgatcaccctattactattattaacattcctgttttaccaaagaggaaactaaagctcagagagggtaagtgacttgccaaggaagggtagaaacagcattggcatctactccagggtctaggcattagggctccatgcgtctaaacacgggtgtctcctggaccatagcagagcttgcttaactgtcaggcccctttagggtctgtaaacacacacactgcccccacagaggtacacacaccatgttatgttgtcatttttggaactctatccccattgactgatggcatttgctgcagtggaggaagaatttgtcatccctgtccttctagaattcaaagtgggtgcggactaatccctgttacatggtaaacagg

SEQ ID NO: 409731 - DNA, 690 bp, Homo sapiens
gctgtgtccagtttgggaggtctacgttttcctgaatttctacacccttcccctagataggcgtacacttttaaaaaatttgcttcattgcatctgtgactcatgtatttatttactaccaacaacttttagaaaatatttaattgccccttctttcctttcagagaggctgtgtttttatacgtgtgattaaaaagtataaggaatctgaaaagcacttgtcagtccacctgtgggactgtgccaagtccctgttgccttgtccaggagatgggacgggaaatgcacggcaatatgtctgcttagaacatcccacccaggacagtttaaaatagaagaagccctgggaggatgcaggtccaggtgtggattgactgaataaacatgctatagaaaggagttaggatttttaagatgcctgttaacagtgttccattgcttgacagtagaatagttaagccagattttgctcctcttggtgagatgggaagagggcatagatgtttatatatccatcatgggtttatccagtaacgttggagtagggcgggaaatactcagcagatattcattacggcatagcagttctgtattcactcgctacaggaaataaagccatagccgagtctgcatattctagccgctgttgggagtgatgaacgacagtaccggtggactttcagccctcct

SEQ ID NO: 409732 - DNA, 651 bp, Homo sapiens
aaggccagagactcactcagaggaaagggtaaaacagggtctcctgactggaagaaaacaggcacagatgcgattgataaaactgtgctgaaatggggaataaagtttactagctaaatgttgtggtccctcaggttttctcttgaaatcagccctcaaactggcagccagtttatacacttcatggaggaaagtggaagatggaaaaaggaagaaaggcagaaaggcagacacagcaaagcttcctcagtgaacggccagcctagagtaaatggaggccgagtcagcacaccagccacgtgcccagagcttcaaatggttttagtgcctcgctcttaagtatgaataagaattaacacttttaaggaaatattctaaaaataaagacaggaaaccccaaaaatgaagaaaaaaaaaacttggaaacacaaaagatgatgcttgaagaagaaacttaaaaaaaaaattctttcactaataatagctcttaagttaaaaagatggtagcgaaaatgaaaaccaaaacttaacagaagggtggaaacctgaggtgaggtttcctcccagaagataaagcaaaaaagatggaaaataaaaaatataattaaaaagtcaggccgggcgcagtggctcacgcctgtaatcccagca

SEQ ID NO: 409733 - DNA, 440 bp, Homo sapiens
taaagacctaaggcttaattgaggcaaaatactcagtgtaaaggaaaagatttgttaaatggactatatataaaaccaagaacttctgttcatcagaagatagcatttagggcaagatactgagctggggaagatatttgcaatacatgtgtgaatcaaaggactcaaatctaggatgtataaagaactagaaatcatttaaagaaacagacaaacaaaaatgggcgaaagactggaacacttcctacacaaaaaaggctatccaaaagataaattcatgaaaggcacctattttgttagtcatcagggaaatgtaaattatagccataatgtggtaccactacacatctaccaaaatagctaacatggaatggcaagaatatacaccagttggaactttctgacacagttgatggggactttggaacgtaacactttgg

SEQ ID NO: 409734 - DNA, 1261 bp, Homo sapiens
ttgctttgctgttagcctgttggaccttcgagcctagctgctcgcacaggactcggccacctgcccttcctgcaccgactggccagctcaagaggtttggatatggaccttcttcaattcctggccttcctctttgtcctgcttttgtctgggatgggagccacaggcaccttgaggacctccctggacccaagcctggagatctacaagaagatgtttgaggtgaagcggcgggagcagctgttggcactgaagaacctggcacagctgaacgacatccaccagcagtacaagatccttgatgtcatgctcaaggggctctttaaggtgctggaggactcccggacagtgctcaccgctgctgatgtgctcccagatgggcccttcccccaggacgagaagctgaaggatgctttctcccacgtggtggagaacacggccttcttcggcgatgtggtgctgcgcttcccgaggattgtgcactattactttgaccacaactccaactggaacctcctcatccgctggggtatcagtttctgcaaccagacaggcgtcttcaaccaggggccccactcgcccatcctcagcctgatggcccaggagctggggatcagtgagaaagactccaacttccagaacccatttaaaatcgaccgcacagagttcattcccagcactgaccctttccagaaggccctgagagaagaagagaaacgccgaaagaaagaggagaagcggaaggagatccgaaaaggcccaaggatctccagatcccagtctgagttatagccctggagcagctcagggctcagggggccacaaggaggcaggtcgggaggaagaagaggtggaggtgtggttgtggtggagagcaccagctagccccttccagaaggggaggccacatttgcccggccccctggagctgggtctgagccccagctgaagggactgagcctcagatggctggattttctctcaggggcctcctgctgaaggggccttcagaggattttatgctggaaatatgaccctgtgcagactgctgggggaggcaggaggatgcctgcctggaccctgttggtggctgaagacctctggccagctggcttccgcccttggtggggaagcagcagaactaggttctgagccacgggtcagggtgccaccctgctgctggccccactgtgtcacagagctgcctggcacaggtcccagcccctctgcagagacacaataaaagccagcagaccctttg

SEQ ID NO: 409735 - DNA, 1389 bp, Homo sapiens
ttgctttgctgttagcctgttggaccttcgagcctagctgctcgcacaggactcggccacctgcccttcctgcaccgactggccagctcaagaggtttggatatggaccttcttcaattcctggccttcctctttgtcctgcttttgtctgggatgggagccacaggcaccttgaggacctccctggacccaagcctggagatctacaagaagatgtttgaggtgaagcggcgggagcagctgttggcactgaagaacctggcacagctgaacgacatccaccagcagtacaagatccttgatgtcatgctcaaggggctctttaaggtgctggaggactcccggacagtgctcaccgctgctgatgtgctcccagatgggcccttcccccaggacgagaagctgaaggatgctttctcccacgtggtggagaacacggccttcttcggcgatgtggtgctgcgcttcccgaggattgtgcactattactttgaccacaactccaactggaacctcctcatccgctggggtatcagtttctgcaaccagacaggcgtcttcaaccaggggccccactcgcccatcctcagcctgatggcccaggagctggggatcagtgagaaagactccaacttccagaacccatttaaaatcgaccgcacagagttcattcccagcactgaccctttccagaaggccctgagagaagaagagaaacgccgaaagaaagaggagaagcggaaggagatccgaaaaggcccaaggatctccagatcccagtctgagttatagccctggagcagctcagggctcagggggccacaaggaggcaggtcgggaggaagaagaggtggaggtgtggttgtggtggagagcaccagctagccccttccagaaggggaggccacatttgcccggccccctggagctgggtctgagccccagctgaagggactgagcctcagatggctggattttctctcaggggcctcctgctgaaggggccttcagaggattttatgctggaaatatgaccctgtgcagactgctgggggaggcaggaggatgcctgcctggaccctgttggtggctgaagacctctggccagctggcttccgcccttggtggggaagcagcagaactaggttctgagccacgggtcagggtgccaccctgctgctggccccactgtgtcacagagctgcctggcacaggtcccagcccctctgcagagacacaataaaagccagcagaccctttggaccgaccaaggctggtggggacactgtgaggggaccagggcccctcagggatgtagaaacagcttggaggatgcctctgccccaccaggaggggccccaggccctggcagggcagagaaggaagggg

SEQ ID NO: 409736 - DNA, 1339 bp, Homo sapiens
ttgctttgctgttagcctgttggaccttcgagcctagctgctcgcacaggactcggccacctgcccttcctgcaccgactggccaggagttcagagcctcatgctgagccaggaggagctccgggtgacgcatacggcaggatcgggattgagaggctgaaaaactcaagaggtttggatatggaccttcttcaattcctggccttcctctttgtcctgcttttgtctgggatgggagccacaggcaccttgaggacctccctggacccaagcctggagatctacaagaagatgtttgaggtgaagcggcgggagcagctgttggcactgaagaacctggcacagctgaacgacatccaccagcagtacaagatccttgatgtcatgctcaaggggctctttaaggtgctggaggactcccggacagtgctcaccgctgctgatgtgctcccagatgggcccttcccccaggacgagaagctgaaggatgctttctcccacgtggtggagaacacggccttcttcggcgatgtggtgctgcgcttcccgaggattgtgcactattactttgaccacaactccaactggaacctcctcatccgctggggtatcagtttctgcaaccagacaggcgtcttcaaccaggggccccactcgcccatcctcagcctgatggcccaggagctggggatcagtgagaaagactccaacttccagaacccatttaaaatcgaccgcacagagttcattcccagcactgaccctttccagaaggccctgagagaagaagagaaacgccgaaagaaagaggagaagcggaaggagatccgaaaaggcccaaggatctccagatcccagtctgagttatagccctggagcagctcagggctcagggggccacaaggaggcaggtcgggaggaagaagaggtggaggtgtggttgtggtggagagcaccagctagccccttccagaaggggaggccacatttgcccggccccctggagctgggtctgagccccagctgaagggactgagcctcagatggctggattttctctcaggggcctcctgctgaaggggccttcagaggattttatgctggaaatatgaccctgtgcagactgctgggggaggcaggaggatgcctgcctggaccctgttggtggctgaagacctctggccagctggcttccgcccttggtggggaagcagcagaactaggttctgagccacgggtcagggtgccaccctgctgctggccccactgtgtcacagagctgcctggcacaggtcccagcccctctgcagagacacaataaaagccagcagaccctttg

SEQ ID NO: 409737 - DNA, 485 bp, Homo sapiens
gggtcagggagaaacactgtgtgatggtttttgagccaggccttgaaaggaaagaaactcctagaggagggtgaggggcatcctgggcagagagggtgcagcgcgagcagagaggtggaggctctggaacagtagaatgcttgtggagacggcaggaagaccacagcaaagggaaggcaggagccaggtctggaggcttggtttcaggcttctgggtgtggagcgccatgggaactggatgaatagtgcgttgcaggtccatgcacttgtcagtttgttcatttcctggaggcttctagccctgggtgtccatggcccttgcagatacttgctggtcaggaatgagccttctgaggcaagactgctggattgtccaggcagggctattgatgccagccccttaacttaattctgcccagacaagaagatgtttgaggtgaagcggcgggagcagctgttggcactgaagaacctggcacagctga

SEQ ID NO: 409738 - DNA, 432 bp, Homo sapiens
gtgatatctcattagaacagcggcttaatttcaatattgaagctgctctccaaacaatgaagaaaagcagaaatctctacattttctatttctcaaccactcccagtgctcatttataggaattacccctaaattttcccagttaacctttcagggaaacacaaacccacagccacagaaaactttcgtctctctacacttatactctcttacttatactcactgcctctacacagtcatattcactctctacacactcctctcttttcccaagaaagagctctgttacaggcagaggagaaaatggagtgccctaggatacacaatggggccactgtactaaaaggtggagcttttagtagaagtagaggtattataaatagaactgaagaggggaagcttttctccctccaatctctatgatctttattc

SEQ ID NO: 409739 - DNA, 490 bp, Homo sapiens
ccaggtgggaccagccgtgggggcagaggcactgggccgactgtgatggggtgtcagagatgggacagggacagtgggcaggagtgtgggtgcatgggcacgtcggcagggtcccctcaccttccccctggagccctttctccctgagatcccctccctccagggcctccccctgccacacgctggagagggctgaggcctgtgggtgtgtgtccacagtcttctggaagtactactatgggcattacttggacgactatcacacaaaaaggacttcatcccttgtcagcctgtcaggcctcggcgccagcctcaacgccagcctccacactgccctcaacgccacttctgcccagggtgggtgggactgagcaggatggattttcttttgataaaagagtcgatgcctgaaagagaaaccatttccttgattgtgtaaggaacttgctggacgcacattagagaataaagctcctgtttctaggctcct

SEQ ID NO: 409740 - DNA, 3093 bp, Homo sapiens
ctttctccctagggtggcgtgggttgcatccctcggaagagcgaaggaatgagccaggtcggggggcggggagacaggtgcacacaggaggtccagggcttggtccatggggctggtgacctttctgcttcccttgcagaaaactctcccaccatgtcgcagaatggatacttcgaggattcaagctactacaagtgtgacacagatgacaccttcgaagcccgagaggagatcctgggggatgaggccttcgacactgccaactcctccatcgtgtctggcgagagtatccgtttttttgtcaatgtcaaccttgagatgcaggccaccaacactgagaatgaagcgacttccggtggctgtgtgctcctgcacacctcccgaaagtacctgaagttaaagaacttcaaggaagagatccgtgcgcaccgcgacctagatggcttcctggcgcaggccagcatcgtcctgaacgagacggccacctccctggataacgtgctgcggaccatgcttcgccgcttcgccagggaccctgacaacaatgagcccaactgcaacctggacctgctcatggccatgctcttcaccgatgccggggcacccatgcggggtaaagtccacctgctgtcagataccatccaaggggtcaccgccacagtgacaggggtgcggtaccagcagtcgtggctctgcatcatctgtaccatgaaggccctacagaagcggcacgtgtgcatcagccgcctggttcgcccacagaactggggggagaattcctgtgaggttcggttcgtcatcctggtgctggccccacccaagatgaaaagcactaagactgcgatggaggtggcgcgcacgtttgccaccatgttctcggatatcgccttccgccagaagctcctggagacccgcacagaggaggaattcaaggaggccttggtgcatcagagacagctgctcaccatggtgagccacggtccagtggcgccgagaacgaaggaacgcagcacagtctccctccctgcccacagacacccagagcccccaaagtgcaaggactttgtcccttttgggaagggcatccgggaggacatcgcacgcaggttccccttgtaccccttggacttcactgatggcattattgggaaaaacaaggctgtgggcaaatacatcaccaccaccctgttcctctacttcgcctgcctcctgcccaccatcgctttcgggtctctcaatgacgagaacacagacggggccatcgacgtgcagaagaccatagccgggcagagcatcgggggcctgctctacgcgctcttctctgggcagccattggtgattctgctgaccaccgcgcccctggcgctctacatccaggtgattcgtgtcatctgtgatgactatgacctggacttcaactccttctacgcatggacgggcctgtggaatagtttcttccttgcgctttatgcctttttcaacctcagcctggtcatgagtctcttcaagaggtcgacggaggagatcatcgccctcttcatttccatcacgtttgtgctggatgccgtcaagggcacggttaaaatcttctggaagtactactatgggcattacttggacgactatcacacaaaaaggacttcatcccttgtcagcctgtcaggcctcggcgccagcctcaacgccagcctccacactgccctcaacgccagcttcctcgccagccccacggagctgccctcggccacacactcaggccaggcgaccgccgtgctcagcctcctcatcatgctgggcacgctctggctgggctacaccctctaccaattcaagaagagcccctacctgcacccctgcgtgcgagagatcctgtccgactgcgccctgcccatcgcggtgctcgccttctccctcatcagctcccatggcttccgggaaatcgagatgagcaagttccgctacaaccccagcgagagcccctttgcgatggcgcagatccagtcgctgtccctgagggccgtcagcggtgccatgggcctcggcttcctgctgtccatgctcttcttcatcgagcagaacttggtggccgccttggtgaatgcaccggagaacaggctggtgaagggcactgcctaccactgggacctcctgctcctcgccatcatcaacacagggctgtctctgtttgggctgccttggatccatgccgcctacccccactccccgctgcacgtgcgagccctggccttagtggaggagcgtgtggagaacggacacatctatgacacgattgtgaacgtgaaggagacgcggctgacctcgctgggcgccagcgtcctggtgggcctgtccctgttgctgctgccggtcccgcttcagtggatccccaagcccgtgctctatggcctcttcctctacatcgcgctcacctccctcgatggcaaccagctcgtccagcgcgtggccctgctgctcaaggagcagactgcgtaccccccgacacactacatccggagggtgccccagaggaagatccactacttcacgggcctgcaggtgcttcagctgctgctgctgtgtgccttcggcatgagctccctgccctacatgaagatgatctttcccctcatcatgatcgccatgatccccatccgctatatcctgctgccccgaatcattgaagccaagtacttggatgtcatggacgctgagcacaggccttgactggcagaccctgcccacgccccattcgccagccctccacgtcctcccaggctggctctggagctgtgaggggaggtgtaggtgtgtgggtgactgctctgtgctgcgccttctcatggctgactcaggcctggggcatctgggcattgtaggggtgcagtggtatgtgcccacccctctcccattatcctttagctttaggccaagagcgttgctcagggcagcttctgcccagggtgggtgggactgagcaggatggattttcttttgataaaagagtcgatgcctgaaagagaaaccatttccttgattgtgtaaggaacttgctggacgcacattagagaataaagctcctgtttctaggctcct

SEQ ID NO: 409741 - DNA, 602 bp, Homo sapiens
gtcgccgagtttggggtccagaagcgccggagcgccgcgtgaggagcccggccgtgagtgcgcgagtgtgccatggccgcggccaccaggcgcgtgttccatctgcagccgtgcggtgggtgcctgaacccgggggcgcggcgggaaggccgcccgggtctccgccaccgtctcccgtcggggaccccggggagaacgcggatgccgtctgcctgcgcgggccggggccggtgggcgagagggctgcgggattcccagccgcggggaggagggcgcgggtgcgggaggcccgggcgcggcttcgcggccaccgcgcgcttggtttcattagggctctgctgtcgccgtcttgaatttcttaccaggtttgaacagctgatgcagcgggtcgagggcggggagctcgaaagtgggcagggcggagctgtggggctcccagcgccccgagcgccgagcttttgggagcctggcgggccgccgcctcggaaggtctcattttaccttccgcccgggcatcttcccgtccggcgccgcggtgggagccccggaacccctggagttttgggagtcccgggacccctgaccgtgccctgcgcggccgc

SEQ ID NO: 409742 - DNA, 3479 bp, Homo sapiens
gtcgccgagtttggggtccagaagcgccggagcgccgcgtgaggagcccggccgtgagtgcgcgagtgtgccatggccgcggccaccaggcgcgtgttccatctgcagccgtgcgaaaactctcccaccatgtcgcagaatggatacttcgaggattcaagctactacaagtgtgacacagatgacaccttcgaagcccgagaggagatcctgggggatgaggccttcgacactgccaactcctccatcgtgtctggcgagagtatccgtttttttgtcaatgtcaaccttgagatgcaggccaccaacactgagaatgaagcgacttccggtggctgtgtgctcctgcacacctcccgaaagtacctgaagttaaagaacttcaaggaagagatccgtgcgcaccgcgacctagatggcttcctggcgcaggccagcatcgtcctgaacgagacggccacctccctggataacgtgctgcggaccatgcttcgccgcttcgccagggaccctgacaacaatgagcccaactgcaacctggacctgctcatggccatgctcttcaccgatgccggggcacccatgcggggtaaagtccacctgctgtcagataccatccaaggggtcaccgccacagtgacaggggtgcggtaccagcagtcgtggctctgcatcatctgtaccatgaaggccctacagaagcggcacgtgtgcatcagccgcctggttcgcccacagaactggggggagaattcctgtgaggttcggttcgtcatcctggtgctggccccacccaagatgaaaagcactaagactgcgatggaggtggcgcgcacgtttgccaccatgttctcggatatcgccttccgccagaagctcctggagacccgcacagaggaggaattcaaggaggccttggtgcatcagagacagctgctcaccatggtgagccacggtccagtggcgccgagaacgaaggaacgcagcacagtctccctccctgcccacagacacccagagcccccaaagtgcaaggactttgtcccttttgggaagggcatccgggaggacatcgcacgcaggttccccttgtaccccttggacttcactgatggcattattgggaaaaacaaggctgtgggcaaatacatcaccaccaccctgttcctctacttcgcctgcctcctgcccaccatcgctttcgggtctctcaatgacgagaacacagacggggccatcgacgtgcagaagaccatagccgggcagagcatcgggggcctgctctacgcgctcttctctgggcagccattggtgattctgctgaccaccgcgcccctggcgctctacatccaggtgattcgtgtcatctgtgatgactatgacctggacttcaactccttctacgcatggacgggcctgtggaatagtttcttccttgcgctttatgcctttttcaacctcagcctggtcatgagtctcttcaagaggtcgacggaggagatcatcgccctcttcatttccatcacgtttgtgctggatgccgtcaagggcacggttaaaatcttctggaagtactactatgggcattacttggacgactatcacacaaaaaggacttcatcccttgtcagcctgtcaggcctcggcgccagcctcaacgccagcctccacactgccctcaacgccagcttcctcgccagccccacggagctgccctcggccacacactcaggccaggcgaccgccgtgctcagcctcctcatcatgctgggcacgctctggctgggctacaccctctaccaattcaagaagagcccctacctgcacccctgcgtgcgagagatcctgtccgactgcgccctgcccatcgcggtgctcgccttctccctcatcagctcccatggcttccgggaaatcgagatgagcaagttccgctacaaccccagcgagagcccctttgcgatggcgcagatccagtcgctgtccctgagggccgtcagcggtgccatgggcctcggcttcctgctgtccatgctcttcttcatcgagcagaacttggtggccgccttggtgaatgcaccggagaacaggctggtgaagggcactgcctaccactgggacctcctgctcctcgccatcatcaacacagggctgtctctgtttgggctgccttggatccatgccgcctacccccactccccgctgcacgtgcgagccctggccttagtggaggagcgtgtggagaacggacacatctatgacacgattgtgaacgtgaaggagacgcggctgacctcgctgggcgccagcgtcctggtgggcctgtccctgttgctgctgccggtcccgcttcagtggatccccaagcccgtgctctatggcctcttcctctacatcgcgctcacctccctcgatggcaaccagctcgtccagcgcgtggccctgctgctcaaggagcagactgcgtaccccccgacacactacatccggagggtgccccagaggaagatccactacttcacgggcctgcaggtgcttcagctgctgctgctgtgtgccttcggcatgagctccctgccctacatgaagatgatctttcccctcatcatgatcgccatgatccccatccgctatatcctgctgccccgaatcattgaagccaagtacttggatgtcatggacgctgagcacaggccttgactggcagaccctgcccacgccccattcgccagccctccacgtcctcccaggctggctctggagctgtgaggggaggtgtaggtgtgtgggtgactgctctgtgctgcgccttctcatggctgactcaggcctggggcatctgggcattgtaggggtgcagtggtatgtgcccacccctctcccattatcctttagctttaggccaagagcgttgctcagggcagcttctgcccagggtgggtgggactgagcaggatggattttcttttgataaaagagtcgatgcctgaaagagaaaccatttccttgattgtgtaaggaacttgctggacgcacattagagaataaagctcctgtttctaggctcctatgtgccacctgtgtccctgctactgccactccacccccactctggggaggggaagccctccctggggaagtggaatgcaagggacagagtttgtggagtgccacctgtggtctgtcacctccaacgtcgcacagtgggtgctggcccaacagtgaaacatggaagatccaggaggccttcgcatggccatttctccagggacctgcagggaaagcgttctgggaacagcatgtgcaagggtccagaggagcgagggcttggggccactgaggcgctgtggctggtgaagagcagtggggcgggagggaccatcagggtgacagcaaagggccctgtgactctcagatgaaagctgcctgccgggaggccgaggcttcgtgtggagcacttgtgaaccatcccatctgtt

SEQ ID NO: 409743 - DNA, 3638 bp, Homo sapiens
cttccaggcggccgggacgcggtcccaggactggagaccgttgcctgtcggcccccgtgtgacccggggcgcgtgacgggggtcgggggaactgcgcctgcaatgggcgtttatggcccccaggaccggtctgagagtgagaagagggatgtgcagagagatcccccgccttggcatccgaggagagagggggagaggcccgctcgggcccggtcccttcctctcgctgcagcggggcagggttttctcaggaaaacctggattagcgaacatgaaaactctcccaccatgtcgcagaatggatacttcgaggattcaagctactacaagtgtgacacagatgacaccttcgaagcccgagaggagatcctgggggatgaggccttcgacactgccaactcctccatcgtgtctggcgagagtatccgtttttttgtcaatgtcaaccttgagatgcaggccaccaacactgagaatgaagcgacttccggtggctgtgtgctcctgcacacctcccgaaagtacctgaagttaaagaacttcaaggaagagatccgtgcgcaccgcgacctagatggcttcctggcgcaggccagcatcgtcctgaacgagacggccacctccctggataacgtgctgcggaccatgcttcgccgcttcgccagggaccctgacaacaatgagcccaactgcaacctggacctgctcatggccatgctcttcaccgatgccggggcacccatgcggggtaaagtccacctgctgtcagataccatccaaggggtcaccgccacagtgacaggggtgcggtaccagcagtcgtggctctgcatcatctgtaccatgaaggccctacagaagcggcacgtgtgcatcagccgcctggttcgcccacagaactggggggagaattcctgtgaggttcggttcgtcatcctggtgctggccccacccaagatgaaaagcactaagactgcgatggaggtggcgcgcacgtttgccaccatgttctcggatatcgccttccgccagaagctcctggagacccgcacagaggaggaattcaaggaggccttggtgcatcagagacagctgctcaccatggtgagccacggtccagtggcgccgagaacgaaggaacgcagcacagtctccctccctgcccacagacacccagagcccccaaagtgcaaggactttgtcccttttgggaagggcatccgggaggacatcgcacgcaggttccccttgtaccccttggacttcactgatggcattattgggaaaaacaaggctgtgggcaaatacatcaccaccaccctgttcctctacttcgcctgcctcctgcccaccatcgctttcgggtctctcaatgacgagaacacagacggggccatcgacgtgcagaagaccatagccgggcagagcatcgggggcctgctctacgcgctcttctctgggcagccattggtgattctgctgaccaccgcgcccctggcgctctacatccaggtgattcgtgtcatctgtgatgactatgacctggacttcaactccttctacgcatggacgggcctgtggaatagtttcttccttgcgctttatgcctttttcaacctcagcctggtcatgagtctcttcaagaggtcgacggaggagatcatcgccctcttcatttccatcacgtttgtgctggatgccgtcaagggcacggttaaaatcttctggaagtactactatgggcattacttggacgactatcacacaaaaaggacttcatcccttgtcagcctgtcaggcctcggcgccagcctcaacgccagcctccacactgccctcaacgccagcttcctcgccagccccacggagctgccctcggccacacactcaggccaggcgaccgccgtgctcagcctcctcatcatgctgggcacgctctggctgggctacaccctctaccaattcaagaagagcccctacctgcacccctgcgtgcgagagatcctgtccgactgcgccctgcccatcgcggtgctcgccttctccctcatcagctcccatggcttccgggaaatcgagatgagcaagttccgctacaaccccagcgagagcccctttgcgatggcgcagatccagtcgctgtccctgagggccgtcagcggtgccatgggcctcggcttcctgctgtccatgctcttcttcatcgagcagaacttggtggccgccttggtgaatgcaccggagaacaggctggtgaagggcactgcctaccactgggacctcctgctcctcgccatcatcaacacagggctgtctctgtttgggctgccttggatccatgccgcctacccccactccccgctgcacgtgcgagccctggccttagtggaggagcgtgtggagaacggacacatctatgacacgattgtgaacgtgaaggagacgcggctgacctcgctgggcgccagcgtcctggtgggcctgtccctgttgctgctgccggtcccgcttcagtggatccccaagcccgtgctctatggcctcttcctctacatcgcgctcacctccctcgatggcaaccagctcgtccagcgcgtggccctgctgctcaaggagcagactgcgtaccccccgacacactacatccggagggtgccccagaggaagatccactacttcacgggcctgcaggtgcttcagctgctgctgctgtgtgccttcggcatgagctccctgccctacatgaagatgatctttcccctcatcatgatcgccatgatccccatccgctatatcctgctgccccgaatcattgaagccaagtacttggatgtcatggacgctgagcacaggccttgactggcagaccctgcccacgccccattcgccagccctccacgtcctcccaggctggctctggagctgtgaggggaggtgtaggtgtgtgggtgactgctctgtgctgcgccttctcatggctgactcaggcctggggcatctgggcattgtaggggtgcagtggtatgtgcccacccctctcccattatcctttagctttaggccaagagcgttgctcagggcagcttctgcccagggtgggtgggactgagcaggatggattttcttttgataaaagagtcgatgcctgaaagagaaaccatttccttgattgtgtaaggaacttgctggacgcacattagagaataaagctcctgtttctaggctcctatgtgccacctgtgtccctgctactgccactccacccccactctggggaggggaagccctccctggggaagtggaatgcaagggacagagtttgtggagtgccacctgtggtctgtcacctccaacgtcgcacagtgggtgctggcccaacagtgaaacatggaagatccaggaggccttcgcatggccatttctccagggacctgcagggaaagcgttctgggaacagcatgtgcaagggtccagaggagcgagggcttggggccactgaggcgctgtggctggtgaagagcagtggggcgggagggaccatcagggtgacagcaaagggccctgtgactctcagatgaaagctgcctgccgggaggccgaggcttcgtgtggagcacttgtgaaccatcccatctgtt

SEQ ID NO: 409744 - DNA, 194 bp, Homo sapiens
taacgggaacatatacaggtctcatttctaaggaacctgggccaggctgctgatcagtacttcagttttggggtgtttctcaaatgtttctttatcaatactgattgctaacttatctcccctcattctctggttactcctgttgttcttgagcaaggaccgtgtcattctgaataaaacctgttatttttagt

SEQ ID NO: 409745 - DNA, 398 bp, Homo sapiens
tttatctatggactgtggcacatgctgtcagagtcggtctttgacatagcacctaggaaagaagctgaatcagattaaacatactacccaaacattaggtcaattgaaaatggctagggaaaggggaagattcatcgtaaaaactaattgagtaaagctagggaggcccaataagttcaaagatttgaattcaaggtagaaagaagaagaaaaccctctagcagaaggcggccttaatggcccatagccttagatctggcatcatttagaaccacatggctggacatgtggctcaagcctgtaatcccaatactttgggaggctgaggtggacagatcacttgaggtcaggagtttgagaccagcctgaccaacatggtgaaaccctgtttctactgg

SEQ ID NO: 409746 - DNA, 773 bp, Homo sapiens
tggagtcttgctctgtactccagcctggacaacagagtgagaccctgtctcaaaaaaaaattaaatgttttgattatacaaggaaaatgaacattcatgtattaaagcttcatgttttatgaacaaaactgactttgcaggcaggagagcgttttctgggggcaccagaagcagggaacttcccttgtccgttggcttcagggctgcccactatccctccactatcttcccattgtagccctgtctggtgtcttttgtccctgacaaaacctacaaaaagtgactttaacacttcaggctgcatgcatttgaagagcaataagataacgttttttcgcttcccactaccagtggagatctgctggggtgggctgcatggaatctgaaatgatgtctaaatactgaagtgaacctctacactagagactgatatacagctgacccttaaacgacgcaggggtcagggataccgacccctgcggaattgaaaatgcttgtattacttttgactcccctaggtcttaactactaatagccaactgttgcccggaagccttatgaagttgcccggaagccttatgaattacataaactcccagtcgattaacacattttgtatgatatatgcatgatatatgcataatatatatgatatatgcattttgtatgatatatgcattatatatattttagtataagaactatacttgtactaaaacagaccagagaaagggtatcaggaaaattgtaagaggctcgttgacattacaccc

SEQ ID NO: 409747 - DNA, 426 bp, Homo sapiens
gtctagcgctagaggggaaagaggggccctcggaacacacaagatacaggccggttcaccaaggtaggagaaagaactggaagaggttaatagctcactaataacgaagagcatgccatttgtccttggtgcactcacaacactttttaggggtggcagcagccacataggtggctgacagggattctagtcctcttttctcaccataacattcccaggcttctttcctttgtcctctctagtttacaatctaaataggtgcttccaaccttgattttttaaaatcaaagccttaaacaacaacaaaaatcaccacacccagttttatgattgcctccataaaatagaccaggcacctttccatgatgccaggccaatgggcagggtgtgctagggtaatatgccactattatgccctcccttaaa

SEQ ID NO: 409748 - DNA, 739 bp, Homo sapiens
tatgtacaatctagagataatattaactatagataaaggataatcgataggattatatgcttatgagataatgcatatgagtagagataatgagtgatctgagattggacatataggtaatagataatatatgccctttatcaatcatacagattgaaggatgcttatggagctgtcttgcgtatatttgttccgtcagagcttagtataaaattcttagaaaatgaacttttttgcagcgaagattatgaataacaatcacttaaagcttttgttaacatgttgttgtttttttttcagaagggcaatactagtttgtttacctatccctcagttatacctgcatgtgacctggaacacgtggcagttcatggtttttcattatatttttattactgctgaatttttacatttttcaatgtagttactgaccctttactttttatattttataagctgtctgatcttctcattagcccatttttttcattaatgtgaaaatatgttttcaggatacagagctgcactgtacagtactaatgcatttggctcgtaaggcaactgaaacatggccagttctcactgggacatgctatgagtataaaatataccccagattttgtagacttagtaagaaaagaaagactgtaaaatatctcaatacctgttatgctgaatccctgtttaaatgataatattttggatatattgggttgaataaaatatattctttaatttt

SEQ ID NO: 409749 - DNA, 405 bp, Homo sapiens
cagcgattggtgaaatgggaagcctgccgccgtggtttgtggtttagggtcctctggagcagcgatttcaaaatcccagggctcagcttaggaatgctgctggggaaaagaaatagggacaatctctcttccactttggctgtagaaaacgaatacatttccacagaaagtgtgctagattaattggtcaattacaaacattcattaaaatatcaggtcctctcttttgcagtggaggatttgtgacagtggatatctgtgttccatattctactgctatctggatgtccgactttaatgccaaatgttatgagacaggacttggcacctcctagaagtgttcacatatactaaatgatctgctattatggaaataattaaatgacatgtttcttgctcgaaaga

SEQ ID NO: 409750 - DNA, 366 bp, Homo sapiens
cagttaacaacaacaacaagaaaaggctggagaaaacagcggtaagagcactatgagataaatatgaagactaaatatacagttaacaacaacaacaacaagaaaaggctggagaaaacagaggtcctgctggtcattgagagaaaaggtgtgcacacaggttgggcaataagagaatcaaacagttctccaccagccattaacaccagggtttgaaggtgaagaagctggcaaattgaaatgtcaacagacgcatataaaaccctaacaaaagcctctgtagccaatagaacaagaaaggagtagactagcaaggcagaaaacttttggaaaataactcttctgctatattcaatctgggaaaaa

SEQ ID NO: 409751 - DNA, 1003 bp, Homo sapiens
tcaaggaatttccagtatcttatagaaagagcagatacctacctccttaattaacccttttttatacttactggtgtacagacctgtctcttcttactattttatgagtttttggagggcagggaccaggtctgattctcctagcacagtatctggcgcatcatagctgctcagtgtgtgtttgttgagtggactacagaacctgagattatagtcaatctgttaatatcaatgccctgctcattacaactcacacacacacacaccctaacacaccctactggtcattctcagccaagagagcacatgatgcagggtaaagagaccaacagagacaccagatagttacagacatctctgaagcaacatgtccttaaaacaggatctgttttggcaccacaaggtaccccacagccctcagtgcctagaaataggataaatactgtaagctctatatctgtctttcaccacctcaggagcaacagcagttaggtgttcagatgtgaagtgtgaagagcaaaagtttcctctactgaagacagacagaaactcaaatgaaagctaaagatgctggctgtccccccaatagtgacacctagggtaacctggagaaatggtccacagagaatagtccatgatctgtacaaacatccagagagctgctttctcccatggcctcccacaggtctgactgccagagagtagaagcaagaggggtgaaaatagaggagtacctgctgtgctgtcatttcaggtctgctctggagaagaacatgggctaagaattatcttttatgatctgaaaaagctgtctgaagttccttccaagcttatcagcctcctaacctgagctttaacaaaacccggtatggtagagtcctagtgtgccaatccagctttccttacctggctgtgtgagtcacttaatatctttggacttaagattccttacctaaaaatgagggttgagacgtaggattcagtttaaaaaaaaaaagtatgt

SEQ ID NO: 409752 - DNA, 210 bp, Homo sapiens
aaaaaagaacacgatcctatgctacgtaggtgggaaatacaaaataaaattagaattctttctttacaaaatacgttcttatgagaatttgtttaaaaaacaaaaaagttatcaagtcagaaagtgatctatccacaaaggagatgtaaacacaacgttctgatgttttgggattctagaaaaggcattttttgttgtgtttacagtcgt

SEQ ID NO: 409753 - DNA, 269 bp, Homo sapiens
aaaccctctctactaaaaatacacagaattagctgggcatggtggcttgaacccaggagacggaggttgcagtgagccgagatcatgccattgcactccagcctgggcgacaaaagtgaaattccgtcttaaaaaaaaaacaaaggaagagagaattggctgaggttttctaatgaaaacatcagaacatcacgtgtactgagcacacagataaagataaactaacacttttgtcacattatagtgaaagtacagaacaaaaaaaaaaa

SEQ ID NO: 409754 - DNA, 289 bp, Homo sapiens
tttttatggatatagtagccctcattcactctagacctgtcctatgaattgtatggggaggctgggccctgggaagctttccctcggcttttagaatctcaacccccttgtggtcatccaagctttccaaaaaggaaagacatttcttttctttttgtttttctttcttttctttttttttgacatggtcttgctctgttgcccagactggagtgcagtggtgtgatcatagctcactgaaactttctgggctcaggtgatcctcccacctcagcctcccaagtagctg

SEQ ID NO: 409755 - DNA, 289 bp, Homo sapiens
ttcagattaggggttcttaaagaggttgtgatgatgacagagtcattcatcctgcttcttttggcaagaacaatattttaaaatatgtgctttggtggcaaaggcaaagctgacaagagagatagatgtggacactggagaaacaaaatagccctaacagtgagcacactgtggtcatttcaaatgcccagagtatactaaaagtatctgaacatgtaaattactcatatatacacaatgaaggcaaacatactgccttgttccaagtgggatgaaaaaaaattttaat

SEQ ID NO: 409756 - DNA, 1194 bp, Homo sapiens
ggtgatcccctcccccagctgcagtggtcccatgggcctggcccactgcccctgggtgctctggcccagggtggcaccctcagcatcccttcagtgcaggcccgggactctggctactacaactgcacagccaccaacaatgtgggcaaccctgccaagaagactgtcaacctgctggtgcgatccatgaagaacgctacattccagatcactcctgacgtgatcaaagagagtgagaacatccagctgggccaggacctgaagctatcgtgccacgtggatgcagtgccccaggagaaggtgacctaccagtggttcaagaatggcaagccggcacgcatgtccaagcggctgctggtgacccgcaatgatcctgagctgcccgcagtcaccagcagcctagagctcattgacctgcacttcagtgactatggcacctacctgtgcatggcttctttcccaggggcacccgtgcccgacctcagcgtcgaggtcaacatctcctctgagacagtgccgcccaccatcagtgtgcccaagggtagggccgtggtgaccgtgcgcgagggatcgcctgccgagctgcaatgcgaggtgcggggcaagccgcggccgccagtgctctggtcccgcgtggacaaggaggctgcactgctgccctcggggctgcccctggaggagactccggacgggaagctgcggctggagcgagtgagccgagacatgagcgggacctaccgctgccagacggcccgctataatggcttcaacgtgcgcccccgtgaggcccaggtgcagctgaacgtgcagttcccgccggaggtggagcccagttcccaggacgtgcgccaggcgctgggccggcccgtgctcctgcgctgctcgctgctgcgaggcagcccccagcgcatcgcctcggctgtgtggcgtttcaaagggcagctgctgccgccgccgcctgttgttcccgccgccgccgaggcgccggatcacgcggagctgcgcctcgacgccgtaactcgcgacagcagcggcagctacgagtgcagcgtctccaacgatgtgggctcggctgcctgcctcttccaggtctccgccaaagcctacagcccggagttttacttcgacacccccaaccccacccgcagccacaagctgtccaagaactactcctacgtgctgcagtggactcag

SEQ ID NO: 409757 - DNA, 1104 bp, Homo sapiens
ggtgatcccctcccccagctgcagtggtcccatgggcctggcccactgcccctgggtgctctggcccagggtggcaccctcagcatcccttcagtgcaggcccgggactctggctactacaactgcacagccaccaacaatgtgggcaaccctgccaagaagactgtcaacctgctggtgcgatccatgaagaacgctacattccagatcactcctgacgtgatcaaagagagtgagaacatccagctgggccaggacctgaagctatcgtgccacgtggatgcagtgccccaggagaaggtgacctaccagtggttcaagaatggcaagccggcacgcatgtccaagcggctgctggtgacccgcaatgatcctgagctgcccgcagtcaccagcagcctagagctcattgacctgcacttcagtgactatggcacctacctgtgcatggcttctttcccaggggcacccgtgcccgacctcagcgtcgaggtcaacatctcctctgagacagtgccgcccaccatcagtgtgcccaagggtagggccgtggtgaccgtgcgcgagggatcgcctgccgagctgcaatgcgaggtgcggggcaagccgcggccgccagtgctctggtcccgcgtggacaaggaggctgcactgctgccctcggggctgcccctggaggagactccggacgggaagctgcggctggagcgagtgagccgagacatgagcgggacctaccgctgccagacggcccgctataatggcttcaacgtgcgcccccgtgaggcccaggtgcagctgaacgtgcagtgtgagtccaccacgccacccggactaccttcccagctttccttctggctcccagccggcctgtcccctcttcatcctctcacccaccccagtccaaccaaaccccaccagctactcctgatacccctaatgctccttgacagccccatgctgtaggacacggaggtctgtgttctttgctccatttcatcaagtatctcccatcttcattttcagggacccggtgaacaaaaaaaaaattacttgattttgccaggtggaaatgggattttgaaggaggaggaaggacactca

SEQ ID NO: 409758 - DNA, 973 bp, Homo sapiens
  misc_feature (21)..(21): n is a, c, g, or t
  misc_feature (34)..(34): n is a, c, g, or t
  misc_feature (42)..(42): n is a, c, g, or t
aaacaaatacggggtcaatgngtaagcgaaggcnctcggcgngtgttttaaaaacttcggggcacggaaaggggagaaggtgacctaccagtggttcaagaatggcaagccggcacgcatgtccaagcggctgctggtgacccgcaatgatcctgagctgcccgcagtcaccagcagcctagagctcattgacctgcacttcagtgactatggcacctacctgtgcatggcttctttcccaggggcacccgtgcccgacctcagcgtcgaggtcaacatctcctctgagacagtgccgcccaccatcagtgtgcccaagggtagggccgtggtgaccgtgcgcgagggatcgcctgccgagctgcaatgcgaggtgcggggcaagccgcggccgccagtgctctggtcccgcgtggacaaggaggctgcactgctgccctcggggctgcccctggaggagactccggacgggaagctgcggctggagcgagtgagccgagacatgagcgggacctaccgctgccagacggcccgctataatggcttcaacgtgcgcccccgtgaggcccaggtgcagctgaacgtgcagttcccgccggaggtggagcccagttcccaggacgtgcgccaggcgctgggccggcccgtgctcctgcgctgctcgctgctgcgaggcagcccccagcgcatcgcctcggctgtgtggcgtttcaaagggcagctgctgccgccgccgcctgttgttcccgccgccgccgaggcgccggatcacgcggagctgcgcctcgacgccgtaactcgcgacagcagcggcagctacgagtgcagcgtctccaacgatgtgggctcggctgcctgcctcttccaggtctccgccaaagcctacagcccggagttttacttcgacacccccaaccccacccgcagccacaagctgtccaagaactactcctacgtgctgcagtggactcag

SEQ ID NO: 409759 - DNA, 444 bp, Homo sapiens
agcctgtgataacacactagggcaagagaagatgaagtctttaaataggccagggcccggagtaggacagaaggaccaagaatggatatatttagaaatgtttaagaggtggaatccctagtacttactagtgctggggaagaaggaatataggccaggctgacttcaggtctctttttgagttgggagacactgaggtggagacccaggagatggagaggatttggaaaagtgagttctgctttggaaatactgggggaccagtcggaagtctgggatgggagagagaggcttgcccctagcgggaggtaagcaggagccagaaggcagagcccagtggggagctctaactccgctcctacctctccgctgatcaccatcacccccacagtgccgcccaccatcagtgtgcccaagggtagggccgtggtgaccgtgcgcgag

SEQ ID NO: 409760 - DNA, 1209 bp, Homo sapiens
gacaaccactaaattactgccttcttccctcttttgtgtcttgcctttcttcctggtgcttcagcactaagggttttgctccctctccctgccctttcccctccacggactcaattttcttctgaatgggtggccattttaattaccttcccccttccccaccccacctctctgcccttgcccttgctgctgagaaaggcaggctcaggataactacctggggactgagaatgagccaggcttgctgttcacacggggacaaggaaagaagagacagagacatttggatcctatagtctctgcagtgaaagttttattggttggtacatggaggtctggttttaggaaggattcggaaatagagttttcatattatccaaaaccccctgaggcctcgtcccaattttcttaactgctcagtaccaaatgctttactggtttcagtatttacttccctgagcctgccaggaagagtaagctttacaagtgagaaaactgaggcatgaaatgcaaagcttactccagatcctgccatcattagttcgctgaacctggttgaatttttacagaaggtctgaagtagtctttttctcttttacatgtgcaaacacacaagcacttttagaaatactttttatttttcttatttcatcttgatgataactttgtgaaaaaggcaaggcaagaatttgcccattttataatgaaggaagccagagctcagagagtttgttcaacttttatgtggttaagccaggttcaaacctgtctgtcgcttttcagtgtcatttttaaagtctgtcagtcctgattttctcagaactggattatagtatgtcggtagcaacatagtatggggccaaaaaaaggttgacttgaaagacttcagaggcacactagatttgtgcatagaaaactttcagattggccgggcgcagtggctcatgcctgtaatcccagcactttgggaggccaaggtgggtggatcatttgaggtcaggagtttcagaccagcctgatcaacatggtgaaaccccgtctttactgaaaatacaaaaaaaatttgccgggcatcgtggcgcatgcccttagtcccaggtactcgggaggctgaggcaagagaatcacttgaacccaggaggtggaggtttcagtgagccgagattgcaccactgcactccagcctgggcgacagaatgagactgtctc

SEQ ID NO: 409761 - DNA, 198 bp, Homo sapiens
cttagcagtcagaattaatgattaaaatagaaatgctgaaaatagttgaaaccgaagcagattggatgatttattcaaaccttcaggaaaaattactattcaggccagaattgaaatttagacctgtggttcataaccaattagaatgcaactcttccctgatgctacccactcccccaccccacacaaaaaaggaaa

SEQ ID NO: 409762 - DNA, 381 bp, Homo sapiens
tgagacagagtcactgtatcccaggctggagtgcagtggcgcagtctctgctcactgcaacctccgcctcctatgttcaagcgattctaagttcttaacccatgtccaaggattccataagccacctgaattcacatgcaaaaaatcccaaattttgtttttgtggatgcatgtgcatttttctagggatagattagatattacaagatttccaagggcatctatgacccatgaaaagttaagaatttcactttcagctgggcacagtggctcgtgcctgtaatcctagcactttgggaggctaaggtgggaggattgcttgaggtcaggagtttgagaccagcctgggcaacacagggagatcctgtctctacaaaaaat

SEQ ID NO: 409763 - DNA, 814 bp, Homo sapiens
atcccttcatgtaccccacacatagtttccactattattaatatcttatatcagtatggtacatatgttaggaataatgaacaatactgattgtattatgattaactgaagtctatgcattatttcagtttccttagtttttatttaatatccttgttctgttccaggtcaccacattacatttagctgtcatgtctccttaggctcctcttagttgtgacagttccttagactttccttgtttttgatgactttgacagttttgagaggttactggacagatattgtaggagatatataaatatattgtaagtatattggaatttgatgatttgtcatgcttggactaagttagtgaatttttaggaggaagatgacaaaggcaaaatgatactttcatcttatcaagagcacatactgtctgcatgctttatgactgttgatgttgaccttgaccagctggctaaagtagtgtttgtcaagtttttcctctctacagttaatcccccaccctcctttctgtgctatactctacgtagccttctgcctttccatctttgtgggctgggatacagtcttagaggtcatagagataagaagggtagacactgctagacatcgcaagtggtggtggtagaagggtagcgcaaacaatttggactcatatccatttcttcactccaaaataaaatccacgtagatcaaatatatacataaaacccttaaatcatagaggtactagaataaaatataggacaattttctggtataagacctggtatgagacaggcctttctttgtatgacaagacact

SEQ ID NO: 409764 - DNA, 391 bp, Homo sapiens
actgttcttcaactttgaacattacacaaagccaaatacattttctaagtccagattcttttgtaaataatagtcatggagctaataatgaactagaattagtaacatgtctttcatcagatatgtttatgaaagataattcacagcctgtgcatttggaatcaacaattgcacatgaaatttatcagaaaattttaagtccagattctttcataaaagataattatggactaaatcaggatctagaatcagagtcagttaatcctattttatcccctaatcaatttttaaaagataacatggcatatatgtgtacatctcagcaaacatgtaaagtaccattatcaaatgaaaattctcaagtcccacagtctcctgaagattggagaaa

SEQ ID NO: 409765 - DNA, 260 bp, Homo sapiens
gtaactgcaaatttcacaaacagtattggagatgaagggtttaaaaagggaagagatgacagaaaagacagatggcagcgtcacagttgagtataaagagagatgagcatttgaggaaggtggtagacatggaaactaagattgtttctatggataggaagtagcagggtacttaaatatttgtttgactcagggtacttgaagaaagcgtgtgaagagagggttgtggactgagaatgtgatatcttcagtcaggactg

SEQ ID NO: 409766 - DNA, 378 bp, Homo sapiens
tgtataatagagagcaccttttatatggtatacatatgtgatacatacatacacacacacacacacacacacacacacacatatatatatatacatatgagagcattcgctcttgaggacaagttcatatgtagtcttctctgctcaagacaagataatgctttcatattagttagtgttaagctccaaaggaagaattatttcttaactagaaggtagaatatatttttgtaacttgttaagactgtatattgattcaggacaggcgctgtggcttatgcctgtaatcccaacactttgggaggcagagatgggaggattgcttgagtccagaagttcaagaccatcctaggcaacatagcaaatccccatctctta

SEQ ID NO: 409767 - DNA, 278 bp, Homo sapiens
gctgggacctaattaaactaaagagtttttccacggcaaaaagaacagtcagcagagtaaacagacaacccacagagcaggagaagaatcttcacaatctatatatctgacaaggactaatatccagaatctacaacaaactcaaacaaataagttaagaaaaactcaaacaggctgggcgcggtggctcatgcctgtaatcccagcactttgggaggccgaggtgggcaaatcatgaggtcaggagatggagaccatcctggctaagatggtgaaac

SEQ ID NO: 409768 - DNA, 209 bp, Homo sapiens
actctgtctcagaaaaagaagaaaagaaaaataaattaagaaaatcagtcttctttgtagagacataacataatccagacactctacaatgtatcattcacaacatccagaaaacaacctacaatgaaacaggaaacagggcccattctcaagaataaagaccaggaatggaggctgattctgagttgattaagatggtggattagcag

SEQ ID NO: 409769 - DNA, 255 bp, Homo sapiens
tttatttgtttgatttatcacagactaaagaagatgagttaaatagtcaactacagatgtaattctttctgaatttttcttccattttgtatagaaattgttttatgaattgtgttaatatttattgtattgctgaaaagtatttatgtctaagcttttcaattggatgtgcctaatttattgataaattcttcttgttgtcttctgtaatggtatatactttttgttcaaatatgtgtaaccattttaatagtt

SEQ ID NO: 409770 - DNA, 371 bp, Homo sapiens
tttttttgagtaagaagtttttaaattattagttcaatttatctttactagttatatatttactcaaagtttttatttctctttgagtcagttaccataatttatttctttctaagactttgtccatttcatctaagttatataacttgttgataaacacctccttaattttgatatctatattaaagtgtttagatcatctgttgggtatgttataactaaatgctattagaaaaacaatttattgtccgggcacggtggctcatgcctataatcccagcactttgggaggccgaggcgagcggatcacaaggtcaggagatcgagaccatcctggctaacacagcgaaaccccatctctactaaaaaaa

SEQ ID NO: 409771 - DNA, 444 bp, Homo sapiens
actcgcgaccgcgtcgacgtgcgtgtgtgtggagagtggctgtgaaagcgacacgggctctgggaagagaagtaaggaggactgctgggaaggaaacgaggttctcggatgagcaggggctgtgatatgaaagtgatcaagagatgggaccatctagttgcaagagaacaagctcagggctccccctgattctacatgatgtatttgtcttcactttcaaagagcgtaaagtgaaagaaaggaggaagtccacacccttgggtttgggggcatcggatccagtgtgcaatgtgagaagtaaaatgaagaggagaaatgatctagagagactttctgatgaagcaaacaccagatatcctagaatttcagcaaatctaagactccatcaagtgttagatgccccattattttatgtattattaataaagaaaaaaacactgccaa

SEQ ID NO: 409772 - DNA, 477 bp, Homo sapiens
atagaaacggtgtcttgctttgttgcccagcctggtcttgaactcttggcctcgagcaattgtcctgccttggcttcccaaagtactgggattacaggcatgagccgctgggcttggcatgaatttcttttatttctttttctttcctatcaccttggctagaacttccagtacagtgttgaatggaagtgatgagagtaaacatctttgttactgataagtagggagaattcatccaatctttcaccattaagtatgatgttatcagtaggtttttcataggtgtcctttatcttcttgaggaaattcccttctgttgctaatttttttaattatgaaaaggttttggatcttgtcaagtgctgtttctgtgtttattgagatgatcatgtgatttttattttattgatatatgatgtattgtaataattgatatttgcatattaaataaactttgcattcctagaataaatccca

SEQ ID NO: 409773 - DNA, 292 bp, Homo sapiens
tggaaatgattggtctgattggttatcacaaagactctgacatatttactttttcagatgttttatagtgataatttactttaaaactttccttatttaggctgggcgcggtggctcatgcctgtgatcccagcactttgggaggccgaggcgggcggatcacgagttcagcatatcgagaccatcctggctaacacggtgaaaccccgtctctactaaatatacaaaaaattagccagacgtggtggcaggcgcctgtagtcccagctacttggggtcgacgcaggagaat

SEQ ID NO: 409774 - DNA, 348 bp, Homo sapiens
acataatttctgtaatgatcatttttaatggctgcatcatagctaatgaaagtgataatttcttaagaataatttgccaagccattctttgattgtttaactgttaggctgcttttgatttttccatagatctataatgaacacctttgcattctagccttttctttccttagaattttgattattatatcaagtggtataaatgttttcatggttctgtagatgcattgccaaatcatttcttaaatggagagaaataatttacatgtttaatgcctctcagcactgatttaaattttgaaaataaatgcttaatggaataaaaaaatgatgttcttctcattaaaa

SEQ ID NO: 409775 - DNA, 183 bp, Homo sapiens
gtgaggatgtggagaaagtggaatgcttacacagtgttggtgggaatgtaaattggtacaacctctatgaaacacagtatggagatttatcaaagaaataaaaatagaactattatatgatccaacagtcctactgggattactactagatactgggtatctacttaaagagaagaaatcatt

SEQ ID NO: 409776 - DNA, 268 bp, Homo sapiens
tttgtttttagttagaggccataatattttaagtaggatttaaaattgtatgttatttatatggtcttctaggaatatacatattgataatcaactaattttttttttaaattttacagtcatgtgtggcataataacagtcaatgactgaccacctctaccacagcggtctcctgagattataatactgaatttttactgtgccttttctgtgtttagttagatacatttaggtacacaaataccattgtattacaattgcctacag

SEQ ID NO: 409777 - DNA, 425 bp, Homo sapiens
ttttttgagatggagtttcgctcttgttgcccaggctggagtgcaatggcgcgatctcagctcactgcaacctccgcctcccgggttcaagcgattctcctgtctcagtctcccgagaagctgggattacaggcacataccaccatgcccagctccccttcatgtcttaatgtcttcatctggggtatgaaagttgagctgcttttactcacaacacttctgtcaccaaaagtgtaggtgtttgccacaccaggcaagtctccagttctctgcatacactaaatgggtgtcctacaaatctattcaattcaattctgacactgtctacccagagtttgcctgagatcccaaaagtgaaggactcagtcccaccagactatccccagttcagatggcactcacaggtcccaggttgttactggtac

SEQ ID NO: 409778 - DNA, 286 bp, Homo sapiens
ccagatttttaaaaggtgtacagtacttggattgacatttctctaaaagaatatctgagtagccaacacacatatgaaaaaatgctcaatgtcactaatcggagaaatgccaatcaaaaccataatgagatatcactccccactggttgtcaaaacaacaacaaaaagataacaagtgttagcaaagatgtggagaaattggaatccttgtactctattgggagtgtaaaatggtgcagccactatagaaaacggtatggaggctcctcaaaaacattaaaaatag

SEQ ID NO: 409779 - DNA, 505 bp, Homo sapiens
aattttgagtccaagtttcagtcaaccagccaagtcaacagttagcaccactcaatttagctcacacactgaaattgccagtagaatgtaatctccatgaatgagagtctttgtgcctgaatttccaactgttgtattcccagcacgcacaacagtgtttgacacattaggcattttataaacattcgctggataaatgagtgaatgatcaatccctttaaaggttctctgaggctggttataaaattatagggagcaggtttggtgctagaattcatcagttaattgatcagctgagtttcagtattgaacagaatcatctccccttcagagttttgatttcaagttgctcccaccttcctggatgtaaaggcttgttctgcctttggcttttccagggtgagagagccctgttttcgtgttggttccccactttgtcaactgctgatcaactgtgttctccattctccacaccaattataaccaaagctttaacacgcggttg

SEQ ID NO: 409780 - DNA, 317 bp, Homo sapiens
cctggagcagatccttcctcccagcctcagaaggaactgaccctgcccacaccctgctcatgctcctgcatcttccagaagtgtgagaaaatacatttctgttattggagccactcagtctgtggtgtttgtcactgcagccccaggaaactttaataaaagtacaggctgagcattcttaaaccaaaaattccaaaatctgaaatactgcagagtatgaaacgttgagtgctgacaatgccacaggtgaaaacattcatatttgacctcaagtgacggattgcaggcaaaatacagtcagtcttcctttcatgcac

SEQ ID NO: 409781 - DNA, 304 bp, Homo sapiens
cagttctagtttacaaacataacatgcctttatagttctcagcgctccttaaatatgtggattggaattctaattcctttaaatttcatgttgagttctcagtttctctgcagctactatagctgctctgagttgatgtaattcaaagtctctttaaaagaagctagggcatttctctgttatgcaattccttctgttgcattggagaaacaccgagtaatgcagccacgttgggaaatgctgtcattcccaaatctaagtatcctttaatgggacctactgaaaaaagaagaagaagaagaag

SEQ ID NO: 409782 - DNA, 615 bp, Homo sapiens
tgcacctgtagtcccagctactcaggaggctgagatggaaggatcacttgagcccaggaggtcaaggctgcagtgagccaagatcttgccactgaactcccgctggggtgacagagcgagaccgccatctcaaaaccaaaaaaacaaaacaaatggaatcagcacaatagctgtagaaagatgctattagaaaggatggggggaaatggaaaataagtggcagataaagtacccatactaaaaagatgtttttagcttggttgaaaaataattgtcagtcctaccactgtgagttcaaagaacttaagaaaatacagaacttcaagcagagatatagaggattgggtaaaataaggcatggcaaagagaaaatataacatcagctggcagagcacacaggaaagtagtggaagagaaaactaaaattatcacaggattaaaagccacattggaaacagaataaaggctgggcacagtggttcactcctgtaatcccagctacttgggacactgaggcaggagacttacttgaacctgggaagaggaggttgcagtgagccgagatcatgtcactgtactccagcctgggtgatgaagtgagactgtcaaaaaaaa

SEQ ID NO: 409783 - DNA, 348 bp, Homo sapiens
tgcacctgtagtcccagctactcaggaggctgagatggaaggatcacttgagcccaggaggtcaaggctgcagtgagccaagatcttgccactgaactcccgctggggtgacagagcgagaccgccatctcaaaaccaaaaaaacaaaacaaatggaatcagcacaatagctgtagaaagatgctattagaaaggatggggggaaatggaaaataagtggcagataaagtacccatactaaaaagatgtttttagcttggttgaaaaataattgtcagtcctaccactgtgagttcaaagaacttaagaaaatacagaacattcttcttccccgccatcttattccct

SEQ ID NO: 409784 - DNA, 780 bp, Homo sapiens
ataaactggtcatcatttgattttgaaggatcttttaaattaccagatttagtattgaaacagatgatacaatttaaaaatgcaattgcaatgacagaaaaagtgtggctatgcatttatctggaagaactgaaagttacttggctctgagtacagcaccagaagccttgaggtgagagcatcccgtggggtggggtgggggcaaggtaaggggtgcagtaaggggtaggggtttgggggcaggatgcaccctccgggtaagcactgctcttctgatggggtccatcgggagctgcgccagcccagtctcctgcctcctgagttatttcccctcccatctgtgtccagtagcacctcaaggttccctatggcagaagcgagcattctcaggcgaggcttcacacttggggttctgcggcagaaatctgttttgaaacatgccgtgggaaagacaaacacatccctccgtgcacatcacagggagctcctccaccctgagccagcaaatatacaatcggctgaagaataatgaaaacatcttaaccacacattatgagctaactggcggccagggcactggcacactggcatccgcaggggccgttagaatggaaatgtggaagtgtgttccactgcaggaaaatcgctcttttcatgagcagtgtttgtgggtaaaggatgacaaggcttcacatcagctccctcctcctcaagctctaatggctgtggggcggctttgccactctgccagcagctggatgaccacgccgatccctgcca

SEQ ID NO: 409785 - DNA, 404 bp, Homo sapiens
  misc_feature (364)..(364): n is a, c, g, or t
  misc_feature (378)..(378): n is a, c, g, or t
  misc_feature (391)..(391): n is a, c, g, or t
ataaactggtcatcatttgattttgaaggatcttttaaattaccagatttagtattgaaacagatgatacaatttaaaaatgcaattgcaatgacagaaaaagtgtggctatgcatttatctggaagaactgaaagttacttggctctgagtacagcaccagaagccttgaggtgagagcatcccgtggggtggggtgggggcaaggtaaggggtgcagtaaggggtaggggtttgggggcaggatgcaccctccgggtaagcactgctcttctgatggggtccatcgggagctgcgccagcccagtctcctgcctcctgagttatttcccctcccatctgtgtccagtagcacctctattccnccttctcagaaagntcaggcttttgtntttttattgtttc

SEQ ID NO: 409786 - DNA, 456 bp, Homo sapiens
ttgaggtacctataaactatctttgaggagatgtctggcagggattggatataagagcgtgcagttcagggaagagcccatggctagaaacacacttttgggagttggggcactgtgatgagtttgcagatgaagacgtgaagggtgcctgggacaggggctccctcaccctaagtggagcagaggagcaggggccagcatggggcctgagaagagaggcctatgaggtgctgggactcaggagaaaggggcctgctggctcccttgccaacaggtcagatgagataagcagaagaggcaaaggagatcattccgtatggcagcatggaagtcatctgctgagtgaatgaatggaattctacctcattggttggtgcatctctttagaaatgaactcagtagaggctgggcacggtggctcatgcctgtaatcccagcactttgggaggccgaggc

SEQ ID NO: 409787 - DNA, 270 bp, Homo sapiens
tgatgagggtttgggatgagaagtcaccagcggtaacctcagaggtgtcagttggggccaaggaattcgccttctgttgagaagttcgtccttcctctttctcacatgataaactagcatatttaaatcaactagctcagatttggagtctttattttattttttaggaagtatttctgcttcacttagaaaagtgagatgctctgtgtctgtgacatgctgcctcactggagagtattttagagtcccttccaccccttgactgtcaaa

SEQ ID NO: 409788 - DNA, 658 bp, Homo sapiens
gaaaatggattctctaaatgacttgtttagttggttaccctcagggctaagttcattttttcgttctggtcttcaagtaattgttattataatcataagtacagtttccattttcctagttatcaaattactcatgattcgtgtttcagcttgcttgtgatcaatgactaaaactagaataataattgcttaaaaagttgccttaattgaaaataagtcacacaaccagaatcagaccactaagttatactttccttctgttgttcataattaggctttggcttctttcggcttatgaattaaacatttcccctctctgtggggcatgactctctaggaatgagacttcctagtgatgtgagatataactactctctaacaaatgcttcttccgtaatgctttcttcaaagatcttgaagaaaaggggaaaatgtgaaagaaaaggaatagtctgtctatttggggcttctaaaagcttaggttttgtggaagattgactttggagaccaagtcacagagcatgacctcttaatcttgactttttattatagattaatttcctttcttattttcttgtacctgactcagatggtacctgagatacaagactccttgactgagtctatataagtctccttgactgattcttgactgaga

SEQ ID NO: 409789 - DNA, 481 bp, Homo sapiens
tgacctcaggaggcctcggcctcccaaagtgctgggattacaggcatgagccgctgtgctggcctgatttttaagttttagaactcagtgagtcttcaaaccagtgcagatctgtcactataaaaagctgccaccaggcccactcacacctgtaatcttagaactttgggaggctgaggcgggattgcttgagcccagaagtttgagaccagcctggacaacatggtgagaccccatctcttgaaaaaaatttaaaaattagctactgtggccccagctactcggaaggttgaggcaggaagattgcttgagcccgggaggtcaaggctgcagtgagtcgtgtttgtgccattgcactcttgagtgggcaacagagcaagatcctgttcccaaaaaaaagctgccactggggccaggtgcagtgccactcgcctgtagttccagctacttgggaggctgaggcaagagacacaacctcttt

SEQ ID NO: 409790 - DNA, 386 bp, Homo sapiens
caggagtcatggttacagatgttttctgacgattctaaattttatgaattccccactagaaagtcttgttcactccccctgcttcctccctctctcctgaggggtaaaggcctgttcttggaggcaggccgacaatgacatgtttgtcaaggctatagctgcagaggctcataggaggagcccaggtcctctcaagatgcagtggccagagagttctggagtttaattagcaggacagcagctgtggagacttgggccgactgttggtgtcaaaggacatcctccctttaccccactctgtgccagtgtgcctcatatttctctctgggctacaactgttattaacgttcagattttggagataatggtcttaattaaactacttt

SEQ ID NO: 409791 - DNA, 470 bp, Homo sapiens
ttaaaggtcacctggcctttttctaccatgaagacttccaaagagtagttgttcacacccagcgcaggggtgcttctaagagtgagaatctggacagggcacccagaaagcaatggctaaaaatgcctcaatggtggagcactgtaggtccagccgagacacccagtaaactcacagggctttctgacagctcggggtaatcggttaggtcccagcttctttataagttcctgttgcctgaatctgtggacagtgtgtcccttccctaaaggtacagcccacagttagcaaacacagtaactgctaggtgaattaatcagtgcaaatgtcttaagccctgctggtgcagagtctccggggtgcagagcaggagaagtgatggcagccagggagaggttggactatgcaacttcccaggggcagaagtgaactctgccactcctgacaccagctctaggaaagacctgggt

SEQ ID NO: 409792 - DNA, 464 bp, Homo sapiens
aaaaacatcaaaaaaagaaaaagaggactcagaggagccttactcaagtttggtcaaggggtgagtgtgtccgactccaaggagcatctccgtttctgagtgggaactctcatgacactgtgtcccttgcctcaggcttgtcactgtctaaagaaaaacgctcctttcattccaacagctggcaggatctctgttttgccctaacaaagaagctagagccaaaattcaggatgaatcatcgttcttctctggcaaagtggctgtaggtcccaggtctatggaggctttcccagaatcttttagatactgttcatgaattctgatccaaaaggaacatttcatagtgcgggcaggatcacatattaggcagaaaacaattccaagcaaggagagttgctgggattattctgctctggtcgcaagctgtttctcccgccgcactgtatctgcttggtggagacaag

SEQ ID NO: 409793 - DNA, 460 bp, Homo sapiens
cagtggctccacttcctagcacttaactctaagacaggtatttatggtgccttgaccttccctaatatattgctacaaggtaacgtgggccagtcctgcagttctggtcatcccatggcccctccctgggcctgagcaaagaacaagaaaaaaccatcaagctggtcacgaggtttgcgatacaaatggcagtgagttgttttcaggaggcaaatgggcccccacagactaatggctttcagtggctccctccccctccctccctgagcttcccccgccccggtccagagctggcccagctgggaagctgcagttgctccagccacccccaccccccagcccttttgctgacagtataaccttcaggaacctgaaattcctgagtggtccccagagctccatgcatcttgaaagaaaatttgtgtaatgtcatttcaggctgtccctaatccagaattat

SEQ ID NO: 409794 - DNA, 518 bp, Homo sapiens
caaagtcaaggttgctgctttgaaaagacaaaattggtaaacctctgatgtgattgagaaagaaaagcacaaataatcaaagtcaggaatgaaaattgggaaatcacaacagattccatggcttatttagaagtatattttttaacttccaaacatgggaatttcctagttatatttttgttattgttgttacaaaacatggtccatgtgactgctgtcctttgaattgtgttgagatttgctttatggcccagcatgtgtttaaccttagtgaagatttgtgggcacttgaaaagaatgcatgttctgcagatgccgcatgcagtcatctacataaagccattagattgtaatacgttgttcatatcttctctgctcttaatgaagttttatttgcttctattaatgagacaattgttgagttatctctacttagatatagttctgtgaactttgctttatatatttgaggccacacaaatataaaattgttatatgaattgaaattttatgaagta

SEQ ID NO: 409795 - DNA, 400 bp, Homo sapiens
tgaggtgggaaggtggcttgagcccaggaggtcgaggctgcagtgagccttgtttgcatcaccgctgcactatggcctgggtgacagcgtgagaccctggctcaaaaacataaaataaaaagtttcgactgggcacagtggctcatgcctgtaatcctagcactttgggaggccgaggcaggtggatcatgaggtcaggagttcaagaccagcctggccaagatggtgaaaccccgtctccactaaaaatacaattagctgggcttgatggcgggcggctgtaattccatctacttgggaggctgaggcagagaattacttgaacccaggagatggaggttgcagtgagccgagatagtgccactgcactccagcctgggcaacagcgcgagactctgtc

SEQ ID NO: 409796 - DNA, 304 bp, Homo sapiens
ttttgtctttgtcgggctgcaaaagggctcagcaggaggagcctccagctgaggccagtaaccacacgttgggggttgagggctgcctcacgcttgcctttctggcctgggcagcctgctcactcacatggtacacatcttgtttcccctgtgttttcccagcaatattcagatgtgctggagattactgtaggaagggttggtgagagccagacttttaccatcttaaccatggctatttctggtgagtgtcccttaagatctcagaggataagtagtggtcctggggtgggcagggcaaagc

SEQ ID NO: 409797 - DNA, 350 bp, Homo sapiens
tagcatgagcaaaacagaataaaatccttgccttcatgtagcgtacattctagtggaagaggagacaatatataaataaatgcataataaaatatcacatagtataataataagtatcttgaagaaaaaaacaatgtaaaggaataaagccgtgtggacaactggagccctacctcatatcatatctttttttttttttttttgagatggagtctcgctctgtcacccaggctagagtgcagcggtgtgatcttggctcactgcaagctccgcctcccacgttcacaccattctcctgcctcagcctcctgagtagctgggactacaggcacccaccaccacacccggct

SEQ ID NO: 409798 - DNA, 478 bp, Homo sapiens
ggaaaacatggggctgaaaacagccctggaagtctggattcttagtggaagttgaaacagtctaaaacaaagtctctggctgtcctcagtttgcacttaagaagcagaacactcaacactgaaaagcaggatggcaagcaaaggtcttatatggcctccacactccggatggagacagtggggatcaggatgggctagtggctagagtctagtagaaatagaaaggggttcccaagagactccaggccccaacattgagcttttattgtgacttccagggctgtgtcccaaatgaccctttctgagaccctccacaaccagcctccagggaagcctgtgaaccagggagaagaaggctcactctactgagccactgccaagctttggagtcagcgtaactgagccccatcatcggcatcaatgttttatagctgtgggaactcaggcaagtcattcagcctctcagattcctcatcta

SEQ ID NO: 409799 - DNA, 352 bp, Homo sapiens
ctgtcttgcagatagttccagctggctggaaatatcctgtggaactgttagaatatggcccagggccgggtgcagtggctcatgcctgtaatcccagcgctttggaagaccaaggcaggcagatcacgaggttaggagatcaagaccatcctggctcacatggtgaaaccctgtctctactaagaatacaaaaagttagctgggcttgatggcacccacctgtagtcccagctactccagaggctgaggcaggagcattgcttgaacccaggaggtggaggttgcagtgagctgagatcgcgccactgcactccagcctcatgacagagcaagactccatcttggggaaaaa

SEQ ID NO: 409800 - DNA, 408 bp, Homo sapiens
gcatggtggcacatgcctgtaatcccagctactcaggaggctgaggcaggagaatcacttgaacctgggaggcggaggttgcagtgagccgagatcacgacactgcactccagcctgggtgacagagtaagtctcaaaaaaagaaaaaaaagcaggaattaagataacagtaatatctcattatgtacatatgtacaaaaaataatttttcaaaacaaaaaaaattattgaggagagtggcattgttctacattattttacaaatattttttgatttttcaattttaaattatgttaaaaaacataacataaaattaccatcttaaccattttttttttttttgagactgagtctcactctgtcgcccaggctggagtgcagtggtgcgatctcggctcactgcaagc

SEQ ID NO: 409801 - DNA, 347 bp, Homo sapiens
tggcatgaagcccagccgcggcagcacctctgctctgcgggatccgctatgtccataggatatttgcctcccagaatgaaagggagctcaaagtgacccaaattctcaaagaaaagtttccttgagctacagtgatcaaagtcactgacatttcaggaggttgaaattaaatagaaatttaattgaattaattaatttaaattgaatttaaaatgaaattaaaattgaatcagaagaatttaagcagaagagaactgttcagcagtaccacatggttaatcaggcactaaaagaagaaatcaaagggatgcatggattacagatatttacctctgtccccaaacgct

SEQ ID NO: 409802 - DNA, 174 bp, Homo sapiens
atctgtgcacttcagtttcctcttctataaaatgggatcaatactatcttctaggccaggtgaggtggttcacgcctgtaatcctagcactttggggggccaaggcgggtatattgcctgagctcaggagttcgagaccaccctgggcaacatggtgaaaccctgtctctacta

SEQ ID NO: 409803 - DNA, 724 bp, Homo sapiens
  misc_feature (81)..(81): n is a, c, g, or t
caagaaggcaattctgacacatgctacagcatggatgaaccttgaggacattatgctaagtgaaataagccggtcacaaanagacatgctgtacttttccacttgtatgagggacctagagaagtcaaattcgtagagacagaacgtagaacagtggttgccaggggctggggaaagtggaaggagagaggttgttttcaaagaaatgggacattggctttgaagaggtgacagatggaattatagaaaatgaggctgggtgtggtggctcgtgcctgtaatcccagcactttgggaggccaaggcaggcaggtggatcacctgaggtcaggagttcgagaccagcctggccaacacggtgaaaccccgtctctactaaaactacaaaaattagctgggcgtggtggcatgcgcctgtaatcccagctacttgggaggctgaggcaggagaattgcttgaacccaggaggtagaggtggcagtgagccaagcatctagccgctgcactccagcctgggtgacagagctagactccgtctcaaacaaacaaacacccctgtccttgctcagtcatctataatagctcttagttgcttatttaaaacaaaaatctttaaagcgcatcccaccctaggttacccagcccctactttcagtgcctctctgagctactgtgtctgtaaaatcaaggtattgtactctgccttgcatattggaataattt

SEQ ID NO: 409804 - DNA, 474 bp, Homo sapiens
ttgaaggcagggaaaaggcatgaacaaacacgaatgcacacatctcactgaagatgatgcacagttaatttttaaaaaatgctggtggataaatttcaagcaaattatgtgagtgaaaaaagcaatctcaaaagaagcatatagccaggtgtggtggcatgcgcctgtaatcccagctacttgggaggctgaggcaggagaattgcttgaacccaggaggtagaggtggcagtgagccaagcatctagccgctgcactccagcctgggtgacagagctagactccgtctcaaacaaacaaacacccctgtccttgctcagtcatctataatagctcttagttgcttatttaaaacaaaaatctttaaagcgcatcccaccctaggttacccagcccctactttcagtgcctctctgagctactgtgtctgtaaaatcaaggtattgtactctgccttgcatattggaataattt

SEQ ID NO: 409805 - DNA, 852 bp, Homo sapiens
aattatggcataacaaaattatcaatatggtagcaattttctgtattgattgcctgtatgcatacttatagtggacgagatttgccactgatgtaactcttttctttttttctatttataattttatgggtctgaatctaataaaacatttggacttgtattttgtatgacctttttaacttttatttttccagcagttcattttaattttactttttaaaagtgttggtccatgaaagattgtaattttgaagaaggaaagtggtttttcaccacacatagtctgggcgatctaggccaggcacaatgctcacatctgtaatcctagcactttgggaggccgaggtgggtggatcgcttgagcccaagagtttgagaccagcctgggcaacatggtgaaaccccgtctctgaaaaaagaaatacaaaataatttgcccggtgtggtggccacatacgtgtagtcccagctactcaggaagctgaggtgggaggatctcttgagcccaggaagccgaagccacagtgagctgtgattgcaccactgcactccagtctgggtgacaagagtgagaccccatctcaaaaaaaaaaaaaaaaaagataatctgggagatctgtcctatcgtagttctcatagtatccatcactgaccttattttactgatcatcttgctttattattagttatattcccttttaaccaaaagctctatgaagggcagagtccatgtttgtgtttgctgttacgtcttcagtatccagaacagtgttcgttacttaacacctattcagtagatattggtcgaaagaattaatggtacttttacatttttttcattgtgtgggaata

SEQ ID NO: 409806 - DNA, 398 bp, Homo sapiens
ggatgtggtaacatgatgagaaaatcattctagttgcaatatggagaatggatctgaaggggcctgggataccacttagcaggtcacagagagcaatccttctaaaaggcataaatgaactttcccgtcctcaacattctccacttgtgcgaaagtgaaatctaaactacttagctcaaaaaacagagtcctttctagcactcaataatgtttctagtcttttctaacgcttcctgatgtgcatcctgtgcctggccttgtgttcactgctacttgatcttgccacgctctgtttcttctatctgtactgtcctcttcatccccctttgtgaacctagggaacacctattttccagcaaaacacagctccttcatttcattccaccccagaaaaaaaa

SEQ ID NO: 409807 - DNA, 453 bp, Homo sapiens
ttgtgtggttcctggtgcctgtgctgagggtggagtcgctctccctgcccgattactctccctggctagcagctctccaccactggctcttcccagatctcctgggtgcgcggttctgagctgtcggcattgctttctttcagtcactgccggtgacatcaggtggaccctggtcagaaacattgattaaagccactgtcggtgataagcagttcagaattttcgctggggctccgaagcggcagtggttatagatagagaggtgttccactgcgcacctttgtagttgaatgtgattctttggcgatgccctgtctgtaggctcagctgctctggagccacgtggtgaagccgctgtcaggcagggccagggtcgagcagcacaggcaggagggtggccgctcggcccaagggtgccttgtgtggccttggagatgaggcctaaaaaaagaa

SEQ ID NO: 409808 - DNA, 119 bp, Homo sapiens
ttccttttttttattgagtatattttatggttccattttagttcagctattaccttactaactgttaactcttttttaaaggattattctaggatttgcaccttttatcacagtctacc

SEQ ID NO: 409809 - DNA, 439 bp, Homo sapiens
ggaacatttgtatgctcttctgaggttttgttcatcccccccacctcaacatctaatttacacgttgaattagtcattgactccgcctgccattttgtggtaaagatcaagtcaaatgaggctcatcacagtgcttcacaaaaggggccgggtgtggtggctcatgcctgtaatcccagcactttgggaggctgaggctggcggatcacctgaggtcaggagttcgagaccagactggccaacatagtgaaaccccgtctctactaaaaatacaaaaattagccgggcgtggtggtgggcgccggtaatcccagatacttgggaggttgaggcaggggaatcacttgaaccaggaggtggaggttgcagtgaatcaagattgtgccattgcactccagcctgggcaacaatagtgaaactccgtctcaaaaaaaaaaaa

SEQ ID NO: 409810 - DNA, 330 bp, Homo sapiens
atgtaaagaaagccatgggaaggatacagaaagccattatatagtcaatatatgtaatacagaaagccatttatatagtcagtatgtaaagaaaggcatgggaaggatacagaaaggcgagccctgagccctccagcttttcaaagtcagatggaagaggagtcagcaaaggctcagagttagacctggttgtcggttcttaacctctcagagccacagtttcttcacctgtaaaatggggatattaatacctggtttgcctatttcatagaagtgtggaaaaggcttaactgggatgcccactagaaataaaggttttgttattatgta

SEQ ID NO: 409811 - DNA, 130 bp, Homo sapiens
attacgttttctttaatagtgaaaatctagttcagaaaatttgacgttcactttttctttaaataaaaacatcactctttgaaagcatgacacattgaatacagtttaaaatatacaaattttataatat

SEQ ID NO: 409812 - DNA, 118 bp, Homo sapiens
ctaagactcagcagataaggatggaggcgactcaacatcacactgagacagatatgagccctgcatttctgaatgccttgaaagaaaaaccagcaagttgggagggccgtgtctcctt

SEQ ID NO: 409813 - DNA, 707 bp, Homo sapiens
tttttttttttagagagtcagggtcttgctctgccacccaggcaggaatgcagtgatgtgatcataactcactgcagcctcaacctcctgtgttcatgtaatcctcccatctcagcctcctgagtagctgggactacaggcatgtaccaccatgctcagctaatctttttatctttttttttttttcaggagatgaggtcttgctatgttgcctaggcttaattatttacttttaattaacctaaacttaaaaagctacatgttggtgacatcagccaaaaaaaaaaagtaaggacctctgaaaatcatcttcacaaaaagaatgaaaacatggacaaaaatagtcaaaatcagctttttcagaactttggaaattagccaaaagcttatacacatagcacttattcaagaaaaatagctgaatatcagcaagaacagttatcttcatggtgttttaatttgcgctgtacccatttgttgtcctccagctgtatggtagccttgaaaaccaacaggccacaatcacagtgaaaacctcaggttggcagccactggaggatacaaaatgagtttggatctccttcaatgccccattcccagagaactgtcattatttgacctgctggtagttccctaaaggacgtgcaaggatgtttttatttgactggacacttgaagcttgccctgtatgaacagcccccatcttc

SEQ ID NO: 409814 - DNA, 851 bp, Homo sapiens
cggccacgccttaccgaaaggagtcctgactcagagctgctgtgccgtcccttctcctgtccctgcctggaagaggcctatcaggttgaccaagctttgctcccacctgtggatgagaagggcaggtggccgagagtgggtgtggaggaggaagactggatgccaatgatcctgatctcactctgtcaccaaggctggagtgcagcagcagaatttcagctcactgcaacctcgacttgctgggttcaagggatctcccaagtagctgggactacaggtgcacaccatcatgcctggctaattttttgtagggatggggttttaccatgctgcccaggctggtcttgaacttctgagttcaagcgatcctccctcctgagcctcctaaagtgctgggattacaggtttaaaaaatatcctggactttggaaaatattcttatataaagaagcaaaaagaggatggaatagacttgtgctaacactgaaactccagtcaagttgtaaactgaaaaagaacgtgttgaaacaaggaattgccccatagccttcacaggtaatgctgatgcttcaagtcttggaaccacacttcgagaatcactgttataatgtacagcagaactgcatgatcagctgtatggtagccttgaaaaccaacaggccacaatcacagtgaaaacctcaggttggcagccactggaggatacaaaatgagtttggatctccttcaatgccccattcccagagaactgtcattatttgacctgctggtagttccctaaaggacgtgcaaggatgtttttatttgactggacacttgaagcttgccctgtatgaacagcccccatcttc

SEQ ID NO: 409815 - DNA, 287 bp, Homo sapiens
ctaagcgatgaaatccaaaggtgaatcttttggttggtgattttgatgatagccacaaagcaagcaggctgtatggtagccttgaaaaccaacaggccacaatcacagtgaaaacctcaggttggcagccactggaggatacaaaatgagtttggatctccttcaatgccccattcccagagaactgtcattatttgacctgctggtagttccctaaaggacgtgcaaggatgtttttatttgactggacacttgaagcttgccctgtatgaacagcccccatcttc

SEQ ID NO: 409816 - DNA, 730 bp, Homo sapiens
agcctcccaaagtgctgggattacagacgtgatccaccgcgcctggccagagcttgacagttggattgatgaaacctgagaatgtatgctttatatgttgttcattttaatttgttatatctagaaatttagctcttactgttgactataacacatacatgacgtgagtagaattttatctagattgagttttcagaccgtaattggtttcaagaaaataaataaggtattggaagtgaactaaaattagtaactggctttggcattagactttaatgcacttaaattacatgatctcatctgtgagataatttgacagaggaggacgatggcatgtattatgtccatatgaggaaagggcagagaaatagaccctgcaagattcattagtgttactccttcctcctgttcgttttctttcttcgttttccccccctggtaagcattaaaaaaaattttttttggctgggtgtggtggctcactcctgtactcccagcactttgggaggccatgactcacttgaggtcaggagtttgagaccagcctggccaacatggtgaaaccccgtctctactaaaaatacaaaaaattggccgggcacggtggctcacacctgtaatcccagcactttgggagtccaaggcgggtggatcacgaggtcaggagatcgagaccatcatggctaacatggtgaaaccctgtctctactaaaaatacaaaaaaaaaaaa

SEQ ID NO: 409817 - DNA, 295 bp, Homo sapiens
tccccataaagaaaaatgattattgcaaagattttgttttggtaagcattttcctgtaggattgtgctccaagagttactgtcagtttcactgttctttacttttccctagtaggagtatagcgaatgctacctggaacaggtgccaatgttatttgaaataaaaagtatgcaatttggtatctattcgcccaagctggaggtatcaggggactttaaaacagagatgggcatataagaaataacattgcttattacaaccagaaatgtacactacatacccctccagaaaaaaa

SEQ ID NO: 409818 - DNA, 303 bp, Homo sapiens
ggtgcgacggctgggcgtggtggctcatacctgtaatacgagcactttgggaggcagaggcaggtggattacttgaggccaggagttcgagcccagcccaaatatatcttttaaagcataatacactaaccccaaaactgaagtaatcacttaatgtcattttaacaaattcctagaaatcccagtttaaatgcatttttatgtggaaggcttccctattacctcccagcaaaattcgtagtctttctctatggagttagcaggaactatatataattttgcttctgtatttcgtcttggttt

SEQ ID NO: 409819 - DNA, 337 bp, Homo sapiens
gcacattgagaaaatagatcagcaagttttctaattgctcatatctaattacattcctgctgttgaactgttttgacatcctggaaaagggtgagtcacaaaagaggaaggaactacacttatgatccattgtaaacacttttgggtgtggtgatgtgtttgtgtgtatcctagaacaaattatctcatttaatgcatggaggctatcaggtaggtttttgttgttcattctaacctgtaaggtgaaatttcttgtggttgcttctaactgctagtattgaagatactcctgaaagaggaccaaaagtagtgaaggaatacttttgcattgtgagga

SEQ ID NO: 409820 - DNA, 360 bp, Homo sapiens
tggtagaggcagggtctcaccatcttgcccaggctggacttgaactcctgggctccagcaatcctcctaccttggcatcccaattgtagaatattcagacttagtaccagagagatttcaggacaagactttttggcctccttccatttggcaaccactcccttgtcttcttgtgcttgaggccagccgctagcggctgaaagtgggataacttgggaagacgtgacaattgctctgtcttaaattgtaggtagcaacaggcatcagtaatacatattttatccattttgcatgttttgtgtcttcataatatgttaagttttgttttctgaacatgataaccataattttaaacttcag

SEQ ID NO: 409821 - DNA, 395 bp, Homo sapiens
aagggcacagtatgattatttaaataaaattaaaatcctcaagttttccaggacacacgtttatccctctgaattcaaaaaagtttaaagaagtcttcccatatgcataccttactcaccaagaagtgatacttaattttttaaataagtaagtttcttcttcacaccattttggtgaagatggccacactctaaaacttggaaactcatgtgctgacacaaataaacccatttgtgcctggaaactcaagtcttttaaaaaacagaaaattgaaggcttaatatccaagatatataaggaactcacaccactcgatagcaaaataaataaataaataaataacctggttaaaaaatgatcaaaggcatgaacaggcatttttcccaagacaaca

SEQ ID NO: 409822 - DNA, 422 bp, Homo sapiens
tacaggcgtgagccaccgtgatcggcacatttttacataagcaatcagatatgcgtttgtctcagatgagcagagggtgactttctgtccagcacctgtgaagataagcttttccttgtgggcaaattgtgctttgtagctatcttatttaggaattaaaatgggaggcaggtttgcctgctggagttctcagcttgacttttcccttggcttagtgattttggggtcctgagatttattttcctttcacatttctgtagcctcaagatggcatatgaacttctgtacctcactgtggagcggggtctttgttctgaaggctgctatgtatacatatgaaataaatgtgtgtgatctttcttttaatgtctgttaattaatctgcctcatgtcagtgattttcagtgaacctccagggggcc

SEQ ID NO: 409823 - DNA, 410 bp, Homo sapiens
gggataattgtctttgcagtcagtgagattataaagatatttggatcacattattgaggagccatcatgtggtaaaagtagcagtctctccaaatttggaaatttctgagttgttgggtgatatgaaaggtaaaatttttacatctgatgttatcctgcgtctactacaaatattagcacattgcctcaccaagagcaaataaataagtcagcttcttaaaccataagtttcccagtgggcatattccattctactacaatttatatttttcatatggtttcagtgttctagtgtttactattcattaacatgaaacacagattttaaattgcctttttaaaaattatttctgctgctttgtggttttctttgttttgagggccatgttattcatggagttttcattgtt

SEQ ID NO: 409824 - DNA, 255 bp, Homo sapiens
gattgtctttttgcctatatatggatcacactttcttgttttttcagatgtctaatacattttggttgaaaagtggacattatagataacatgtagtagctttagaatctattgtgttctgaagattattagtcatttgttgtattaggcagttggaagttaactcacctggaatcaaattgcaaactttgtcttccctactattcaaatgctaatatctttgcctgtttttatagtctccagctgctgcttttt

SEQ ID NO: 409825 - DNA, 312 bp, Homo sapiens
aagatagggtctatctctgttgccaggctggagtgaagtggcacaatcatagctcattgcagcctttacctccctggctcaaatgattctcccacttcagcctcccagagttttaaaatgttttgagacttgttttgtgcatagcaaaggaaacaatccaacagagtaaagaaataaccttccttttgaatggtagacaatagttgcaaactatgcatctgacaagaaactaaaaaccagaatatacaaggaactcaaacaactcaacagttaaaacaaaacattcccattaaaaagtgggcaaaagacata

SEQ ID NO: 409826 - DNA, 160 bp, Homo sapiens
aatactatccctcttttacagaaaaggaaactgaagctcatggagaattaagtaatttaaagatcaaataacaagtaaatggtgagactggaatctctgctcttaatactcttaactcaagtcctaaactaatgagaatttgtgttgtaaaaaactcagg

SEQ ID NO: 409827 - DNA, 233 bp, Homo sapiens
gaattaaaggtgaagcccgcactcacctgcgtgggatgcagagccgctaccaccacgctctgcgtagctttggggaagactgtaatttcaattttagcttcgtgcttcccgctttccttatgtgtaatgagctcaccacatgcaatgtaataacaatagccaaattaaaaatgaatgacttggcccagcgcggtggctcatgcctgtaatcccagcattttgggaggccgagg

SEQ ID NO: 409828 - DNA, 767 bp, Homo sapiens
gtcccagctacttggggggtcaaggagattgaggctgcagaactacggacacatcactgtactccagattgtgtgacagaacaagaccctatctcagaaaaaaaaaaaaaagtagagcatatctatagagttgtagaaataaataaggtaaggtgtgttatatgcttataatagcacatgggacataggaaatcttcagtaaatgttagtcattattatcattaccattatttattggctatccagatattggagaaaactgaaatcgaccttaagactgatttgtgtaaagcacagtaagtattcagtgaatgtttattgggtaataaagacatgtcaagtgtatatggaggctttattgaatagattaccatttttcaaaaacaatgaaaggttttaaacagtttatttcagcacctcctcaatgaactggagctcaaagccttaccctagtgccctgtctggatgagtgacacatagccaaattatataataatgttaattatttgaggatattgtatataaacaaacatttagaagtcagtttgctgaccaagtacggaggcttatgcctgtaatcccagcactttgggagcccaggcgggtggatcacttgaggtcaggagtttgagacagcctggccaacatgttgaaaccccatctctactaaaaatacaaaaattagctgagtgtggtggcacgtgcctgtaatcccagctacttgggaggctgaggcaggagaatcgcgtcaacctgggaggtggagg

SEQ ID NO: 409829 - DNA, 863 bp, Homo sapiens
cagctacgtcagcctgaggtgtccttaggcagaacagaaagtgagaatcagagcagtatctcatttctgaacacctggattgtagctttccctggactgactgtcaaaggaggtggttttaaaaagcaagccaaacaggtttccgtcctttaggaagaccctggaacgtgccagttgattctgacaatttctcatgaacagaaacacctaggaagggagaactggtgagtcttttcaagaggaggaagtccctcaaaaggggctgtgtttcgcaaacggcgccccaaaagggctgaaatacttcgatctggaggaaaaagactcaggcactgagggaaggggagggtgcacatctggggtaatttcaaggctttttccgtgttatctgaggtggcaacaagtaaagatttgttcgttttattatttttttaatttttaaaggtgttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctccaggcgcgagtggaggtcggtgtggggagacgcgactcctgcccgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcg

SEQ ID NO: 409830 - DNA, 461 bp, Homo sapiens
cagctacgtcagcctgaggtgtccttaggcagaacagaaagtgagaatcagagcagtatctcatttctgaacacctggattgtagctttccctggactgactgtcaaaggaggtggttttaaaaagcaagccaaacaggtttccgtcctttaggaagaccctggaacgtgccagttgattctgacaatttctcatgaacagaaacacctaggaagggagaactggacttatttaatggggatgtgttcaaggcaagaccgaattcagaaggatatcgacgtcgtgatccagaagtccagagctgaggactgcctgtttgcagggcccgcctggcaggacgactgagcaagttcttggaaaaccagagatattagagcggtgaatcgcgctggtcacgttggacacctgcgcgttaggagattctggagccagagggagagaccccagaaacgccccggtcg

SEQ ID NO: 409831 - DNA, 604 bp, Homo sapiens
cagctacgtcagcctgaggtgtccttaggcagaacagaaagtgagaatcagagcagtatctcatttctgaacacctggattgtagctttccctggactgactgtcaaaggaggtggttttaaaaagcaagccaaacaggtttccgtcctttaggaagaccctggaacgtgccagttgattctgacaatttctcatgaacagaaacacctaggaagggagaactggacttatttaatggggatgtgttcaaggcaagaccgaattcagaaggatatcgacgtcgtgatccagaagtccagagctgaggactgcctgtttgcaggtgagttcttgcttttccagaacctcggaccccgcgcccccttcccagttctctgaccgcgacgtgtgtggctgggggtggggtggagggtttgcacgtccgcattccggggttcatttggcgacagtgtctgcaacgaacgcgggagcaaaagcgggagggggcgccactacgccccttcccctcaccccacccccaagtctggggcagctactagctttgagggcagaacccgcgtggcccgagcgggggtctaggcgaaggggcagtgcgtggtatttc

SEQ ID NO: 409832 - DNA, 488 bp, Homo sapiens
gttttggatgggatgcatgacatacaggtagctctcttttttaaaatataggtatctctttgcatatatatacacaacatgtcacaatattttatatatattacatagtatttacaacaaagccccttccatagtatttactatgtaatatatataaaatattgtgacatgttttggatgggatgcatgacatacaggtagctctcttttttaaaatataggtatctctttgcatatatatacacaaggaaagttgaattttcaggagagatcattctgatatcttgcaaatttgtattaaatgtatacagacttccaagtgtgctaattctttacctcctaaacttttagttgcaattgttttgcagtgtaaaattgtacatgtgttaataatcaaaaagtgttgcatttaatgttatttctgtaaactttgagctttgttaataaactattatgcagcatctacactttgaaaatcaagtacttca

SEQ ID NO: 409833 - DNA, 2540 bp, Homo sapiens
aaaaactactatggctgagaaggaggaaaaattacaaaaggaacaaaaggaattacaagatgtatggacagtctcttcgcacattcaacagcagcaagcaggtcatgccaaattcaccaagcacacaattagaagcctcacagcttcaacaaacaccttgcacacaacagccaaacaacgttctcaacacacacataatgcaaacagttcaatccactgtggcttcaccatcaaagcaactaaatgaaaatcagctagtgagaaagcaagatgtattgggaccttctactactccgcctgcacattccagcagcaacacaatcagaagtggaatttctcctaacctgaatgtggttgatggtagactgacttacccaacctgtgggattggttatcctgtctcctctgcatttgcattccagaataccttccctcattcgatatctgccaaaaataccagccaccctggttcaggaacaaaggttcagtttaatttgcagtttacaaaaccaaatgcatcactaggagatgttcagtcaggagcaactattagtatgccttgctcaactgataaggaaaatggtgaaaatgtagggttggaatccaaatacctgaagaaaagggaagatagcattcctttacgcggactcagccagaacctatttagtaattcagaccatcagagagatggcactttaggagcattacatacatcttccaaacccacagcgctcccctctgcgtcttcagcctatttccctgggcagttaccaaacagttaattctagtgtcatgttttactttttattggtattttagaaactcaggtgcttaaaaaatatgtcaacacaaaccagatcctcaaatagcaagtttcaaattttacttgagctgttaaagactggatactttaagtactgcttttatggcagtttataatataggaacaaatttgtacttggggattggtaaagattgtgagtaaatgacattttttggtttgtgaacatggcgttttatagaataatatgaattttattaagctattctttagaaattcagttctaaggaaagagttgatccttatgagggagattctgatcatattaaaaatctgggtaaactaaaacctgctcataacctcatagtatgcaaccaaagaatactaattcattttatcactttcattggtaaaacttttaaattcaacacctgaaaatcatgagggaaaatgattacctcttgagatatattattgatgacatttaaagggaaaagtcctaaatttaccttaaataactgaaatgaattaagccttcatagcgtattttccttgaagcatttaaatttgctagtgatgaatcaaataaatttgatatacttaaaataatttggacagtttttatgtgaccagattaagtgcttttgtcatttgagctgacaagtttttaaaacttcagtgcttcctaaatgtttatactcatctagtttttctcaattgtagttttattatgcagttaaatctgtatcagtggacttttaaaacttggtactactactaaatctactatatcatgaatattcatttatttttatagtatcagaacttgggttgatttcaatgttaataaactaggcaaaacaaataactgttagaaggtacaattttcttctcttccctgtaactgaaagttttaagaattgttccttggggaaaaatttttttaaaattcacctagaatcatagggcctcattttgttttcttattgacaaacaatacctggtagcattctctaaagagtcttctagatcaatttttataaagtactaatgctcatgtgataatttaaaattattttcaactactttattacacagatgaagaaacatttcaagatattgatgtaataacattactgagtcccatggtaagaaagaatctttgctaatttttttttttttttttacgaagccagtatcttgaaactattggcaattgcaagtgtctttaaactagggatctaatctgaaaattcagtaactaatattaggcagttgatactcccccacctcccccatttagatacactactgtattagtgagaatacttggtacagtaacttgaaagcacttgctattctggaaagaagcctcttggtgattttggaaggagctttattgtaaatactatggaaggggctttgttgtaaatactatgtaatatatataaaatattgtgacatgttttggatgggatgcatgacatacaggtagctctcttttttaaaatataggtatctctttgcatatatatacacaaggaaagttgaattttcaggagagatcattctgatatcttgcaaatttgtattaaatgtatacagacttccaagtgtgctaattctttacctcctaaacttttagttgcaattgttttgcagtgtaaaattgtacatgtgttaataatcaaaaagtgttgcatttaatgttatttctgtaaactttgagctttgttaataaactattatgcagcatcta

SEQ ID NO: 409834 - DNA, 2442 bp, Homo sapiens
aaaaactactatggctgagaaggaggaaaaattacaaaaggaacaaaaggaattacaagatgtatggacagtctcttcgcacattcaacagcagcaagcaggtcatgccaaattcaccaagcacacaattagaagcctcacagcttcaacaaacaccttgcacacaacagccaaacaacgttctcaacacacacataatgcaaacagttcaatccactgtggcttcaccatcaaagcaactaaatgaaaatcagctagtgagaaagcaagatgtattgggaccttctactactccgcctgcacattccagcagcaacacaatcagaagtggaatttctcctaacctgaatgtggttgatggtagactgacttacccaacctgtgggattggttatcctgtctcctctgcatttgcattccagaataccttccctcattcgatatctgccaaaaataccagccaccctggttcaggaacaaagtggtgaaaatgtagggttggaatccaaatacctgaagaaaagggaagatagcattcctttacgcggactcagccagaacctatttagtaattcagaccatcagagagatggcactttaggagcattacatacatcttccaaacccacagcgctcccctctgcgtcttcagcctatttccctgggcagttaccaaacagttaattctagtgtcatgttttactttttattggtattttagaaactcaggtgcttaaaaaatatgtcaacacaaaccagatcctcaaatagcaagtttcaaattttacttgagctgttaaagactggatactttaagtactgcttttatggcagtttataatataggaacaaatttgtacttggggattggtaaagattgtgagtaaatgacattttttggtttgtgaacatggcgttttatagaataatatgaattttattaagctattctttagaaattcagttctaaggaaagagttgatccttatgagggagattctgatcatattaaaaatctgggtaaactaaaacctgctcataacctcatagtatgcaaccaaagaatactaattcattttatcactttcattggtaaaacttttaaattcaacacctgaaaatcatgagggaaaatgattacctcttgagatatattattgatgacatttaaagggaaaagtcctaaatttaccttaaataactgaaatgaattaagccttcatagcgtattttccttgaagcatttaaatttgctagtgatgaatcaaataaatttgatatacttaaaataatttggacagtttttatgtgaccagattaagtgcttttgtcatttgagctgacaagtttttaaaacttcagtgcttcctaaatgtttatactcatctagtttttctcaattgtagttttattatgcagttaaatctgtatcagtggacttttaaaacttggtactactactaaatctactatatcatgaatattcatttatttttatagtatcagaacttgggttgatttcaatgttaataaactaggcaaaacaaataactgttagaaggtacaattttcttctcttccctgtaactgaaagttttaagaattgttccttggggaaaaatttttttaaaattcacctagaatcatagggcctcattttgttttcttattgacaaacaatacctggtagcattctctaaagagtcttctagatcaatttttataaagtactaatgctcatgtgataatttaaaattattttcaactactttattacacagatgaagaaacatttcaagatattgatgtaataacattactgagtcccatggtaagaaagaatctttgctaatttttttttttttttttacgaagccagtatcttgaaactattggcaattgcaagtgtctttaaactagggatctaatctgaaaattcagtaactaatattaggcagttgatactcccccacctcccccatttagatacactactgtattagtgagaatacttggtacagtaacttgaaagcacttgctattctggaaagaagcctcttggtgattttggaaggagctttattgtaaatactatggaaggggctttgttgtaaatactatgtaatatatataaaatattgtgacatgttttggatgggatgcatgacatacaggtagctctcttttttaaaatataggtatctctttgcatatatatacacaaggaaagttgaattttcaggagagatcattctgatatcttgcaaatttgtattaaatgtatacagacttccaagtgtgctaattctttacctcctaaacttttagttgcaattgttttgcagtgtaaaattgtacatgtgttaataatcaaaaagtgttgcatttaatgttatttctgtaaactttgagctttgttaataaactattatgcagcatcta

SEQ ID NO: 409835 - DNA, 2893 bp, Homo sapiens
  misc_feature (2692)..(2692): n is a, c, g, or t
aaaaactactatggctgagaaggaggaaaaattacaaaaggaacaaaaggaattacaagatgtatggacagtctcttcgcacattcaacagcagcaagcaggtcatgccaaattcaccaagcacacaattagaagcctcacagcttcaacaaacaccttgcacacaacagccaaacaacgttctcaacacacacataatgcaaacagttcaatccactgtggcttcaccatcaaagcaactaaatgaaaatcagctagtgagaaagcaagatgtattgggaccttctactactccgcctgcacattccagcagcaacacaatcagaagtggaatttctcctaacctgaatgtggttgatggtagactgacttacccaacctgtgggattggttatcctgtctcctctgcatttgcattccagaataccttccctcattcgatatctgccaaaaataccagccaccctggttcaggaacaaagtggtgaaaatgtagggttggaatccaaatacctgaagaaaagggaagatagcattcctttacgcggactcagccagaacctatttagtaattcagaccatcagagagatggcactttaggagcattacatacatcttccaaacccacagcgctcccctctgcgtcttcagcctatttccctgggcagttaccaaacagttaattctagtgtcatgttttactttttattggtattttagaaactcaggtgcttaaaaaatatgtcaacacaaaccagatcctcaaatagcaagtttcaaattttacttgagctgttaaagactggatactttaagtactgcttttatggcagtttataatataggaacaaatttgtacttggggattggtaaagattgtgagtaaatgacattttttggtttgtgaacatggcgttttatagaataatatgaattttattaagctattctttagaaattcagttctaaggaaagagttgatccttatgagggagattctgatcatattaaaaatctgggtaaactaaaacctgctcataacctcatagtatgcaaccaaagaatactaattcattttatcactttcattggtaaaacttttaaattcaacacctgaaaatcatgagggaaaatgattacctcttgagatatattattgatgacatttaaagggaaaagtcctaaatttaccttaaataactgaaatgaattaagccttcatagcgtattttccttgaagcatttaaatttgctagtgatgaatcaaataaatttgatatacttaaaataatttggacagtttttatgtgaccagattaagtgcttttgtcatttgagctgacaagtttttaaaacttcagtgcttcctaaatgtttatactcatctagtttttctcaattgtagttttattatgcagttaaatctgtatcagtggacttttaaaacttggtactactactaaatctactatatcatgaatattcatttatttttatagtatcagaacttgggttgatttcaatgttaataaactaggcaaaacaaataactgttagaaggtacaattttcttctcttccctgtaactgaaagttttaagaattgttccttggggaaaaatttttttaaaattcacctagaatcatagggcctcattttgttttcttattgacaaacaatacctggtagcattctctaaagagtcttctagatcaatttttataaagtactaatgctcatgtgataatttaaaattattttcaactactttattacacagatgaagaaacatttcaagatattgatgtaataacattactgagtcccatggtaagaaagaatctttgctaatttttttttttttttttacgaagccagtatcttgaaactattggcaattgcaagtgtctttaaactagggatctaatctgaaaattcagtaactaatattaggcagttgatactcccccacctcccccatttagatacactactgtattagtgagaatacttggtacagtaacttgaaagcacttgctattctggaaagaagcctcttggtgattttggaaggagctttattgtaaatactatggaaggggctttgttgtaaatactatgtaatatatataaaatattgtgacatgttttggatgggatgcatgacatacaggtagctctcttttttaaaatataggtatctctttgcatatatatacacaaggaaagttgaattttcaggagagatcattctgatatcttgcaaatttgtattaaatgtatacagacttccaagtgtgctaattctttacctcctaaacttttagttgcaattgttttgcagtgtaaaattgtacatgtgttaataatcaaaaagtgttgcatttaatgttatttctgtaaactttgagctttgttaataaactattatgcagcatctaaaaaaaaaaaaaaaaaaaaaaaaaaaaaaaaaaaaaaaaaaaaaaaaaaaaaaaaaaaaaaaaaaaaaacccttggtgggccgcttgggccaagtcatttttaaactggaccaggtttttgcttgcggccgaatttgggcctaattgggccaattccccttatagggagccgattaacaataaatgggccgcggtttaaaaacgtcggaacgggaaaaccccgggggtacccacattaaatcgccggggngaaaatccctttttcgccagttggcgaaataccaaaaaggccccaaccaatcccctttcaaacattgcccaccctaatgggaatggaaaattgaaacctaaatttttggtaaaatccccgtaaatttggaaaacagctatttttaacccaaaggcgaaacggaaaaccctaatataacccgggggtgggggttcccacttg

SEQ ID NO: 409836 - DNA, 1931 bp, Homo sapiens
aaaaactactatggctgagaaggaggaaaaattacaaaaggaacaaaaggaattacaagatgtatggacagtctcttcgcacattcaacagcagcaagcaggtcatgccaaattcaccaagcacacaattagaagcctcacagcttcaacaaacaccttgcacacaacagccaaacaacgttctcaacacacacataatgcaaacagttcaatccactgtggcttcaccatcaaagcaactaaatgaaaatcagctagtgagaaagcaagatgtattgggaccttctactactccgcctgcacattccagcagcaacacaatcagaagtggaatttctcctaacctgaatgtggttgatggtagactgacttacccaacctgtgggattggttatcctgtctcctctgcatttgcattccagaataccttccctcattcgatatctgccaaaaataccagccaccctggttcaggaacaaagtggtgaaaatgtagggttggaatccaaatacctgaagaaaagggaagatagcattcctttacgcggactcagccagaacctatttagtaattcagaccatcagagagatggcactttaggagcattacatacatcttccaaacccacagcgctcccctctgcgtcttcagcctatttccctgggcagttaccaaacagttaattctagtgtcatgttttactttttattggtattttagaaactcaggtgcttaaaaaatatgtcaacacaaaccagatcctcaaatagcaagtttcaaattttacttgagctgttaaagactggatactttaagtactgcttttatggcagtttataatataggaacaaatttgtacttggggattggtaaagattgtgagtaaatgacattttttggtttgtgaacatggcgttttatagaataatatgaattttattaagctattctttagaaattcagttctaaggaaagagttgatccttatgagggagattctgatcatattaaaaatctgggtaaactaaaacctgctcataacctcatagtatgcaaccaaagaatactaattcattttatcactttcattggtaaaacttttaaattcaacacctgaaaatcatgagggaaaatgattacctcttgagatatattattgatgacatttaaagggaaaagtcctaaatttaccttaaataactgaaatgaattaagccttcatagcgtattttccttgaagcatttaaatttgctagtgatgaatcaaataaatttgatatacttaaaataatttggacagtttttatgtgaccagattaagtgcttttgtcatttgagctgacaagtttttaaaacttcagtgcttcctaaatgtttatactcatctagtttttctcaattgtagttttattatgcagttaaatctgtatcagtggacttttaaaacttggtactactactaaatctactatatcatgaatattcatttatttttatagtatcagaacttgggttgatttcaatgttaataaactaggcaaaacaaataactgttagaaggtacaattttcttctcttccctgtaactgaaagttttaagaattgttccttggggaaaaatttttttaaaattcacctagaatcatagggcctcattttgttttcttattgacaaacaatacctggtagcattctctaaagagtcttctagatcaatttttataaagtactaatgctcatgtgataatttaaaattattttcaactactttattacacagatgaagaaacatttcaagatattgatgtaataacattactgagtcccatgtgggcagcaagagaaccgctggaatgcatcaaatgaaaaggcaattccaggcaactggaaaaataaacagcagctaccatttttacagcctatatgtact

SEQ ID NO: 409837 - DNA, 733 bp, Homo sapiens
ctcttcactgggcggctcacttttaatctgccccctggcaagccccggcttgaggctgttgctagagttatcttcccggaatgtgcttgcaaaacctgaggtactgtgtgatgatgcattatagacattcttggtacatgcaagctggtatttcttgtatctggggtactgcgttaacgcgtccttttctgagctctccttggtgtctgtgggcacgtcaggctcgggcagcagggcttcttccttctctgctacggggatggcggcggcctcaaagctgatgggctctggaagcatctggtccctggggcaagccatcttggccgtctctgaatccatcgtctcctcctcttcatcctcctcctctcctgcagagttctcgcagtcctcgtgtgggcgctggcacgcagcatccttccggcacacaaacaggccatcctcactgttcaggagctgggtctgcaggaagctgaagcaggagtcctccaggttgtgcatgcgcaggaactcagcacagcggatgacctcgcggatgttttctctgctgagtaacagcttggcagtgtaggcaaactgtaacagcggcccaaagcccctggctgtgacctgcaaaacaaacagggaaatcgccaacattaccatcagcactgctattgtcccgaatccctcaactgaagcaagataaccagacagtgctaatgtcccagaataaagactgcaaaggggcagttaa

SEQ ID NO: 409838 - DNA, 207 bp, Homo sapiens
atcaaatatcaagtgcttttctaggacagaagtggttaatgtggaatcaccttcagcatcctgcctctgtggatggggaaggcagtctctctactgtcatctttaatcttagcacgtaagaacaatgtgggagtggtggggggcagggagtagtccagataaagggcctagagagtgggtcacatgcttgaatttatgtgggttccc

SEQ ID NO: 409839 - DNA, 496 bp, Homo sapiens
atatgaggtatcagaagaacatggctttggagacaacaatacggtttaaattccaactcacctcactagccatgtgacttttgggcaagtttcttagctcctctgagccttgtatttagaaatctgtagaatggagagaatcatacccatcacaaagggttattgtgaagatgaaacaagatcatgtatggaaagacttgagcacaattgaccgacatgtagttggtattccctaactgttagaaccagagagtagagtgggtcagatcgtgggctctgggtctgaatttgcatttgtgcttttccacttctagccaagtgagctgggacaaattccctcattttctgtatatctgtttctgcatctataaaactggcattaatagtacccaccttattaggacagtctgaagattaagtgagttaatatatacagcacttagaatactgcctgttatgtaataagttttatataagtggcagccactgttctctc

SEQ ID NO: 409840 - DNA, 363 bp, Homo sapiens
ctggactcaagcaatctgtcagacttggcctcccaaagtgctgggattataggcgtgagccaccacccccggccacctttgtcttagtgaatgctattaagttgttaggttagtgatgtagtcatacaacttttttttttttttgagatggattttccctcttgtcattcaggctggagtgcagtggcgtgatcttggctcactgcagcctccgcctcctgggctcaagtgattctcctgcctcagcctcccgagtagctgagactacagacttgggccatcatgcttggctaatttttgtatttttagtagagacagagtttcaccatattagccaggctggtcttcaactcctgacctcag

SEQ ID NO: 409841 - DNA, 332 bp, Homo sapiens
gcctactactactaaattcgcggccgcgtcgacgagtaattagctatagattccactggccttaaacatacaattaagtgtatacatgatatagtgcacacacaaaagccacctttaattattgaaataacctgtattctttttggaaatcatttaagtttggtattgaagtactatattttttgtgcatcaatgtatttttctatttacaagcctatgtaaaagtgaagtgtatcttcagtgaaccatgtgccaattaagctgtaataaaaaagtggtctagtctgtcaaaaaaaaaaaagtcgacgcggccgcgaatttagtagtagtag

SEQ ID NO: 409842 - DNA, 565 bp, Homo sapiens
gtgagccgagattgcgccactgcactccagcctgggcgacagaggagactctgtctcaaaaaaaaaaaaaaaaaaaaagagcagggtcataatcacacagcagtgccttatatagttgccataagacttcagtgcagtacaacataattttacagctacatatcagggcatattctatatggtgtatttgtgttagaataacacattaaatgtctttaaacataaaaataagaatgtttgcatgtttcagttttcaagaaccaaatgagtaattagctatagattccactggccttaaacatacaattaagtgtatacatgatatagtgcacacacaaaagccacctttaattattgaaataacctgtattctttttggaaatcatttaagtttggtattgaagtactatattttttgtgcatcaatgtatttttctatttacaagcctatgtaaaagtgaagtgtatcttcagtgaaccatgtgccaattaagctgtaataaaaaagtggtctagtctgtcaaaaaaaaaaaagtcgacgcggccgcgaatttagtagtagtag

SEQ ID NO: 409843 - DNA, 185 bp, Homo sapiens
tcactctaatttgtttaaagtttggataagttattgtcatgtattgaattctaagtcttactttaggcttctttctgaataacaatatttaaattgctttgacgcttatttttcctacaggatattatgtaagtcattccttcaagatgaatcctttaaaccaagtattcaggggcccgtcgacg

SEQ ID NO: 409844 - DNA, 523 bp, Homo sapiens
actcaaggcactgatttctgcatcttcagcctcctcatttcattaactattaaaattaattccctgtagagataatttgcatcaatcaacagaatagaagaattagaagagcttctgaggcttttctatgactaaaagagcaattcttttattgactaccataaacattagatttactaaaaggaaaaggtgttttaaattgaaccacccctctaatttattcatcttagttctgaaaacatgtaggtaagagttaatcatgttactgaatctaatttaaaaagtgagagggaaagtactgaatatttttcctctttgaaattacatgttgtttgcaatattagcctgcctgtatttttcatgtaaaccttttgtacattgaaaacaaattcaaaataaagaacgtttgttttcaggctcagaccttaagaactgatggtcttttcttttacttctacacaaaagtctaagcagttctgaagaaacactacagtgacattgggtcattgctaaaaaaaaaaaa

SEQ ID NO: 409845 - DNA, 442 bp, Homo sapiens
atgccactctcgtcgacaaaaccctttaatcctcatcatgtacaggatgtaagatccaaactccttgtaaagggcgtatgaaatcctctgcgatctgctccttgtctactcttggatcttgtccttagtaactccaaggcctcacactggatgcctcagctatctcagactacttccctgagatatcaagtaacatcggttggcaagaaagcaagaaaagttatctgccttcctagctaaccagaatctgttcaagaatctgctttccttcagggaaatcttcctgactgtcccctaagctagggtaggtttttttcctttatgctcctgtagaagtgtactgttaacatttatttcagacacaggacttcaccacacaagatttaggttattttaggttaagtatctctccattaggaccataagctgcttaaggttagga

SEQ ID NO: 409846 - DNA, 338 bp, Homo sapiens
ttttttggtatactatgtgagagctgctttggagcaagctcagtgtttagcttatcttttttgtttaccttttattaaaaaaatcacaacccaatttgttaagtcctcataagacatttgctgaattaatggtattttatgtacccacataggcttttcttctttgtgccatagcaatagttcctgagtacgtatcatatgcaaggcatcaatacgaggatgaatgagacaagcaatgtccctaacctggtagaggctgactgcaaacaaacaatacatgagtaaaaatacaaacaatcattcttaagaaggcagacaacagtgtgctattatagaac

SEQ ID NO: 409847 - DNA, 337 bp, Homo sapiens
tttttttagtagaaaaacacttaggatttattgtaagagaaatggacagaaaacagacagaccaattgcaaagtaattgaaagtccagtggtaaaattgcaggggttgaggcctccaatctttgtgacattgtgaaattttattctcaaagcctagatctttgagacacggtaggggaaaatgatgatgatgacacaagtttctaatctggccaacgtaaaaaatagaaaagtgagtgagctgctggtttgtggggaagatgatgtggttgggaccaataaaatctggctatctattatcctccttagattgtggaactgaaagacaagctgtagtg

SEQ ID NO: 409848 - DNA, 427 bp, Homo sapiens
tttttttgttttttggagacagggtcttgcttggtagcccaggctggagtgcagtggcatgatcttggctcacaggaacttctgcctcccaggttcaagtgatcctcctgcctcagcctcccaagtagctgagattacaggcgcccaccaccacacctggctaatttttgtattttcagtggagacatggtttcaccatgttggccaggctggtctggaactcctgacctccagtgatctgcctgccttggcctcccaaagtgctgagattacaggcgtgggtcaccacacctggcctgttcacttctatacaacaaatatttcatgagcttccaccatgtgccagagtgttgggtgctaaaaatacatgaggcactgataaaatggcctgtgactttgtcacctcagctacaggccaccctatatg

SEQ ID NO: 409849 - DNA, 456 bp, Homo sapiens
  misc_feature (19)..(19): n is a, c, g, or t
  misc_feature (21)..(21): n is a, c, g, or t
  misc_feature (37)..(37): n is a, c, g, or t
  misc_feature (41)..(41): n is a, c, g, or t
  misc_feature (45)..(45): n is a, c, g, or t
  misc_feature (56)..(56): n is a, c, g, or t
  misc_feature (63)..(63): n is a, c, g, or t
  misc_feature (65)..(66): n is a, c, g, or t
  misc_feature (70)..(70): n is a, c, g, or t
ccccgttgttcccgccccntngggggcccaagcccgngggnccanccaggccccgngatccgngnnccgnttcccaaaaaaaaaaaaaaaggaatttacatagttgaacaactattctttggacatcttttagtccagtagacggtgttaaacttgaagacaaataacgatttgacctgtgatatttgtttttccctcttatcttctaagcccattcatccagatcattcatcacctttaaaggcatccccagagggaggcaggtctggacagagctgaagattgcacaggccatttgcaggctggattagttctgtggtgacccacctgtctgactcgagttatttttttcccatgtctggacaagactgacctctgcccagcaactcaggcctggatttagtccaagggccctcagtggcttttttttctaataaattggggccgagctcgatt

SEQ ID NO: 409850 - DNA, 1300 bp, Homo sapiens
aacccctatccctggtcgctttccctggggccagaacaatccctttgccctgggccccgggcccaaatccgtgccccgtttccaaaaaaaaaaaaaaaggaatttacatagttgaacaactattctttggacatcttttagtccagtagacggtgttaaacttgaagacaaataacgatttgacctgtgatatttgtttttccctcttatcttctaagcccattcatccagatcattcatcacctttaaaggcatccccagagggaggcaggtctggacagagctgaagattgcacaggccatttgcaggctggattagttctgtggtgacccacctgtctgactcgagttatttttttcccatgtctggacaagactgacctctgcccagcaactcaggcctggatttagtccaagggccctcagtggcttttttgtttgtttgttttttcaggaagtgaagaatttagagggataaaaggcggaaataacttttcagcctctgacctttgtaacaatctagtttccttttaaaggagcattgtttgggcctggggccacctagaccttctgatgctctttccccacccttggaggaggaggaaaggaagaaaatgggccctgagcgatcaccacataccaggccctgggggtctagtggcgaaggaggcaggtagggtctcttgctttcatggagcttctagtcaagcgagacgcactaaacagtaaagggacaaataggattactggaggtagccctaactactgggacagaaacaagatggtaagatagagaaggaagagtggcctgctcagatggggtggtccagaggcctctcgggggaggtgactcctttttattttattttttttgagatggaatctagctctgtcgcccagcctgaagtgcagtcgtgtgtttcatgcgcgtccgtgtgaagagaccaccaaacaggctttgtgtgagcaacatggctgtttatttcacctgggtgcaggcgggctgagtccgaaaagagagtcagcaaagggtggtggattatcattagttcttacaggttttgggatagggggtgaagagccatgttttgcaggcaggggtggatctcacaaagtacattctcaagggtggggagaattacaaagaaccttcttaagggttggggagattacaaagtaccttcttaagggtgggggagattacaaagtacattgaagagttagggtggggcagaaacaaatcacaatggtggaatgtcatcagttaaggctatttttacttcttgtgtggatcttcagt

SEQ ID NO: 409851 - DNA, 887 bp, Homo sapiens
aacccctatccctggtcgctttccctggggccagaacaatccctttgccctgggccccgggcccaaatccgtgccccgtttccaaaaaaaaaaaaaaaggaatttacatagttgaacaactattctttggacatcttttagtccagtagacggtgttaaacttgaagacaaataacgatttgacctgtgatatttgtttttccctcttatcttctaagcccattcatccagatcattcatcacctttaaaggcatccccagagggaggcaggtctggacagagctgaagattgcacaggccatttgcaggctggattagttctgtggtgacccacctgtctgactcgagttatttttttcccatgtctggacaagactgacctctgcccagcaactcaggcctggatttagtccaagggccctcagtggcttttttgtttgtttgttttttcaggaagtgaagaatttagagggataaaaggcggaaataacttttcagcctctgacctttgtaacaatctagtttccttttaaaggagcattgtttgggcctggggccacctagaccttctgatgctctttccccacccttggaggaggaggaaaggaagaaaatgggccctgagcgatcaccacataccaggccctgggggtctagtggcgaaggaggcaggtagggtctcttgctttcatggagcttctagtcaagcgagacgcactaaacagtaaagggacaaataggattactggaggtagccctaactactgggcgacagaatgagactccatctcaaaaaaaaaaaagaaaccaaggatatagaataaaacaagagtgtagatttgggcattgaggccttcaaattggattgttctcaatgtccagaaga

SEQ ID NO: 409852 - DNA, 966 bp, Homo sapiens
aacccctatccctggtcgctttccctggggccagaacaatccctttgccctgggccccgggcccaaatccgtgccccgtttccaaaaaaaaaaaaaaaggaatttacatagttgaacaactattctttggacatcttttagtccagtagacggtgttaaacttgaagacaaataacgatttgacctgtgatatttgtttttccctcttatcttctaagcccattcatccagatcattcatcacctttaaaggcatccccagagggaggcaggtctggacagagctgaagattgcacaggccatttgcaggctggattagttctgtggtgacccacctgtctgactcgagttatttttttcccatgtctggacaagactgacctctgcccagcaactcaggcctggatttagtccaagggccctcagtggcttttttgtttgtttgttttttcaggaagtgaagaatttagagggataaaaggcggaaataacttttcagcctctgacctttgtaacaatctagtttccttttaaaggagcattgtttgggcctggggccacctagaccttctgatgctctttccccacccttggaggaggaggaaaggaagaaaatgggccctgagcgatcaccacataccaggccctgggggtctagtggcgaaggaggcaggtagggtctcttgctttcatggagcttctagtcaagcgagacgcactaaacagtaaagggacaaataggattactggaggtagccctaactactgggacagaaacaagatggtaagatagagaaggaagagtggcctgctcagatggggtggtccagaggcctctcgggggaggtgactcctttttattttattttttttgagatggaatctagctctgtcgcccagcctgaagtgcagtcgtgtgtttcatgcgcgtccaggtgaaataaacagctttattgctcacaaaaa

SEQ ID NO: 409853 - DNA, 497 bp, Homo sapiens
  misc_feature (78)..(78): n is a, c, g, or t
taatattctcatatgctattaatacttcttagtccttcctttaatatggtatgacatacatggagatcaaaagaagtngaattttgcctcccatccctcctcagggctgcctagggcagctacaaaaaccaggccagcctctgaaaggtgctccacatctcattaaaaaccgtgaaatcgcactgccccactatcagaatagctcagaggagaaggtctgccagtaccaagtgctggtggggatacggagaagagcagctcccaggcgctgctggtgcaaatgtgctttgttgcacccacggcaggaaactgaccagcttctcatcaagttaaatacgcatctaccctatggcctagcatttccactcttgcttacacatccaggagaaatgagtccttacatgcacaaaaggatgagtaccgtaatactcacatcagcaaataaacaatacagctgtgtgtcagtagtagaatgaataaattgtggtcgattcata

SEQ ID NO: 409854 - DNA, 1518 bp, Homo sapiens
ccagcgggctcgggagccttaacctggctggctgtgctgattatggttgcatggggctgggaagaggtcccatttctgagccacagaaacaggccacatccagtaggggtcctggaaggctgtgagaacccagaggagaccctgacccagcctgcaggtagaagactgcctttggaggcagctttgaaagatgactcttccagatggaagaatcaggaagggccttcccacgtggaggcaccagcaggagcaaacgtccctggtgtgttcaggcaaagagccacaggagagtgacctcgtggagtgggaagagattgtttcccattcccttgccagggattggttgaggaatggacaaggcttgcagttcacgcaagccagtgaaatgcgagggtgaagtcttgggagtggggtggaggaggtcatctgggaagggtgtccttggtcttaaaaagaggcacaagaggccgggcgcggtggctcttgcctattatcctagcactttgggaggccaaggcagggggatcacttgaggtcaggagttcgagaccagcctggccaacatggtgaaaccccgtctctactaaaaatacaaaaaattagccagacgtggtgccaagcacctgtaatcccagctactcaggaggctgaggcaggagaatcacttgaacccaggaggcagaagttgcagtgagccaagatcgcgccactgcactccagcctgtgtgacaagggcgaaactccatctcaaaaaaaaagggggagggtggcgcaaggagaggacacctctctcctggccctgtcgccatcttccctcatcaatagctaaaaatggcaaagaagaaagagccaggaccccgtgccatcaaatcctccggccttgtgctgccctgtctcggcactgcttgccttaggagatcaggagtgttcctagccactgggagatgggatgcctgccactggcagctctgccgtccatcctcaccatcccaccgtccccccaagacagctctccatcccatcctctgcctcccttctagcctcaacctaactcagggctcccccgtctcacacctgggttgcaggaacatcctcttcaccaacccccctcccatccctcctcagggctgcctagggcagctacaaaaaccaggccagcctctgaaaggtgctccacatctcattaaaaaccgtgaaatcgcactgccccactatcagaatagctcagaggagaaggtctgccagtaccaagtgctggtggggatacggagaagagcagctcccaggcgctgctggtgcaaatgtgctttgttgcacccacggcaggaaactgaccagcttctcatcaagttaaatacgcatctaccctatggcctagcatttccactcttgcttacacatccaggagaaatgagtccttacatgcacaaaaggatgagtaccgtaatactcacatcagcaaataaacaatacagctgtgtgtcagtagtagaatgaataaattgtggtcgattcata

SEQ ID NO: 409855 - DNA, 687 bp, Homo sapiens
tggcccgcggtcgggtgggatcctagccctgtctcctctcctgggaaggagtgagggtgggacgtgacttagacacctacaaatctatttaccaaagaggagcccgggactgagggaaaaggccaaagagtgtgagtgcatgcggactgggggttcaggggaagaggacgaggaggaggaagatgaggtcgatttcctgatttaaaaaatcgtccaagccccgtggtccagcttaaggtcctcggttacatgcgccgctcagagcaggtcactttctgccttccacgtcctccttcaaggaagccccatgtgggtagctttcaatatcgcaggttcttactcctctgcctctataagctcaaacccaccaacgatcgggcaagtaaaccccctccctcgccgacttcggaactggcgagagttcagcgcagatgggcctgtggggagggggcaagatagatgagggggagcggcatggtgcggggtgaccccttggagagaggaaaaaggccacaagaggggctgccaccgccactaacggagatggccctggtagagacctttgggggtctggaacctctggactccccatgctctaactcccacactctgctatcagaaacttaaacttgaggattttctctgtttttcactcgcaataaattcagagcaaacaaaaaaaaaaaa

SEQ ID NO: 409856 - DNA, 614 bp, Homo sapiens
tggcccgcggtcgggtgggatcctagccctgtctcctctcctgggaaggagtgagggtgggacgtgacttagacacctacaaatctatttaccaaagaggagcccgggactgagggaaaaggccaaagagtgtgagtgcatgcggactgggggttcaggggaagaggacgaggaggaggaagatgaggtcgatttcctgatttaaaaaatcgtccaagccccgtggtccagcttaaggtcctcggttacatgcgccgctcagagcaggtcactttctgccttccacgtcctccttcaaggaagccccatgtgggtagctttcaatatcgcaggttcttactcctctgcctctataagctcaaacccaccaacgatcgggcaaatagatgagggggagcggcatggtgcggggtgaccccttggagagaggaaaaaggccacaagaggggctgccaccgccactaacggagatggccctggtagagacctttgggggtctggaacctctggactccccatgctctaactcccacactctgctatcagaaacttaaacttgaggattttctctgtttttcactcgcaataaattcagagcaaacaaaaaaaaaaaa

SEQ ID NO: 409857 - DNA, 330 bp, Homo sapiens
ttagaccgtgcacttttttttccaatcacgtctctgtacacggttgtcagtcatgcctgtgtaacgaagtcttcataaaatcccaagaggatagggttcagggaacctctggacagctgaccaggtggagcttcctggagggtggtgtacccagggagggcatggaagccccttgccccttcccccagcctcaccatacacatcccttcatctgtatcttttgtaatatcttctataatgaatcatttgagcctaggaggtcgtggctacagtgagccgtgattgtgccactatactctagactagacaacagagcaagaccctatctca

SEQ ID NO: 409858 - DNA, 1212 bp, Homo sapiens
  misc_feature (1)..(1): n is a, c, g, or t
  misc_feature (4)..(6): n is a, c, g, or t
  misc_feature (8)..(8): n is a, c, g, or t
ngcnnngncgattcaggggagggagcaactggagcctcaggccctccagagtagtctgcctgaccaccctggagcccacagaagcccaggacgtctcccgcgaggcctccccgtgtgtggctgaggatggctgagcagcagggccgggagcttgaggctgagtgccccgtctgctggaaccccttcaacaacacgttccatacccccaaaatgctggattgctgccactccttctgcgtggaatgtctggcccacctcagccttgtgactccagcccggcgccgcctgctgtgcccactctgtcgccagcccacagtgctggcctcagggcagcctgtcactgacttgcccacggacactgccatgctcgccctgctccgcctggagccccaccatgtcatcctggaaggccatcagctgtgcctcaaggaccagcccaagagccgctacttcctgcgccagcctcaagtctacacgctggaccttggcccccagcctgggggccagactgggccgcccccagacacggcctctgccaccgtgtctacgcccatcctcatccccagccaccactctttgagggagtgtttccgcaaccctcagttccgcatctttgcctacctgatggccgtcatcctcagtgtcactctgttgctcatattctccatcttttggaccaagcagttcctttggggtgtggggtgagtgctgttcccagacaagaaaccaaacctttttcggttgctgctgggtatggtgactacggagcctcatttggtattgtcttcctttgtagtgttgtttattttacaatccagggattgttcaggccatgtgtttgcttctgggaacaatttaaaaaaaaaacaaaaaaacgaaaagcttgaaggactgggagatgtggagcgacctccgggtgtgagtgtggcgtcatggaagggcagagaagcggttctgaccacagagctccacagcaagttgtgccaaagggctgcacagtggtatccaggaacctgactagcccaaatagcaagttgcatttctcactggagctgcttcaaaatcagtgcatatttttttgagttgctcttttactatgggttgctaaaaaaaaaaaaaaaattgggaagtgagcttcaattctgtgggtaaatgtgtgtttgtttctctttgaatgtcttgccactggttgcagtaaaagtgttctgtatt

SEQ ID NO: 409859 - DNA, 1193 bp, Homo sapiens
tggaaggggaagaggctctggaagggctgatctggggactggggcagggaagcttctgcaaggcttccaggacgtctcccgcgaggcctccccgtgtgtggctgaggatggctgagcagcagggccgggagcttgaggctgagtgccccgtctgctggaaccccttcaacaacacgttccatacccccaaaatgctggattgctgccactccttctgcgtggaatgtctggcccacctcagccttgtgactccagcccggcgccgcctgctgtgcccactctgtcgccagcccacagtgctggcctcagggcagcctgtcactgacttgcccacggacactgccatgctcgccctgctccgcctggagccccaccatgtcatcctggaaggccatcagctgtgcctcaaggaccagcccaagagccgctacttcctgcgccagcctcaagtctacacgctggaccttggcccccagcctgggggccagactgggccgcccccagacacggcctctgccaccgtgtctacgcccatcctcatccccagccaccactctttgagggagtgtttccgcaaccctcagttccgcatctttgcctacctgatggccgtcatcctcagtgtcactctgttgctcatattctccatcttttggaccaagcagttcctttggggtgtggggtgagtgctgttcccagacaagaaaccaaacctttttcggttgctgctgggtatggtgactacggagcctcatttggtattgtcttcctttgtagtgttgtttattttacaatccagggattgttcaggccatgtgtttgcttctgggaacaatttaaaaaaaaaacaaaaaaacgaaaagcttgaaggactgggagatgtggagcgacctccgggtgtgagtgtggcgtcatggaagggcagagaagcggttctgaccacagagctccacagcaagttgtgccaaagggctgcacagtggtatccaggaacctgactagcccaaatagcaagttgcatttctcactggagctgcttcaaaatcagtgcatatttttttgagttgctcttttactatgggttgctaaaaaaaaaaaaaaaattgggaagtgagcttcaattctgtgggtaaatgtgtgtttgtttctctttgaatgtcttgccactggttgcagtaaaagtgttctgtatt

SEQ ID NO: 409860 - DNA, 254 bp, Homo sapiens
atgcctggctatttaaattttttttttttgtagaaacaagatctcactgtgttgcccagtctgttcttgaactcctgagctcaagtgatccttctgcctcagcctcgcaaagtgctaggggtacaggcatgagccaccactcccggccacaatatgggatatattttgattacattttcagcttcagataaatgaagcttaattctgttagggaactttaaggacgatattcctagcatatatatctcagaatt

SEQ ID NO: 409861 - DNA, 450 bp, Homo sapiens
attcagtaaaaaacaagatgttgagaatctttgagtaatattctacaaatccaattatttacattaaaaaatactaaaaataaaaaaaatctgtaatgatgtttgttactctaaaccctgaacctactgatgtttaaactttagagtgtttttagtacagtaggaatattttaggttaaggcattattcttcccaagtcatctagaaaatcttcatcatttattctctacttgacaactaatttttttttttttttttaatattttagtctttaaggacacttgtattaggatctgttgcctccttataaaagttaagtggccaggcacggtggctgacacctgtaatcccagcactttgtgagactgaagcaggaggatcgcttgagcccaggagtttcagaccagcctgggcaacattgtgggactcttctctaccaaaaaaaaaaaa

SEQ ID NO: 409862 - DNA, 1006 bp, Homo sapiens
tttttctgctatctaatggattatgctgctctggaacattcatgtgatgcttttgttaattgcttatacattttattaagctaatgagcttggtcatagtaacatataaaatcaagaatcgtttaacttttgcaataaaaatcttgatgttgactctgaagtagtaagatgcaacttcaatgtactgggattgaggcagccatagcaatattaccacaggttttccaaaaattaacacaaatattttctattctagatgtgatatctttggcatcactgttcattcttttcctccttgattaaagtgaaacaattacattaaaatagttttatgatttaaaaatcattctttttttaagctattatttttaatgtaggtcagtgtgttatgtaaattgatgtccactacctgaacatgtgatgctttctcttttattccttggtatttcctccatattctctgagggccttcagtcaatttttttaaaggaaataataagttcaaatatgtatctatgacttagggttacaaagaatattttctttgcctccagtatactttgtattaaaaaaattataaaaggccataggtattcattttcaaatatttgaaaaaaaaaggcatggcacaattaaagcatatgcagaaccaacttggattattgctatatttctttctttctagtgtgtacggatattgatgacatttttaggtggctcttaacaagaacattttcctctctttagatgtgaatgcatagaaaatatctttcatttggaccaggatcgttttaaaacatttcctttattttttgattaaatttttttccttttaaatattaggacttagttttttattaaatttgaacataatatatttaacatacttacggatacatttttgtgggcatatttctctgacaatttctcttattacaaaccaaacttgttagtgacctgattttgtgtgtgtgtgtgtgtgtgtgtgtgtgtgtgtgtgcgcgca

SEQ ID NO: 409863 - DNA, 477 bp, Homo sapiens
ctctatagcaatgcaagaatggcttaatacatctcccctcccctacatgggacaaggccatctgataattaaccttcctagcaactcaggactaagctcctgaacataaagggagccaaaacaatttgcatttttctatgaggccttctttgaaaggtcttgatgaaaaggggagaaatggggaaaaaaatagcacagagcagtctgagctatgtgaggtgtgccaaagttatcaggcccagagagacaggagagtggggctttttgttttgtttttgtttgagacaacatagtgagagcctgtctttataaaaaattttaaaaaattgtccaggcataagggcatgtgcctgtggtcccagctactgaggcaggctgaggagagaggattgcttgagtctgggaggttgaggctgcagtgagctgtgatcacaccactgcactccagactgggtgacagagtgagaccctgtctca

SEQ ID NO: 409864 - DNA, 286 bp, Homo sapiens
ggaattggtctctttagtacttagatgatcatttcctgagcgtgtgtcccgcagcctgtgagcatgtaactggggaagcacatgtttgtggtcacgtgtcccaaccaaaggtaggagctgacatgaacaggctagtggttgaatgcatgttaaaaatctgtggctggccgggcacggtggctcacgcctgtgatcccagcactttgggaggccgaggtgggtggatcacctgaggtcaggaattcaagagcagcctgaccaacatgtagaaatcctgtctctacta

SEQ ID NO: 409865 - DNA, 419 bp, Homo sapiens
acccgggaggcagaggttgcagtgagccaagattgcaccattgcactccagccagtcacactctgggtgaaagagcaaaattctgcctcaaaaaaaaaaaattgcatttttgccattaaaagcagttgcaaaaaccacaattacttttgaaccaacctaatataatcccagtgctttgggacttcaggagttcaggagttctagaccagcttgagcaacatagtgagaacccatctctacaaagtatacaaaaattagccaggcatggtggtgtatgcctgcagtcccagctattcaggaggctgaggcaggaggatcgcttgagaccaggagtttgaggctgcagtgagctatgattacaccacagcactccagcttgggcaacagtgtgagacgctgtctctaaaacaaaaaaaaag

SEQ ID NO: 409866 - DNA, 183 bp, Homo sapiens
aaaagtacaatcgtctgtaagaatattagtttcccaacatattgactctgctccaggataaaattacctcttgaactccaatagaattgcaacacaactttctttttaattgctttagttctgtgaatatgtggtgaagaaaactacagtaaagtagcatttgttcttaaagtgcaattactg

SEQ ID NO: 409867 - DNA, 815 bp, Homo sapiens
acccctctgtttctcagatcctccacagctgaaaactgtggatcatattagtacctgtgtcatagagttattgtgtgaattaaataaagtgattcatttaaagtgcttagtacagtgcctggtacatagtaagtgctcaataaacagtagcttttttttcttaaccaatttaattaggagctaatggctggcagttcatagcttttttgaataataggcttctcctgataattgaatggatgctgtgaaccctctcccttcatatatggtttcagtcagtccaggggcccttgaaggccacactgggtcagtggaccctagtttaggaagggcacatgaaagagatcagttttactggcccaatttcttaaaataattggcttgtatttagggactactttgtattaaaattggctgatttttgagtgtgagagtctttgtaagatctactttggtcctcccaatacacacacacacacacacacacatatacacacacacactcacactcacacacacacggctagatcatttagttttctttctgagaagaatttttatttcccaggtccgcctccatcatctcctctttggtaatagtcgcagaggttgccataatgagtcatttgttaaactaatctgtgtttccatagtccactgtggccctctgtattgagcttgggccactcaatggcgcctttgtcaggctgattaaaatgtaactttgcatgccaaaaaagggcactcctctggcttaaaagtcatcttcctttgttataaatgtttacatttttctattatgctaaaaaaaaaaa

SEQ ID NO: 409868 - DNA, 414 bp, Homo sapiens
tttgcgaaagtgagtttattaagaaagtaaaggaataaagaatggctattccataggcagagtagcccaggcaccttcttgaccactctgttcatacccactattcagttaaccttgttgctcactgattagggttcacttacaagtattttatacatatattttaagtcattgttatttatatctagatactacacaaaacttttattattatcaaaaccaccacatacttactgggctttttgtgggagtattcacatttctttactgaatctgtttgtagaagggaatcacatccagtctggttttagaagtagggctttgatgtcattagagggaaaggctttggcatctgtcctgagctcagcccagaaagcaaagtaatataccaaaatgaacagagatcccacgttc

SEQ ID NO: 409869 - DNA, 700 bp, Homo sapiens
tttttatatagattgattcgtcttgattacttttgccgggagttgctaaaaacaaagattaggtaataaaaatcagaaataccaatgcatcacagatacatgtacagggactagcagaaaggcacagcctgttgaactacacattgttaatgaaggacaacacattgaatctattatgcaatatcatgcaacataccatttattacatatcagtaaacaacttatgtttatcagcccgtgcatccagactttatggtcgtagcttatgcttatttattgacttagtgactgtctcctgcactgtaacacaaattccataaagacagttttatatatcactatctctagtatgtagatgagtttcctcaataaatattttttaataaataaataaaaatgggtcaggcacggtggctcatgcctgttatcccagcactttgggaggccaaggcaggtggatcacctgaggtcaggagtccgagaccagcctggccaacatggtgaaacctcgtctctactaaaaatacaaaattagctgggtgtggtggtgcatgcctgtaatctcagctacttgggaggctgaggcaggagaatcacttgacctgagaggtggaggttaaagtgagccaagattgcaccattgcaatccagcctgggtgacaagagcgaaactctgtctcaaaaaaaaaaaaaaaaaaaa

SEQ ID NO: 409870 - DNA, 1504 bp, Homo sapiens
ccccacggccgcgcctgcgcactggccacgcggacggcgcgatggcggcggctgccgccgagacccccgaagtccttcgggaatgcggttgcaagggcatccggacctgtctgatctgcgagcggcagcgcggcagtgacccgccctgggagctgcccccagcgaaaacataccgtttcatttactgctccgacaccggctgggccgtgggcacagaggagtctgactttgagggctgggccttccccttcccaggagtgatgctgatcgaggactttgtgacccgggaggaagaagccgagttggtgcggctcatggaccgtgacccctggaagctctcccagtctggacggaggaagcaggactatggccccaaagtcaactttcggaaacagaagctaaagaccgagggcttctgcggcctccccagcttcagccgggaggtggtgcggaggatgggcctctacccggggctggagggcttccggcccgtcgagcagtgcaacctggactactgccccgagcggggctctgccattgacccccacctggacgacgcctggctgtggggggagcggctggtcagcctcaacctcctgtcccccaccgtgctgtccatgtgtcgggaggcgcccgggagcctgctcctctgctcggccccgtcggctgccccggaggccttggtggacagcgtgatagcacccagccggtcggtgctatgccaggaggtggaggtggccatccccttacccgcccgctccctgctggtcctcaccggggcggcacggcaccagtggaagcatgccatccaccgcagacacatcgaggcccgccgcgtctgcgtcactttccgggagctgtcggctgagtttggccctggagggaggcagcaagagctgggccaggaactgctgcggatcgccctctccttccagggaagacccgtgtgaaccgcctccttggctccagacttgactgatcccgggattgaaatgaggagcacagaacagggcctcctgcaactcacggggtttcaagagaagatggctgacccctgatgctgtgagcagtgtgagccctgcccaggagcaggttttgatgggaacgtacctccaggcagcccccttccacctggaccgtggccacacttttttggttatttagtttgtcacagtcttggggacatgggatcatttgagcttaaaaaatactgggggccgggcacagtggctcacacctgtaatcctaacactttgggaggctgaggtgggcggatcacttgatgccaggagttcgagaccagcctggccaacacggtgaaaacccgtctctacaaaaactacaaaaattagccgggtgtggtgactcacagccgtaatcccagctactcgggaggctaaggtgggagaattgcttgaacctgggaggcggaggttgcagtgagccaagatcacgccactgcactccagcctcggtgacagagcaagactgttttgaaaaaaaa

SEQ ID NO: 409871 - DNA, 1413 bp, Homo sapiens
ccccacggccgcgcctgcgcactggccacgcggacggcgcgatggcggcggctgccgccgagacccccgaagtccttcgggaatgcggttgcaagggcatccggacctgtctgatctgcgagcggcagcgcggcagtgacccgccctgggagctgcccccagcggagtgatgctgatcgaggactttgtgacccgggaggaagaagccgagttggtgcggctcatggaccgtgacccctggaagctctcccagtctggacggaggaagcaggactatggccccaaagtcaactttcggaaacagaagctaaagaccgagggcttctgcggcctccccagcttcagccgggaggtggtgcggaggatgggcctctacccggggctggagggcttccggcccgtcgagcagtgcaacctggactactgccccgagcggggctctgccattgacccccacctggacgacgcctggctgtggggggagcggctggtcagcctcaacctcctgtcccccaccgtgctgtccatgtgtcgggaggcgcccgggagcctgctcctctgctcggccccgtcggctgccccggaggccttggtggacagcgtgatagcacccagccggtcggtgctatgccaggaggtggaggtggccatccccttacccgcccgctccctgctggtcctcaccggggcggcacggcaccagtggaagcatgccatccaccgcagacacatcgaggcccgccgcgtctgcgtcactttccgggagctgtcggctgagtttggccctggagggaggcagcaagagctgggccaggaactgctgcggatcgccctctccttccagggaagacccgtgtgaaccgcctccttggctccagacttgactgatcccgggattgaaatgaggagcacagaacagggcctcctgcaactcacggggtttcaagagaagatggctgacccctgatgctgtgagcagtgtgagccctgcccaggagcaggttttgatgggaacgtacctccaggcagcccccttccacctggaccgtggccacacttttttggttatttagtttgtcacagtcttggggacatgggatcatttgagcttaaaaaatactgggggccgggcacagtggctcacacctgtaatcctaacactttgggaggctgaggtgggcggatcacttgatgccaggagttcgagaccagcctggccaacacggtgaaaacccgtctctacaaaaactacaaaaattagccgggtgtggtgactcacagccgtaatcccagctactcgggaggctaaggtgggagaattgcttgaacctgggaggcggaggttgcagtgagccaagatcacgccactgcactccagcctcggtgacagagcaagactgttttgaaaaaaaa

SEQ ID NO: 409872 - DNA, 470 bp, Homo sapiens
taaatgattttcacctttattatgcatctattttcatggggtttcccgatatctcactgtccagtcccttcatttggggaatgtgttggattagggaacagggttgaagatttgaagtttagactaaagagctgggaacagcttcagagtcaggctcagcctgactcatgcttgacacccccacgcccagggagggttgggggatgtgaggagggcagggaaatctgagagcctccttccagccccataacgctgttaacaagtaggaaaaattaaagctcccggccaggcgcggtgactcacacctgtaatccgagtactttgcggggctcaggtgggaggattgcttgaggccagcctgggcaacatagtgagacccccatctctacaaaaaatacaaacattagctgggcgtctgggcatggtggccatttccgcatccatcagacactttcctcagcagaccaggc

SEQ ID NO: 409873 - DNA, 1746 bp, Homo sapiens
ccccacggccgcgcctgcgcactggccacgcggacggcgcgatggcggcggctgccgccgagacccccgaagtccttcgggaatgcggttgcaagggcatccggacctgtctgatctgcgagcggcagcgcggcagtgacccgccctgggagctgcccccagcgaaaacataccgtttcatttactgctccgacaccggctgggccgtgggcacagaggagtctgactttgagggctgggccttccccttcccaggagtgatgctgatcgaggactttgtgacccgggaggaagaagccgagttggtgcggctcatggaccgtgacccctggaagctctcccagtctggacggaggaagcaggactatggccccaaagtcaactttcggaaacagaagctaaagaccgagggcttctgcggcctccccagcttcagccgggaggtggtgcggaggatgggcctctacccggggctggagggcttccggcccgtcgagcagtgcaacctggactactgccccgagcggggctctgccattgacccccacctggacgacgcctggctgtggggggagcggctggtcagcctcaacctcctgtcccccaccgtgctgtccatgtgtcgggaggcgcccgggagcctgctcctctgctcggccccgtcggctgccccggaggccttggtggacagcgtgatagcacccagccggtcggtgctatgccaggaggtggaggtggccatccccttacccgcccgctccctgctggtcctcaccggggcggcacggcaccagtggaagcatgccatccaccgcagacacatcgaggcccgccgcgtctgcgtcactttccgggagctgtcggctgagtttggccctggagggaggcagcaagagctgggccaggaactgctgcggatcgccctctccttccagggaagacccgtgtgaaccgcctccttggctccagacttgactgatcccgggattgaaatgaggagcacagaacagggcctcctgcaactcacggggtttcaagagaagatggctgacccctgatgctgtgagcagtgtgagccctgcccaggagcaggttttgatgggaacgtacctccaggcagcccccttccacctggaccgtggccacacttttttggttatttagtttgtcacagtcttggggacatgggatcatttgagcttaaaaaatactgggggccgggcacagtggctcacacctgtaatcctaacactttgggaggctgaggtgggcggatcacttgatgccaggagttcgagaccagcctggccaacacggtgaaaacccgtctctacaaaaactacaaaaaaaaaaaacaaaaaaaaaaaaaaaaaaaaaaaaaaaaaaaaaaaaagaaaaacaaaaacataaaagaaaaaaaagagggggggggcccgcaaacacacaacacacggtggcgccccactgagcaggtcacacagatacgtgtgagagaggtggcccctcatcgtggtggggtgctcataatacaccgcgacaacagcagcagctgtcatctgtataattacaacggtgtggagccagaggggaaacataacggagccttctttccggtgatctttgtgtaggagagcagcacgcaccttcaatctagtcggtgaacggaattattattttctggccgtaaaatcaccgcctacctggacgaataacttcctccgctccctggcgtgcatgataatcatt

SEQ ID NO: 409874 - DNA, 593 bp, Homo sapiens
taaatgattttcacctttattatgcatctattttcatggggtttcccgatatctcactgtccagtcccttcatttggggaatgtgttggattagggaacagggttgaagatttgaagtttagactaaagagctgggaacagcttcagagtcaggctcagcctgactcatgcttgacacccccacgcccagggagggttgggggatgtgaggagggcagggaaatctgagagcctccttccagccccataacgctgttaacaagtaggaaaaattaaagctcccggccaggcgcggtgactcacacctgtaatccgagtactttgcggggctcaggtgggaggattgcttgaggccagcctgggcaacatagtgagacccccatctctacaaaaaatacaaacattagctgggcgtctgggcatggtggcacacacctgtagtcccagctactcgaaaggctgaggcgggaggatggctttaccaccatgtcaaggctgcagtgagctcatgatcataccactgcacttaacttggcaacagagcaagaccctgtccctaaaataaataaaaggaaaacaaaaaaagctcctca

SEQ ID NO: 409875 - DNA, 986 bp, Homo sapiens
ccccacggccgcgcctgcgcactggccacgcggacggcgcgatggcggcggctgccgccgagacccccgaagtccttcgggaatgcggttgcaagggcatccggacctgtctgatctgcgagcggcagcgcggcagtgacccgccctgggagctgcccccagcgaaaacataccgtttcatttactgctccgacaccggctgggccgtgggcacagaggagtctgactttgagggctgggccttccccttcccaggagtgatgctgatcgaggactttgtgacccgggaggaagaagccgagttggtgcggctcatggaccgtgacccctggaagctctcccagtctggacggaggaagcaggactatggccccaaagtcaactttcggaaacagaagctaaagaccgagggcttctgcggcctccccagcttcagccgggaggtggtgcggaggatgggcctctacccggggctggagggcttccggcccgtcgagcagtgcaacctggactactgccccgagcggggctctgccattgacccccacctggacgacgcctggctgtggggggagcggctggtcagcctcaacctcctgtcccccaccgtgctgtccatgtgtcgggaggcgcccgggagcctgctcctctgctcggccccgtcggctgccccggaggccttggtggacagcgtgatagcacccagccggtcggtgctatgccaggaggtggaggattgcttgaggccagcctgggcaacatagtgagacccccatctctacaaaaaatacaaacattagctgggcgtctgggcatggtggcacacacctgtagtcccagctactcgaaaggctgaggcgggaggatggctttaccaccatgtcaaggctgcagtgagctcatgatcataccactgcacttaacttggcaacagagcaagaccctgtccctaaaataaataaaaggaaaacaaaaaaagctcctca

SEQ ID NO: 409876 - DNA, 394 bp, Homo sapiens
ttctgaagataaataagttgcctgcttccctcttgtgtttcatatgtctgcagtgaacagtaatgagtatagctgtaaattagttaagatagaaccgatggggaaattataaatctgaatctaaaacatatttgataagtaagtcaaagtttctccacttaaaggtcatccccttctagtggaagcatatttttctcaaaatttggcaaccttggttttttttttttcctgggaagtctggagatgctcagcttttaaacaactattaaagtgtactttgttaccctgctttcccctgcttcatctttcaactgcagttagatgatcatgagataatcagtaaacagagaccttctatctagccctaagatgactgaaacaaccacagaattag

SEQ ID NO: 409877 - DNA, 551 bp, Homo sapiens
gtggatgtgtaatattaactggcacattgacaccctaatttttgcaaatggtaaagccattccacatatgcatttgttcaagaagctaatgtttattgaaaacctattgtgttctaagccatgaaccatccccaggtaagtgacctcagctctgccattacgagtcctctggggctggccagggaaggtaagagcccaccctcctcatctgtggagttgctatggagatctctgcacctctagacagatactaaggactcaatgcaactggcagaacatttttttgatagcacaagatgaaaaacaatttgcaaggtatttctgaaaagttaatgaaaattgtaggatagttgaaagcaaaagtgaacattatgaggcatatgatactgttaaaatcatcatacactgctgtaaagcagtttcaatatctgtatgtctgccccaggaataatcaaccaggtattacctagaatagtgtttttcaacttctgcaactgtaatctagagcaagagatgacaagttttgcattatggcccagtacgcacatgcc

SEQ ID NO: 409878 - DNA, 544 bp, Homo sapiens
aaggcaaaggggaagcaaacgcatcttcacatggctggcacagaaaagacagggtgaagggggaagtgctacacacactttcaaacaacagatctcgtgagaactcactcactatcacatgaacagcaagggggaaatccgcctccatgatccagtcacctcctaccaggtccctcccccaacattgggaattacaattcaacatgagatttgggtggggatacagagccaaaccatgtcagcttccccagactctcatcagaaacagatgcagcaccacgtttgtacagccagcagaaccaagaaccaactaaattccttttctttaaaaattacccagcctccatcctggtgaacacggtgaaacctcgtctctactaaaaacacaaaaaattagctgggtgtggtggcgggtgcctgcagtcccagctactcgggaggctgaggcaggggaatagcatgaacccctgggggcggagcttgcagtgagccgagatcgcgccactgcactccagcctgagtgacagagcaagactccgtctca

SEQ ID NO: 409879 - DNA, 657 bp, Homo sapiens
ctctcatcctgccttgtgtggtgattatctctttctgcattgtcttctctactagactcatggctccttgagggcaggtacctacctgtctttatatccagcagagacgtggaattgagcagtgttgaataaatgctagtaaaataaactgtcatagcaagcctctcttggacacctatgtgctgaagttaaaaagtttttcaaatttggactgaaaaaatgagaaagcccaaaatgactattaaatatacatgtatgtgtgtgtatacatacacacagtcatgcaccacgtaacgatgtttcagtcagcagctgactgaatatatgacggtggtcccataagattataatggaactaaacaattcctatcacctagcgactcttagccttcgtaatgtcatagcgtaacgcattagtcacgtgtttgtggtgatgttggtgtgaacaaatgtactgtgttgcctgccagtcatataaaatatagtacacaatactggggtaatggtaataaatgactgttactggtttatgttttatttatttcattatttaattttcagtgttctttagctatggtttatgtatttactatcttatagtttttatcattattttatggtgtactcctatttattaaaaaaaatgttaactgtaaa

SEQ ID NO: 409880 - DNA, 1386 bp, Homo sapiens
cagggccagcaggctgtcaggctcacagaggcccgagggtctcccagcgacttgtcgactctggtgtgagtctggcaggaggtaacccagtcccggggagggcggaggctgggcgggcgagttcccctttccccagctgggccgctgcccacccggggagcggcccgccccctccaccctcataaaagcacccccagggccctgcctgggtcagtgtctcagccacagcggcttcaccatgcacagctgggagcgcctggcagttctggtcctcctaggagcggccgcctgcgcggcgccgccccgtggtcggatcctgggcggcagagaggccgaggcgcacgcgcggccctacatggcgtcggtgcagctgaacggcgcgcacctgtgcggcggcgtcctggtggcggagcagtgggtgctgagcgcggcgcactgcctggaggacgcggccgacgggaaggtgcaggttctcctgggcgcgcactccctgtcgcagccggagccctccaagcgcctgtacgacgtgctccgcgcagtgccccacccggacagccagcccgacaccatcgaccacgacctcctgctgctacagctgtcggagaaggccacactgggccctgctgtgcgccccctgccctggcagcgcgtggaccgcgacgtggcaccgggaactctctgcgacgtggccggctggggcatagtcaaccacgcgggccgccgcccggacagcctgcagcacgtgctcttgccagtgctggaccgcgccacctgcaaccggcgcacgcaccacgacggcgccatcaccgagcgcttgatgtgcgcggagagcaatcgccgggacagctgcaagggtgactccgggggcccgctggtgtgcgggggcgtgctcgagggcgtggtcacctcgggctcgcgcgtttgcggcaaccgcaagaagcccgggatctacacccgcgtggcgagctatgcggcctggatcgacagcgtcctggcctagggtgccggggcctgaaggtcagggtcacccaagcaacaaagtcccgagcaatgaagtcatccactcctgcatctggttggtctttattgagcacctactatatgcagaaggggaggccgaggtgggaggatcattggatctcaggagttcgagatcagcatgggccacgtagcgcgactccatctctacaaataaataaaaaattagctgggcaattggcgggcatggaggtgggtgcttgtagttccagctactcaggaggctgaggtgggaggatgacttgaacgcaggaggctgaggctgcagtgagttgtgattgcaccactgccctccagcctgggcaacagagtgaaaccttgtctctctctacaaaaaaaaaaaaaaaa

SEQ ID NO: 409881 - DNA, 975 bp, Homo sapiens
cagggccagcaggctgtcaggctcacagaggcccgagggtctcccagcgacttgtcgactctggtgtgagtctggcaggaggtaacccagtcccggggagggcggaggctgggcgggcgagttcccctttccccagctgggccgctgcccacccggggagcggcccgccccctccaccctcataaaagcacccccagggccctgcctgggtcagtgtctcagccacagcggcttcaccatgcacagctgggagcgcctggcagttctggtcctcctaggagcggccgcctgcgcggcgccgccccgtggtcggatcctgggcggcagagaggccgaggcgcacgcgcggccctacatggcgtcggtgcagctgaacggcgcgcacctgtgcggcggcgtcctggtggcggagcagtgggtgctgagcgcggcgcactgcctggaggacgcggccgacgggaaggtgcaggttctcctgggcgcgcactccctgtcgcagccggagccctccaagcgcctgtacgacgtgctccgcgcagtgccccacccggacagccagcccgacaccatcgacagcgtcctggcctagggtgccggggcctgaaggtcagggtcacccaagcaacaaagtcccgagcaatgaagtcatccactcctgcatctggttggtctttattgagcacctactatatgcagaaggggaggccgaggtgggaggatcattggatctcaggagttcgagatcagcatgggccacgtagcgcgactccatctctacaaataaataaaaaattagctgggcaattggcgggcatggaggtgggtgcttgtagttccagctactcaggaggctgaggtgggaggatgacttgaacgcaggaggctgaggctgcagtgagttgtgattgcaccactgccctccagcctgggcaacagagtgaaaccttgtctctctctacaaaaaaaaaaaaaaaa

SEQ ID NO: 409882 - DNA, 385 bp, Homo sapiens
gctatttaagtgatggacagcaggtgaccttgctgtgtcagctggacctgaggtgctggtggaactctcagaaagggccggaggcccccccgacttgttttcaaatccaggggaggggccagtgggggaggagtaaccacttctgagcacctactatgggcgcagcacgtgtgggattgcttgcattcagcctcactggacccttgcgtccacccaggaggtggcaatgttacccccagtgttgagacccaaagggggacgtgacttgtccacagtcacagaaagtggggagctgggatttgaacccacctctacctggtctcagtccagggatcttctagcccacctcccaggctgtcttggagctccacctctaatccaaagg

SEQ ID NO: 409883 - DNA, 446 bp, Homo sapiens
ccatttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtg

SEQ ID NO: 409884 - DNA, 434 bp, Homo sapiens
gaattcactagtaatattactagtgggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtg

SEQ ID NO: 409885 - DNA, 644 bp, Homo sapiens
ccatttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaatgcttaatgcctcttttttgaaatagggaatgtaataattggccatttgcctactttattatttgggtaacattccagtattactctctgtgatttagcttatttaatggtgttaaactgaggttatattaaatttttgattcccaggtcaggattttgttggtaatttatataataaaagggaaatacaaatcga

SEQ ID NO: 409886 - DNA, 448 bp, Homo sapiens
gcggccgcctactactactaaattcgcggccgcgtcgacggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtg

SEQ ID NO: 409887 - DNA, 729 bp, Homo sapiens
  misc_feature (599)..(599): n is a, c, g, or t
  misc_feature (641)..(641): n is a, c, g, or t
  misc_feature (654)..(654): n is a, c, g, or t
  misc_feature (662)..(662): n is a, c, g, or t
gaattcactagtaatattactagtgggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaaaaaaaaaaaaaaaaaaaaaaaaaaaaaaaaaaaccgagactttctctctctcctcgtgccgaattcggcacgaggaatggctccacgagggttcagctgtctcttacttttaaccagtgaaattgacctgcccgtgaagaggcgggcatgacacagcaagacnagaagaccctatgagctttaattattaatgcaacagtacctncaaacccacagtnctaaactnccaacctgcttaaaccggaaagcgactctttactcaatggccaatactgccaacggaccagttcctt

SEQ ID NO: 409888 - DNA, 414 bp, Homo sapiens
gcggccgcctactactactaaattcgcggccgcgtcgacgtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtg

SEQ ID NO: 409889 - DNA, 538 bp, Homo sapiens
  misc_feature (30)..(30): n is a, c, g, or t
cgcggccggcgacacggctgcgagagacgncgaagaggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgtcaacaaacctattccgcgactccatctcctgcccccgcccttcctcaagaaacccccctccgcccgtctctcgccccccccgcccctccc

SEQ ID NO: 409890 - DNA, 371 bp, Homo sapiens
gcggccgcctactactactaaattcgcggccgcgtcgacggaacaaggtcgtgaaaaaaaaggtcttggtgaggtgccgccatttcatctgtcctcattctctgcgcctttcgcagagcttccagcagcgaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtg

SEQ ID NO: 409891 - DNA, 596 bp, Homo sapiens
tggctgtgactcgcgcacctgcaaggccgcctccgggctgtggcgtgggagatgatagccagaaaccaggctgagacgcagactagcattccacttagcccaaggaccagtgaggaagctgggcatcctagcgcgtagccgctaaaggaatgggcagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaatgcttaatgcctcttttttgaaatagggaatgtaataattggccatttgcctactttattatttgggtaacattccagtattactctctgtgatttagcttatttaatggtgttaaactgaggttatattaaatttttgattcccaggtcaggattttgttggtaatttatataataaaagggaaatacaaatcga

SEQ ID NO: 409892 - DNA, 822 bp, Homo sapiens
ccatttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaaaaaaaaaaaaaaaaaaaaaaaaaaaaaaaaaaaaacaaaaaaaaaaaaacaacaaacaaaaaaaaaaaaaaagaaaaaacaacaaaaaacaagagagggggggcgcgcgcgcgcctgtcgaaaaaatgcccccccccgcgggggggcgcgccgccaagacgtgccgcgcgccgcaccccgacgtttttgttgtaaaaaaagagggggcgtccaatatatgggggagcgagccgtattaattaacgagccagcggagacgagcgcgccacggagcgagttcaaacaaacagcgcgtggcggaggaggggaaaaaacacgggcggcaggggggggataatctggaggagagagagagaacacacatatcagggagg

SEQ ID NO: 409893 - DNA, 810 bp, Homo sapiens
gaattcactagtaatattactagtgggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaaaaaaaaaaaaaaaaaaaaaaaaaaaaaaaaaaaaacaaaaaaaaaaaaacaacaaacaaaaaaaaaaaaaaagaaaaaacaacaaaaaacaagagagggggggcgcgcgcgcgcctgtcgaaaaaatgcccccccccgcgggggggcgcgccgccaagacgtgccgcgcgccgcaccccgacgtttttgttgtaaaaaaagagggggcgtccaatatatgggggagcgagccgtattaattaacgagccagcggagacgagcgcgccacggagcgagttcaaacaaacagcgcgtggcggaggaggggaaaaaacacgggcggcaggggggggataatctggaggagagagagagaacacacatatcagggagg

SEQ ID NO: 409894 - DNA, 926 bp, Homo sapiens
ccatttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaaaaaaaaaaaaaactccggggcagggtggggacggtcggggtactcggaaagcaagcctacgtggctcactataacgtataatcctttcctttccaagatgcctgaggaagtgcaccagggagaggaggagggggagactttggccttcaggcagaaatggccaattcatgtccctcatcatagagtaccttctattccaacagggagatttccctccgggagtggactctcctaaggcttactgatgcttgtggacaagatgcgttatgaaagcctgagagacccttcgaatgtgggacggggtaacgagttgaatttggacattttgcccaacactcaaggaaggttcgctgactgggtgagaccaggtcttggttgaccaaggtggttcttaaattttgggaccttgccagttggtataaagttcaaggggcataggcggggaaaattctgatggggagggggaggttatatcggc

SEQ ID NO: 409895 - DNA, 710 bp, Homo sapiens
ccatttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaacaaaaaaaaaaaaacaacaaacaaaaaatagcattaacacacatccaaatgccagtgcaggagtcccggggtccatcaaagagctaaattcaagtgtccactacacactggagccgtccagaatgactggttgtggcaacccaggtgtacccttgccagtccgtgtccggggttggcgctctgggcaatgctgacagggaacgagcaggcaacgggcggtgcccactaagaccttttccccctgttgccggttgcttgtggt

SEQ ID NO: 409896 - DNA, 774 bp, Homo sapiens
ccatttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaaaaactatacgctcactcacagccctacactcatccgcgcacagccgcacaagaaaccaccacccgcgagcaagcttattattcggacggcattacacgctcagtggccattcgccatatggggatagtttaccgtcccgggcggcggtttacaagttctgatgggcaccccgggtttcccactttaatgtcttgcgacatccctttgccggttggttaatcaagggcttaggtctccttcaagggtacgctaattgaaggctatcagatatgggcagcgtaatgtgacaatttcacgaggacgtacgtttgagatcccgatgattc

SEQ ID NO: 409897 - DNA, 842 bp, Homo sapiens
ggctagtacggctggggttgatcggccgaggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaaaaaaaaaaaaaaaaaaaaaaaaaaaaaaaaaaaaaaaaaaaaaaaaaaaaaaacaaaaaaaaaaaaacaacaaacaaaaaagggggggggcaaaaaaaaaacaccgaggggggacaaaaaagagccaaaaaacaaaataagaaaagagaggcacacaaagagaggaacaaaacaagacgagggggcacgtgaaataaaaagaaggagagaggaacagagagcgaggcgccttgaggacacgccccactcgggggggaaaaaacagacggccacaaccccacacagagaacaaaacagccagaaagaaaacacaacccggagactaagaggataaacaaccacccaagacacggcgacagaaagagaatccagccgaacacacccggaaatcaccagcgga

SEQ ID NO: 409898 - DNA, 828 bp, Homo sapiens
ccatttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacaggtagttagtggatttctaatcatgttaaagcaggcctttttattaagtagcctcttccccatcacccagaacacacacacaaatacattgttgtgtagggctgattcctgaggttatgtgtagatgtggcattggtggagactagttgtaaacctatataaaaatatttcaataatggccagtgtttattgaatactactgcttatcaggtacactttacatcgatatctcatgttctctagcaagcttgtgaggcggatgatagtaaccccatctgagacacagagatgttaagttgttcaacatctcataactagtataatggtggaccaggactcttgcccaggcagtttcttgttgcagaactcacacttttaaccagatatgaagagcattttaagaggtgcagcctctggaagtggatcaaactagaactcatatgccatactagatatgtttgtcaataaacttatgacgtg

SEQ ID NO: 409899 - DNA, 523 bp, Homo sapiens
cgatctagacgatcccgttatgaagcatctgagttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaatgcttaatgcctcttttttgaaatagggaatgtaataattggccatttgcctactttattatttgggtaacattccagtattactctctgtgatttagcttatttaatggtgttaaactgaggttatattaaatttttgattcccaggtcaggattttgttggtaatttatataataaaagggaaatacaaatcga

SEQ ID NO: 409900 - DNA, 530 bp, Homo sapiens
gcggccgcctactactactaaattcgcggccgcgtcgacggaacaaggtcgtgaaaaaaaaggtcttggtgaggtgccgccatttcatctgtcctcattctctgcgcctttcgcagagcttccagcagcgaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaaaaaaaaaaaaaaaaaaaaaaaaaaaaaaaaaaatcatataaatataattaatataacaattatatatttatcaaattaaaaaaatctctggggggggcccgtgccccaattcccccttttgggagtatgtttccctccgcttaattgccgttatttt

SEQ ID NO: 409901 - DNA, 1542 bp, Homo sapiens
gcggccgcctactactactaaattcgcggccgcgtcgacggaacaaggtcgtgaaaaaaaaggtcttggtgaggtgccgccatttcatctgtcctcattctctgcgcctttcgcagagcttccagcagcgaatttgccattttcagtggaaaacaagtggtcgttactagctaagatgtgtttgtactttggatctgcatttgctacacccttccttgtagtaagacaccaactgcttaaaacataaggatgtttcagttcctccatttaacaggtagttagtggatttctaatcatgttaaagcaggcctttttattaagtagcctcttccccatcacccagaacacacacacaaatacattgttgtgtagggctgattcctgaggttatgtgtagatgtggcattggtggagactagttgtaaacctatataaaaatatttcaataatggccagtgtttattgaatactactgcttatcaggtacactttacatcgatatctcatgttctctagcaagcttgtgaggcggatgatagtaaccccatctgagacacagagatgttaagttgttcaacatctcataactagtataatggtggaccaggactcttgcccaggcagtttcttgttgcagaactcacacttttaaccaggtaaaactgataaactgattaatgttactctatcttgaacactgttactagaacagtagctgagaatgtgtcttttaaaacactataaacatttccatttcttttagaaagtggtcactgtgctcctagtttttaaattggcttacaatacttgtttaagttgtgaaaaatccctgaagataaaacccttctagtgctccttgatacataagtcccagataattatgcaattgtaaatctgtgcctcaccaactcagccatgttgggaaactcaaacttttaaatatactttcctcattaaggcagtggttcttaaatgaggatgattttacaacacaatggggcatttggcaatgtgagaccattttgatcgttccaacttgggggcaaaattaccagtggtgctgaggttgagaagccttgtgtcaaggggatatgttaatatatgctcaaaggagtcgttcatattggaaggttagcagatttgctgtgtgtggataaaatatttagcttaattgtcatcagagtttctcagagtaatactatagaacactaggatgattggaaagagtgtcatagtttagagggggaataacttatccaagctactaatgcggaaaggttgcggtgcatgtgatgaagcaaatcagtatgaatgaattcatgatactgtaaacgctttctgatgtactactcaaactgatagaaaatattttcatgaaactacatgatttctgttaaatgaatgggatttttaaaatgccattaatttctgtttttattttgcagatatgaagagcattttaagaggtgcagcctctggaagtggatcaaactagaactcatatgccatactagatatgtttgtcaataaacttatgacgtg

SEQ ID NO: 409902 - DNA, 499 bp, Homo sapiens
  misc_feature (48)..(48): n is a, c, g, or t
  misc_feature (51)..(51): n is a, c, g, or t
  misc_feature (56)..(56): n is a, c, g, or t
ggaagagggggttcgcttgggcgccgaccagttatagttttaggaaanggncctgngcggaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaatgcttaatgcctcttttttgaaatagggaatgtaataattggccatttgcctactttattatttgggtaacattccagtattactctctgtgatttagcttatttaatggtgttaaactgaggttatattaaatttttgattcccaggtcaggattttgttggtaatttatataataaaagggaaatacaaatcga

SEQ ID NO: 409903 - DNA, 487 bp, Homo sapiens
ccatttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagattttgccagtgtcagtgtttttctatgtattgctctataggtgtttgctaatctaaaaatgtatttacttgcttagttttctcaaatcaggagaaatctctataggcttgatgtttacagtagacgtggaaacattttctttgttccattttactcgctatctggggactcttagatatccttttcagaacaggagctggagagggatttatcaagtcttgacatagaatcacctgctctgaatcccctaaatatatgtggtcgacgcggccgcgaattta

SEQ ID NO: 409904 - DNA, 440 bp, Homo sapiens
ggctagtacggctggggttgatcggccgaggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtg

SEQ ID NO: 409905 - DNA, 447 bp, Homo sapiens
  misc_feature (30)..(30): n is a, c, g, or t
cgcggccggcgacacggctgcgagagacgncgaagaggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtg

SEQ ID NO: 409906 - DNA, 519 bp, Homo sapiens
gcggccgcctactactactaaattcgcggccgcgtcgacggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgtaaaaaattgagcaagcttatgcatcgggcgcaattcgagtactttggcacattccctttagtgaggcgat

SEQ ID NO: 409907 - DNA, 848 bp, Homo sapiens
ccatttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaaaaaaaaaaaaaaaaaaaaaaaaaaaaaaaaaaaaaaaaaaaaaaaaaaaaaaacaaaaaaaaaaaaacaacaaacaaaaaagggggggggcaaaaaaaaaacaccgaggggggacaaaaaagagccaaaaaacaaaataagaaaagagaggcacacaaagagaggaacaaaacaagacgagggggcacgtgaaataaaaagaaggagagaggaacagagagcgaggcgccttgaggacacgccccactcgggggggaaaaaacagacggccacaaccccacacagagaacaaaacagccagaaagaaaacacaacccggagactaagaggataaacaaccacccaagacacggcgacagaaagagaatccagccgaacacacccggaaatcaccagcgga

SEQ ID NO: 409908 - DNA, 751 bp, Homo sapiens
  misc_feature (600)..(600): n is a, c, g, or t
  misc_feature (642)..(642): n is a, c, g, or t
  misc_feature (655)..(655): n is a, c, g, or t
  misc_feature (663)..(663): n is a, c, g, or t
ccatttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaaaaaaaaaaaaaaaaaaaaaaaaccgagactttctctctctcctcgtgccgaattcggcacgaggaatggctccacgagggttcagctgtctcttacttttaaccagtgaaattgacctgcccgtgaagaggcgggcatgacacagcaagacnagaagaccctatgagctttaattattaatgcaacagtacctncaaacccacagtnctaaactnccaacctgcatttgctaagacttcgaccgtccaaagccaacttctttacttcattgaacccaatacttgaccaacggaccaagttacg

SEQ ID NO: 409909 - DNA, 518 bp, Homo sapiens
ccatttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgctagtatggcatatgagttctagtttgatccacttccagaggctgcactcttaaaatgctcttcatatcgtc

SEQ ID NO: 409910 - DNA, 1617 bp, Homo sapiens
ccatttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacaggtagttagtggatttctaatcatgttaaagcaggcctttttattaagtagcctcttccccatcacccagaacacacacacaaatacattgttgtgtagggctgattcctgaggttatgtgtagatgtggcattggtggagactagttgtaaacctatataaaaatatttcaataatggccagtgtttattgaatactactgcttatcaggtacactttacatcgatatctcatgttctctagcaagcttgtgaggcggatgatagtaaccccatctgagacacagagatgttaagttgttcaacatctcataactagtataatggtggaccaggactcttgcccaggcagtttcttgttgcagaactcacacttttaaccaggtaaaactgataaactgattaatgttactctatcttgaacactgttactagaacagtagctgagaatgtgtcttttaaaacactataaacatttccatttcttttagaaagtggtcactgtgctcctagtttttaaattggcttacaatacttgtttaagttgtgaaaaatccctgaagataaaacccttctagtgctccttgatacataagtcccagataattatgcaattgtaaatctgtgcctcaccaactcagccatgttgggaaactcaaacttttaaatatactttcctcattaaggcagtggttcttaaatgaggatgattttacaacacaatggggcatttggcaatgtgagaccattttgatcgttccaacttgggggcaaaattaccagtggtgctgaggttgagaagccttgtgtcaaggggatatgttaatatatgctcaaaggagtcgttcatattggaaggttagcagatttgctgtgtgtggataaaatatttagcttaattgtcatcagagtttctcagagtaatactatagaacactaggatgattggaaagagtgtcatagtttagagggggaataacttatccaagctactaatgcggaaaggttgcggtgcatgtgatgaagcaaatcagtatgaatgaattcatgatactgtaaacgctttctgatgtactactcaaactgatagaaaatattttcatgaaactacatgatttctgttaaatgaatgggatttttaaaatgccattaatttctgtttttattttgcagatatgaagagcattttaagaggtgcagcctctggaagtggatcaaactagaactcatatgccatactagatatgtttgtcaataaacttatgacgtg

SEQ ID NO: 409911 - DNA, 93 bp, Homo sapiens
tttacaagtgccgaacaatgtttcttgcactgataatacaagggtgtgcaaaactgacaggaatccctgctctcatggagcttacagtaacag

SEQ ID NO: 409912 - DNA, 314 bp, Homo sapiens
atccttgagaaaattaataaaattattaaactttttagccatgttgatcataaaaaaagagatgacataaattgccaagggtcaggaatgagagagttaatgttagttcggattccactaaaggaaaaaagaaaattatgaagatctttatgcctatacatttgacagtgtagatgaaatggaccaattccttgaaagacataaactaccaaaattcaccacagaagaaaccaataacccaaatgaatttgaatttgtagttaaatatcttcatacacatacacaaatttctaggcccagagttcttcactaga

SEQ ID NO: 409913 - DNA, 581 bp, Homo sapiens
agcaacttcacaggtgaatcaaagacaaggcaagattggaaacatggccaaagatgaggatagcaaaaagtctggaaccaaaactgccgacttcacattgttaaatatgaggaagagaagctggaaaaatcagcatcagtcaaaaagatccatgtcaaatctgattccggtcagtacagtgttgggatagggtatctgtcctcagtaacagcctgttgaccacctttatcttgaactggccacaagcctcctacttaatttgacatgatatgcctagaaaatgtacacatgtgttcggtataatatagccacaggggccaaccacaatttttattttcatggcatgcatcaaatttttactatagtaaatccacaagtaaaggaacatcttactaggtaagactgatggcattcagaagccctcttcagtgatattctgatggataccattttggggaaacttgggttgatttattgttttatttaaatctcagggtgttgggccagggacggtggctcacacctgtaatcccagcattttgagaggccgagacaggaggactgcttgagcccaggagttt

SEQ ID NO: 409914 - DNA, 848 bp, Homo sapiens
aacaatcaaggttgatttcttcctcatatcttatgtcctttgcgagttggcaagagctactcattgtggttatttgtgggcctgagctgatgcagctgcccccatcttgtgctaatcatagtgccagaagcaaaaaaaaaaaaattgcacattgataaattaagcagtgatggctaaaagcctcctacccaaagcaacacattctgtttctgctcatgtttcatgagttaaagcctgtaacttcaaaggggtagggaagtgtaatcctaccaggtgtctaggagaagaacctgaactgtttgatgaactgaatacttctaccactgtgttggttttcaaggaaggggtgggaaagtctttgaaaactctcctgtgacccataaagttatatcctagaagccaatcctttctgtgttcataaaatcactggccttttcctgtggccgccaaggttgcagagagcagagctgtttgggaactcacttcaagaagtggtcagagcttgaggagggagggtcaggacaggagcagaggcagatggcatggcactgggccaggttccatatgacctgggtgccagcaaagctggccttggttttgcttatgcttgtatttgttaccaacctatatagcaagtatcacagtagaaaaacttacagaatggcctgactacacagagctcactgttgaaaaacgctgggttgtaactctaagatagcatctgctacattgctaaagaatgttttataacagggcttagatctgttaggaatcttagctgctactgttgcaacaccaatttatggaaagctgtgttatttattttgaaatataaacatgaaaaaaaa

SEQ ID NO: 409915 - DNA, 327 bp, Homo sapiens
agccatttaatctgtctcccaaattgctgagcctctgtgtgcctccacggtttcaaatgtgaaatgaggacaggaataaggcattgatttaaattagttataaatgcacagtacaaagagcggggtgcaggcctgttgatattaacactgtgagtgctcaggagccgtgttctgaatgctgggacagccacacccagaacaattacactacacagttagcagggcgtctgttgacttggaagagtgttggtgacatgtcactcaataagcatgtaagctacacagcaatgtgtacattgggaatctgttcgggttttttttaaagca

SEQ ID NO: 409916 - DNA, 889 bp, Homo sapiens
ataatgaatctactgaactctgttatagaacaagttcattttgcatgaacttctcttattgaagcagaagccacgtcatgagcctgggggctgccctctccccgtctgggagtgggacagaactgttcagtgccttgaaagtcacagatttctgactcctggaaggaactgggcagtcccaccagagcagaaagaaaggaggcaaacttggggagtgagaagccagcctcccagaggcccaggcctcgtgttccccacctccaaccctcccgtgaggagaggggcttggcctgggaccttgtaacttccttgcaagttaagtgagctatcctgtcacaaaagatagaaggaactgccctttgggacttcttttcactggaaacccagcactggttttatgttgagtgagtgggaagctgggactctgttttacagccatctgtactggagcctggacaaaccactggtctctatgggaggccccagcctcacatttccctggcaaggagagagaggtttagccatgtcctgggtctaggattacagcccagagatgggcacttaagaagacctggtcattggtccagacttgggccaaggctctcctctgtgagggatgggttttactggtgaattacctgtgtggagaagctatcagggccatgtttagcacactgaagggaccagtctccaccaagcactttaacatccctccagccagcatagattgatctcgtgttacagagagggcaaggtttttggcccctgtttgcagactccatgtcttaatcagagaccacagttttctctttgttccaatctgcgccacctcggtagccccactttccttgctgtgtggacttgaaacaaaataaaatgtgttgcttca

SEQ ID NO: 409917 - DNA, 836 bp, Homo sapiens
ataatgaatctactgaactctgttatagaacaagttcattttgcatgaacttctcttattgaagcagaagccacgtcatgagcctgggggctgccctctccccgtctgggagtgggacagaactgttcagtgccttgaaagtcacagatttctgactcctggaaggaactgggcagtcccaccagagcagaaagaaaggaggcaaacttggggagtgagaagccagcctcccagaggcccaggcctcgtgttccccacctccaaccctcccgtgaggagaggggcttggcctgggaccttgtaacttccttgcaagttaagtgagctatcctgtcactggttttatgttgagtgagtgggaagctgggactctgttttacagccatctgtactggagcctggacaaaccactggtctctatgggaggccccagcctcacatttccctggcaaggagagagaggtttagccatgtcctgggtctaggattacagcccagagatgggcacttaagaagacctggtcattggtccagacttgggccaaggctctcctctgtgagggatgggttttactggtgaattacctgtgtggagaagctatcagggccatgtttagcacactgaagggaccagtctccaccaagcactttaacatccctccagccagcatagattgatctcgtgttacagagagggcaaggtttttggcccctgtttgcagactccatgtcttaatcagagaccacagttttctctttgttccaatctgcgccacctcggtagccccactttccttgctgtgtggacttgaaacaaaataaaatgtgttgcttca

SEQ ID NO: 409918 - DNA, 529 bp, Homo sapiens
tttttctgtagagacagggtctcactattttgcctaagctggtcttgaactcctggcttcaagtggtccttccaccacagcctctcaaagtgccaggattacaggcatatgtcaccccaccctgctgtctgctatttcgaggagagactgtaggggtgaaagaggaaagccagttaacaaactattgccaaaaacggttaccagaatttgaatgtattaatatatttaatccttgcaacaacaacactaagtggctactattgctacccttattataaaagtgaggaaacttagccacagagaggttaagcaacttgctcagaattccacaatcagcaagctgtggaggcaggatttaaagagggcagcctggctctagggtccatgtggctgaacattatatggtatagacccacccagtataacacactgggagcacgaggcagggagctgtcttcccgacatggggaaatggtaacctactcttttagaagtcttcgagaaagtatataagccaaaagaagtcttt

SEQ ID NO: 409919 - DNA, 180 bp, Homo sapiens
aaattctgtggccgcgtcgacctgctctccagcctgggtgacagagtgagaccctgtctccaaaaaaagaaagtttctgttgggggagaagagcttggagggtcatactctgccattgtgctgacgttgctgtatttgtttttacattcaaactttcttttgtaataaaatatatcttga

SEQ ID NO: 409920 - DNA, 255 bp, Homo sapiens
tatgtctaattatgtttggagttcattcatacatttctgagcatttctaatactgatttatgtctttccattagagagggtacactttcaattgtaccaccatttgccaagtaactactgttaggtattgactttatgggtcattggctaaatgaaatttaaaaaggtgttttagtcaatcttaagctatatataagtcctacaattttggaagaaataaacatgatcttagcattaattaaggcaactgttaca

SEQ ID NO: 409921 - DNA, 351 bp, Homo sapiens
ttttcaaatgcacaggggaccgttaccaaagtaaagtaaatactgggccattaaagaagtctcaatacatttcaaaggttagaaatattacagaatatgttatcgaattacaacaaggctaattagaaatcagtagcagtaaggttttttaaaaaaaaaaaatccctaaatctttagaaatgaagttatatactccataataactcactactaaaatattacttcagaaagtcaactcatgggccaggtacagtggctcacgcctataatcccagcacttttagaggctgaggtgggaggctcacttgaggccaggagtttcagaccaacctgggcaacatggtgaaactc

SEQ ID NO: 409922 - DNA, 369 bp, Homo sapiens
tctctaatcttgtctgcttgccttatttcaggaagatagtcttcaagctctgatattctctctttcgcttggtcaattcagctattgatagttgtctttgcatcacaaagttctcgttctgtgtttttcagctccatcatgtcattctctaaactggttattctagttaacagctcctgtaatcttttatcatggttcttagcttctttgcattgggttagaacataatcctttagctcagcaaaatctgttattactcactttctgaagcccactttaatcagttcatccatctcagcttcagccctattctgtgcccttgctggagaagtgttgtgatcatttggaggaaaagaggctttctggctt

SEQ ID NO: 409923 - DNA, 411 bp, Homo sapiens
ttttttttcctttttgctccggtgtgctgctgaagttgttaaaatgaactcctgacttctccagagccgtttacattcacagacagctgtccagttgttattctttatggagtggtaaaaactgggatctcctactccatactcttgctgatgtcactaccctcaatatattcataagaaattgtatccaataaatttgcataactcatgagctaaattatagaatttaaacatggttagcttctaaaaagatattaacagcaatatatcaggaaataataatttttattcatcttatagtagtaaaactgcaattaaaactgacttaattttttatcaatatatataaaaaagtcccttttgtgttatcaattggctatggttttagaagtttccccttgatcaatttgt

SEQ ID NO: 409924 - DNA, 1247 bp, Homo sapiens
attttacacttaatttataatatttattgagtatattatgtcctcaacaagtaactataaaatgaaatacttaactcggtgaagactattttatgcaaagtttttttttttttttttttttttttttagcaatttcagtgtaatgaaagaatttaagctttgaatttataatttgctgtggtggggttaatttctgtcagtatttgagattgtattatcagtcttgcataatgaaatccttttttggctaagtatttaattcgaacatatttgcctttttaaaaagtgcttggcctaaacttattgtaactgcatgaaataagcatttgcttaaaacttaacattgtaaaattgttctctctgaaatgtgtgcagaatttaaatcatggccaaatgtattactattaccctatttacagtaatttgctttgcagaaaatatttcttcatcatggaactgtgaaatcaaattgaagatcttactggtaaaaatgacaaattaacaaaaggactaagacaagtggtgcccaaacaacctttttattctgcagttccatcatcataatagaccagttaacccaggagtcctaatgttttaaaacatcattgtggtgatcttgtttattctatctcactaaggatatccagtttcctaagctcttactggctagcaatttcgtcttaattttattgctaaatgttcaaattttgcttccaaactcactttatttttgcagatgtgtacatctgctaaatactaattttatgtaaatgattttgttgattatctttccacatcttaaaatgtttctaacagctttgagattttatctcaacaggctctctctgaccccaaagtagtacttaccttcgtgactactgacaaagtcacaaaatgcaggcgatgtcatgtatttcggtacaactaaatctaggaaacggttttttcattgcattactgcatattttcattttcatttaaattatgtcccctttttctcttgcttgaaacagtgctcctcgaactttgtcttccagcacattttaaagagaaccaattaaagaacaatcacacattctgcttattaaaggctatttaaaaagaaacattttgtattagaaaatggccaactttaaaacactattttttacactcataaaaatgttttttaaatcgccttgacaatcatcagcttttgaaatgtgaattcctattgccagagtaaaggtctcgtttttataccacca

SEQ ID NO: 409925 - DNA, 1464 bp, Homo sapiens
attttacacttaatttataatatttattgagtatattatgtcctcaacaagtaactataaaatgaaatacttaactcggtgaagactattttatgcaaagtttttttttttttttttttttttttttagcaatttcagtgtaatgaaagaatttaagctttgaatttataatttgctgtggtggggttaatttctgtcagtatttgagattgtattatcagtcttgcataatgaaatccttttttggctaagtatttaattcgaacatatttgcctttttaaaaagtgcttggcctaaacttattgtaactgcatgaaataagcatttgcttaaaacttaacattgtaaaattgttctctctgaaatgtgtgcagaatttaaatcatggccaaatgtattactattaccctatttacagtaatttgctttgcagaaaatatttcttcatcatggaactgtgaaatcaaattgaagatcttactggtaaaaatgacaaattaacaaaaggactaagacaagtggtgcccaaacaacctttttattctgcagttccatcatcataatagaccagttaacccaggagtcctaatgttttaaaacatcattgtggtgatcttgtttattctatctcactaaggatatccagtttcctaagctcttactggctagcaatttcgtcttaattttattgctaaatgttcaaattttgcttccaaactcactttatttttgcagatgtgtacatctgctaaatactaattttatgtaaatgattttgttgattatctttccacatcttaaaatgtttctaacagctttgagattttatctcaacaggctctctctgaccccaaagtagtacttaccttcgtgactactgacaaagtcacaaaatgcaggcgatgtcatgtatttcggtacaactaaatctaggaaacggttttttcattgcattactgcatattttcattttcatttaaattatgtcccctttttctcttgcttgaaacagtgctcctcgaactttgtcttccagcacattttaaagagaaccaattaaagaacaatcacacattctgcttattaaaggctatttaaaaagaaacattttgtattagaaaatggccaactttaaaacactattttttacactcataaaaatgttttttaaatcgccttgacaatcatcagcttttgaaatgtgaattcctattgccagagtaaaggtctcgtttttataccaccaaaaaaaaacaaaaaaaaaaaaaattgggggggggcgggcccgagagagttttcaaaacccatcgcgttggggcgcgacggccacaggtactgagacacgggcaatggggtcccaggacccgggacagaaagggggggttcccccaaaaaagccggggaacagggtctggacatcacagggtcggaggcaacaggctcacaggggccagagcgattaa

SEQ ID NO: 409926 - DNA, 1012 bp, Homo sapiens
  misc_feature (988)..(988): n is a, c, g, or t
  misc_feature (1001)..(1001): n is a, c, g, or t
attttacacttaatttataatatttattgagtatattatgtcctcaacaagtaactataaaatgaaatacttaactcggtgaagactattttatgcaaagtttttttttttttttttttttttttttagcaatttcagtgtaatgaaagaatttaagctttgaatttataatttgctgtggtggggttaatttctgtcagtatttgagattgtattatcagtcttgcataatgaaatccttttttggctaagtatttaattcgaacatatttgcctttttaaaaagtgcttggcctaaacttattgtaactgcatgaaataagcatttgcttaaaacttaacattgtaaaattgttctctctgaaatgtgtgcagaatttaaatcatggccaaatgtattactattaccctatttacagtaatttgctttgcagaaaatatttcttcatcatggaactgtgaaatcaaattgaagatcttactggtaaaaatgacaaattaacaaaaggactaagacaagtggtgcccaaacaacctttttattctgcagttccatcatcataatagaccagttaacccaggagtcctaatgttttaaaacatcattgtggtgatcttgtttattctatctcactaaggatatccagtttcctaagctcttactggctagcaatttcgtcttaattttattgctaaatgttcaaattttgcttccaaactcactttatttttgcagatgtgtacatctgctaaatactaattttatgtaaatgattttgttgattatctttccacatcttaaaatgtttctaacagctttgagattttatctcaacaggctctctctgaccccaaagtagtacttaccttcgtgactactgacaaagtcacaaaatgcaggcgatgtcatgtatttcggtacaactaaatctaggaaacggttttttcattgcattactgcatattttcattttcatttaaattatgntaccgcgaagggnatcgtctagag

SEQ ID NO: 409927 - DNA, 387 bp, Homo sapiens
aactaaatgagtcatgtaatttccaaatccatttcatacaggtgaagtatatgtgctatgtagacttcatcagagcgtactgttttgagtagggacagcgtgttttgcatgaacacatcacagtcccatttccgtgaaatgagattggcagatctacagaactcccaggtgttctgctgagtgtagccctggaggacagcaagtgctgtattgtcgtcaatccaccatgggctgcttctcagaagcccagtaatcccacaaatgataggcttgtctgtgattgcaagtcactgactatggacccggtcacctttttcttctatgtcactgaaatttattgacttgaagaggagtcatcctctttgtgacccccccacccaagtcaca

SEQ ID NO: 409928 - DNA, 438 bp, Homo sapiens
aactccacaataagaaaacaaatgccttgattaaaaaaatgggccaaataccttcacagacattttacaaaagaaaatataaggcagtgggtaaccatatgaacagatgatccctaatgtatatcagagaaatgcaaattaaaacaacgagatacggctacatacctattagattggtcaaagttcagaacactgacagcaccaatgctggcaaggatgtggagttacaggaactctcgtttattgctggtgggaatgcaaaatgttacagccactttagaagttaaggggagggaaagcattaggagatatacccaatgtaaatgatgagttaatgggtgcagcacaccaacatggcacatgtatacatatgtaacaaacctgcacgttgtgcacatgtaccctagaacttaaagtataataaaaagaaaaaagaag

SEQ ID NO: 409929 - DNA, 532 bp, Homo sapiens
ggtaagaattgcatatgttatgcataccctaatcctgttattcacagtaaggttgttagtataatatactactgccttcttaacaagtgaccacagttcattttcttgatattgaaaatctccttaggaagttctgtctattaccaagttaatgcgttggcattcttggatttattcttttaaaaatatttgctgagatcctgttatatgtcaggtcccatcctaggcacatatttatattaattctctcacatgtagtgaacaagtatttattttcaagctagcaaaaggaaatcaaattgttcatttcaactcatgtttaaaacgtgccacattgttagggcttagtcatactttaaatttagcataagagtttcttgagtcattcaatgctgtatatagtgagttctatatacctggtttaagccttcataataaaggcttgggttttgctgccatttgtaatgatagggttaaaaacaagtacacagttttatacctctatatgaaaatttttcagcaaggtatcttg

SEQ ID NO: 409930 - DNA, 439 bp, Homo sapiens
cattggaagatattgtaggggcaagtctcttaatcctccgtaattaaaactttggataattttataggttccttcctccagtgggtaacagaacagattacatcaatgttttatgttcacttttaccctaattgttcatcttcaatgtgtagactttatgggtatttgcaagaacatgatcaatgatctacagcacttgaaatagaaaaatgaaactgatgaggaattatgactgctcatattattctgtccctgttttgttttgctagtgcaaaactagtgtttcttatcatccttgctcatacattatgttcatggccttttgggtagactaggagggaaagagatagattaaataccctttcttatctgccatcctgtaccatgctcatcatttcctttattttatgaaacagaatttgcttatgttaaaaaaaaa

SEQ ID NO: 409931 - DNA, 625 bp, Homo sapiens
ccaggcatgccccagtccacctcctccacgagagactgatacaccaggtctctgtgctttcctgaaatcagaagcagctgatgcagcagtggattttgtaaacgtcacaggcaggacttggtactaggaacccatgaaggttgccttcatgaacagctatcactgagaatatgttcatggcaacccctagaagcttttgttttaggctatttcttcttgtctcttctggaataacccaagtatgagcactccgatgttatagtccagggagggactttgcaggatcatctagaccatcaccctgctgctccttgaaaaagaaaatagatggctgggcacagtggctcatgccggtaatcccagcactttgagaggccgaggcgggcagatcacctgaggtcaggagttcgagaccagcctggccaagatggtgaaaccctgtctttactaaaaatacaaaaaaaaaaattagccggatgtggtggcgagcacctgtaatcccagctactcgggaggctgaggcaggggaattgcttgaaccagggaggtggtgattacagtgagccgagattgtgccactgcactctagcctgggcaacaaagcaggactgcatctcaaaaaaaa

SEQ ID NO: 409932 - DNA, 536 bp, Homo sapiens
tggcacaggtaaaaaacagcagaaaagtttacagtgcacgaggtaatggggtggaggttcgtggagccagctgtctgaacttcctgcctccaccttccaaccgtagcttagcttacctgtgagcccttccaggctctgtgcttctcactgtctgggaagccctagttgagtgcctcacgagatcttcgggcattagatcttgcccagttaagccattgtatattttattgatttgaagatttgttaaaagtgcttttaaagagaaaaatgtgagaatatttgattcctttaaagacccttcaacaaccacatggaggagttcttctctgtttttatccaaaatggagtatggtttacttgactagattatttgtattaacagtgaagtatttgtgtgtgtgtgtgtgtgtgtgtgtgtgtgtgtgtgtgtgtgtgtgtgtgtttgtttttttttgaaacagagtctcactgtcacccagcctagattgtgccactgcactccagcctcggcaacagagcgaaactccatcacaaaa

SEQ ID NO: 409933 - DNA, 1057 bp, Homo sapiens
ccggtgtccgagctgctgtagcccctacgtggtgagtagatcgtctccacagaaatcagcggaggcttccacagtccctggttggaatggaaccggcggtgaggatgagaggcgctgaagaccagaagacccagggcgtgaacggggcgtgtcatccctggagtttcagtagaatttcaggcctgtctgcttgagcagcagaggaggagtttctgtgtgcctgtgagagactgtgtgtgtgtgtgtgtgtgtgtgtgtgtgtgatgaatgaacagggttgtgtacgtgtgtgtgcgttagacaaatgaacagtgttgtgtacctgtgtgaattgtcactgtgactccaggctctaggctctgcagattcctcagccctatcgcctcacagacacttgggatgtgcagcaggtaaaagagagaagccagattcatggaggcgtgaaggatcccagcaagaaaacacagacttgatcttgagacgagatttttgaaattggttgcggcctcaaggcaggctctgagaagactcgataaagagttctcaggaataggcatccctcctggatatttcccccttggaagcgccgaggagccagctctatgtttgtaaccatagcatttctaaagctccagccccaggaacctgctgtgaattagagacagattccaccctagacatcagtgatcttggcctctcttgtattgggaaggtcaacactgttccagtttctctcctactcccatctggttgtgctcggtgaagtaggtgagcagtgctacccttctgttaaaaaaaaaaaaaaaaaaaagatcctgaaagaggaaagaatttttgctacacatctgaaagctaaagtccagttgaactccagaggagaacacagcccaggtaacccctcgtttgcagcctgtgagaccagcctgaggacagcacccagctaaactccaggtccatggaaactgtgagattttatatatttatgttgttttaagctaaattcgtggtaattggttatggtagcaactgaaaattaatgcagtaagaaagtctaagg

SEQ ID NO: 409934 - DNA, 315 bp, Homo sapiens
aatggaggaagcgtcgacgaatgccaaaacaactatgctgaaaacagaagtcaaatactacagacatgttggcacatagaaatgtgtttatggccaatgattgggtctctacagtataatcacttttgaggctcattcatagcttctctctcttatttataaataaactgagttccaggcttctgacttctgagctcagccacaaggaagccatgctaggtatgcagggctggacatgtattcagttagcaaatattgattgaaggcacaaggttctaggcgttggtcgacgcggctgaacactcaaagaggaaa

SEQ ID NO: 409935 - DNA, 727 bp, Homo sapiens
  misc_feature (674)..(674): n is a, c, g, or t
gccacccgggttcaagcagttctccctgcctcagcctcctgagtagccgggattacaggcacgcgctaccaggcccggctaattttttttttttttcttttttggtagaatcgaggttttgccatgttggccacgttggtctcgaattcctgacctcagttgatccgcccatctcagcctcccaaagtgctgggatttcaagcgttagccaccgcactcgaccaaatgacactgtcttaaatgatttaatgtcttaaatcgggaaaggagagtaagagaaagcactcaatggagtcagaggtgtcttgcagcctagctctttccacagacaagccacatgggcctatcatctaaccttttcaaacttctccaactgcttctgtgatggagggatttgggctagaggatctttttattttattttattttattttattttggtgacagagtctcgcactgtcgcccgggctgaagtgcagtggcacaatctcggcttgctgcaacctctttctcctgggttcatgcgattctcccgcctcagcctcccaactagctgggattacaggcgcacgccaccacacctggcttattttttgtgtttttggtggagacggagtttcactgtgttggcagactggtctcgaactcctgacctcgtgatccgccacctcggnctcccagagtgctgtgattgcaggcatgagccaccgcgcctggccgatgatcc

SEQ ID NO: 409936 - DNA, 447 bp, Homo sapiens
gctattttcatgtcagatgcacgtgatgtattttaatagccccctcatgaattctgttagtcacttctttccaatatataggtacaatctggattaactcaggtgtatgggaaaataggatggaatgagattgtctctgctcttgtagtagaagcaaaactgtgaccatttttctgactgatttattttttgaatattgtacttatattttctcaggtgatgttgatgtacccccaggtcagcactttgaacacttgaacatctatgaaatcacatagtaaagtgataggagatggggctaagcttttaatggcctttagacatagcattagacataacctaagctgaaaggctttgggaagttgttgtgttaaatccccaacacactctcgtgttttcttaggacttgcctcttatttaaaaaaaaaaaaaaaaatctagccaact

SEQ ID NO: 409937 - DNA, 408 bp, Homo sapiens
ggcaggaggagggagagttctggcaccttccatgaggcactcaaaggaagacctgccccttccaggccccgcggttcctcctccacttggtcagctctggcagcagggaagggagccccgggcctggagtcaggatgcggttctgggccagatcagcctctcctaggctgggagagctctaacggggccccggcctctcgttccctagctggagaatgtggaaggttccacaatctcagacccttgcctggtggctctcagccatgactgcctttagaatcacccgcggagtttttaaagatttccgtgtctgaatccgcccaagaccaaaaccaagtcagtctctggggtggccggtcaggggtggttcctcacaaagctctgcaggcaattccagggtgcagccag

SEQ ID NO: 409938 - DNA, 329 bp, Homo sapiens
ggtcatgccattgcactccagcctccaacctgggtgacaagagcgagattccatctcaaaaaaaaaaaaagaaaaaaagatcccttggcctccagagagcccacaatgcatgaaaagtaacagaggaaaagaagcaggtatgtgagatagcagggaggtgaagggagtggacagacaaggttgatgccacaagtcacataagaggggccaggaaatagccactggatctaccagcaagaaggctgatagtcgggaggatcatttgagtccaggagtttgagaccagcctgggcaatgtagtaggactccatctctacaaaaaaaaaaaa

SEQ ID NO: 409939 - DNA, 343 bp, Homo sapiens
ggtcatgccattgcactccagcctccaacctgggtgacaagagcgagattccatctcaaaaaaaaaaaaagaaaaaaagatcccttggcctccagagagcccacaatgcatgaaaagtaacagaggaaaagaagcaggtatgtgagatagcagggaggtgaagggagtggacagacaaggttgatgccacaagtcacataagaggggccaggaaatagccactggatctaccagcaaggcatggtggggacagcttggtctagatgccactgagcctcataggaagctggagaccgtaggattagtgctggtgacatggaggtctcagctagcagcagacagt

SEQ ID NO: 409940 - DNA, 243 bp, Homo sapiens
tttttttgtactgcgtcaacattttcttggtacccttggcttcattacaaaaataatttgcaggctcaaaagacaaatgtctaaactaaaaatcctggaacctgttttcataaatcatgctatcttactatgttggcaatatggtccacctgcttcatggaaaatgttcagtaattcaataacctggagtaaatacaaatagcttccccttggtttgtgctgttgactctgctgggaatttcc

SEQ ID NO: 409941 - DNA, 1012 bp, Homo sapiens
gcggccgcagccgcttgggactcgctgcgagctggtttcggatccatcccgcctcccggcgtctcactgtgtgccctaccctttgaaacacgcccccgcgcccgccctgccgtagaccaggcagcgaggaagcccacagtctccgggggcgctgcgcgcgaagtagcacgtgcttctcgaaacaccgcagcccccgggtcccgccccgcccggcgcgcgcactcgaacccgcccagagagcggtgcgtggcgctgggtgcgagcagggtctagccacccccaccctcaccccaccccaccccaccctgcttttttcaggttcatcaaggtttgcgcagtggatccgcgaatgaagccagcctggaagatccccagtctcgagacagagcctgacaggggcagatgcactggaaggaccctgtctgggtttagcaaccaagcagccatcctggccccacaggtgtgggacttctgggtcttctcctggctggcttcttgctagaggatttcaagagacccagcaagactgtattgtcccactgaatgctcaagatattggttagaagtagaaaaggggagggggtagtatttagcctctgtccccactaaaaattattcccaattgtcatttgtgtcatctgtttagcttacagttttaatccttgtcaaaatgatcatttgccagggtgcataaaacaccctatttgatgagaactggttttaaaggaaaatggggccatcagaaggaagccggttggtgtgaagagacgtctgggaagagcccctggcgagggccctcattccactgggtgacccagaaggagaaaaccgcgatggcgcttctcatttgaaatgttttctttatggacagtgtttagcaattgttataatgtgtacttttgttgattgatctgtatacatatgtaaaataatttgttctctgagttaattttgttggaacaaagactttagtgcttcctacattaaaacattttactgtaaaaaatgcatt

SEQ ID NO: 409942 - DNA, 906 bp, Homo sapiens
gcggccgcagccgcttgggactcgctgcgagctggtttcggatccatcccgcctcccggcgtctcactgtgtgccctaccctttgaaacacgcccccgcgcccgccctgccgtagaccaggcagcgaggaagcccacagtctccgggggcgctgcgcgcgaagtagcacgtgcttctcgaaacaccgcagcccccgggtcccgccccgcccggcgcgcgcactcgaacccgcccagagagcgaatgaagccagcctggaagatccccagtctcgagacagagcctgacaggggcagatgcactggaaggaccctgtctgggtttagcaaccaagcagccatcctggccccacaggtgtgggacttctgggtcttctcctggctggcttcttgctagaggatttcaagagacccagcaagactgtattgtcccactgaatgctcaagatattggttagaagtagaaaaggggagggggtagtatttagcctctgtccccactaaaaattattcccaattgtcatttgtgtcatctgtttagcttacagttttaatccttgtcaaaatgatcatttgccagggtgcataaaacaccctatttgatgagaactggttttaaaggaaaatggggccatcagaaggaagccggttggtgtgaagagacgtctgggaagagcccctggcgagggccctcattccactgggtgacccagaaggagaaaaccgcgatggcgcttctcatttgaaatgttttctttatggacagtgtttagcaattgttataatgtgtacttttgttgattgatctgtatacatatgtaaaataatttgttctctgagttaattttgttggaacaaagactttagtgcttcctacattaaaacattttactgtaaaaaatgcatt

SEQ ID NO: 409943 - DNA, 543 bp, Homo sapiens
ttttttttttttgtagatagggagtctcactgtgttctccaggctggcttcaaactcctgacctcaagtaatcctcccacctcagcctcccatagcactgggattacagccatcacctaccactccaagccatgagtttggctttggatttaagaaggttgaggtgttcatgagttgacaagtggaaaaaacaagaaagaagttgagtgtttaagactgctgtttgaaggagaagtctagcctcaagacaaaagttcaggactcatcagctgagaaatggcgctgaaaattatgcaaatggatgagctcagctagcaaacaagtccagagagagcagcactgggctatgcacctggcctaatgcttccctgctcctcccaatccctgtgttatgccggagagggttcagcctctggtgagtttcaccaaaccgccacatctctttcttctgagaccttctctaaaatcccctcttttatgcttagtgaaatgggattctctttttcccatccagcttaagcaaaaacttttgactatgagaag

SEQ ID NO: 409944 - DNA, 495 bp, Homo sapiens
tagagggtcaaactccttggcgagttcagtctaacagaggacacattactgccctacaaagcagctctggaaaatgacaaccagtggcactaactccaggcaatatctttgtgaggcttgtgggctgtaatatagtctgctcaggctgccataaaaaaaaaatcacaatcaggccaggcactatggctcacacctgtaatcccagcactttgggaggccaaggagggcagatcacctgaggttaggagttcgagaccaggctggccaacatggcaaaaccccgtctctactaaaaatacaaaaattacccggatgtggtagcacgcaccggtagtcccagctactcgtcaggctgaggcaggagaattgcttgaacctgggagaggtggaggttgcagtgggctgagatcacaccactgtactccagcctggacaacagagccactgcactccagcctgggcaacagagagagactccatcttaaaaaaaaaaaa

SEQ ID NO: 409945 - DNA, 764 bp, Homo sapiens
ctaagctgaatgtatctgtgatccggttgactaggtaatatgccatgattcacttctgcagtagcctggcttgcctcccctgggtcactgtgactctgtcatgcccctgagcatgggagaggttgacatcatgcacacatgcacatgtgctagattgtagatctgtagtagtgccacggtgtctgcctctgtagtcccaagaagaccagcattctctctgcaaagtgaaaggagctctcaccagccactagtggtatgggttttggcatttactttatgacaggagggagaatagtgttttgatccatttcttataagcaggttatttgtataattataaagcttttaactcaaggaaacattaacggcttagagaatcccaaacccctcgaaattacatgcacaatgttagagactacatgtgagcatttttttggagagaggtccgtagctttcatgaagttcttagaggggtccattatgttgtgtcttctttccctggagcttcagggtctgtcagagaagactgtgaagagagtagcagccttcagcaagtccttggccacatggcacatgtgagaacaccccacaaatcggtgggttagccggtggaaaggagtcccagcatcttccctggtttttaattcctggcctcaagcaatcctccctccataacctcccaaagtgctgggattacaggcgtgagacaccatgcgcagcctgggtaatagagtgagactccatctcaagaataataaaatttt

SEQ ID NO: 409946 - DNA, 416 bp, Homo sapiens
gtgccacggtgtctgcctctgtagtcccaagaagaccagcattctctctgcaaagtgaaaggagctctcaccagccactagtggtatgaaaagcagaactcttttgtccacaaggctgatgccccttagctaagtggcctgtggttttggcatttactttatgacaggagggagaatagtgttttgatccatttcttataagcaggttatttgtataattataaagcttttaactcaaggaaacattaacggcttagagaatcccaaacccctcgaaattacatgcacaatgttagagactacatgtgagcatttttttggagagaggtccgtagctttcatgaagttcttagaggggtccattatgttgtgtcttctttccctggagcttcagggtctgtcagagaagactgtga

SEQ ID NO: 409947 - DNA, 385 bp, Homo sapiens
ttacatgcacaatgttagagactacatgtgagcatttttttggagagaggtccgtagctttcatgaagttcttagaggggtccattatgttgtgtcttctttccctggagcttcagggtctgtcagagaagactgtgaagagagtagcagccttcagcaagtccttggccacatggcacatgtgagaacaccccacaaatcggtgggttagccggtggaaaggagtcccagcatcttccctggtttttaattcctggcctcaagcaatcctccctccataacctcccaaagtgctgggattacaggcgtgagacaccatgcgcagccagatattttttattgttgttgtttttttttggaaaaggagtttcactcttgttaccca

SEQ ID NO: 409948 - DNA, 418 bp, Homo sapiens
ccaaaagacaatggaatgacataaagtgacctagaatgccagcctagaattaatatatacccagggaatatatcctttaaaaaacgaatgcaaaataaagacattctcaggcagacaaaaactgagaagaatgcattgcctactctacaagaaatgcttttaaagaagtttataagcaggggcatggtggttcatgcctgcaatccaagtgctttgggaggctgaggtgggaggatcgcttgaggccacgagtttgagaccagcctcagcaacacagtgagaccttgtctctacagaacattttttaaaaattagctgggcatggtggcacacacctgtagtcgtggatattcaggaggctgaagctgtgatcacaccactgcacttcagcctaggtgacagtgcaaaaccatgtctc

SEQ ID NO: 409949 - DNA, 1013 bp, Homo sapiens
gaacacaagatagtctttattaatagatatctgggaaatcttttattttttaaacattacaacctgacctaacattgtgaaggaagttttctctgccttctccttttaccttttctcagagtaaccacgaaataaatttgattctcacctctcttcttaccttaccccaagagagaacttatttacatacatatacatataaacacagtctttttcataaagtgtgcaatgggatgatgtgacctgaaataggctataccattttctccaaaggctgaatattatgaaaaacagaaattccccagagaacttttgagcagctgctttgaataatgattactgtttacttaactcaaccattccaacatcacccaatcaaaactcatttctttcttggccttataggtttattggtaaatggctgagacaaggccaataatggacacctgccatctccttttgtgtttgggctggagggcaaggagtggggggcaccctaactgggagctgttatcaactggaccaataacagtgaatccagagagacttcaaagaaataggattcacagggactttaaaagtgaggaactgagaatctgtatatacaatgtgccacgaatcacaggtcgaaccagcatcattttgccaagaaagtcaatcatccttttgtctctaacagtaataattgctgtatgattttctggaagaagtaagcacaacggttatatctgcccagcgttaatgaggaaagaggttgtctagttccaactcagtgaaattgcctgtctgtggcatctttcttgaaataatagatgcatactgtagcaacctatttataacatgcaacatatctttaacatttcatattagtctcatacatatatactaaagatttgctttaaaaacccttcatataagtatttccaaggtgtgtgtcattgcaaatggtagctaatgatgacttcttttttttcactatttgaaaggccactgggtagtctaaaaaaaaaaaa

SEQ ID NO: 409950 - DNA, 506 bp, Homo sapiens
  misc_feature (447)..(447): n is a, c, g, or t
  misc_feature (467)..(467): n is a, c, g, or t
gaacacaagatagtctttattaatagatatctgggaaatcttttattttttaaacattacaacctgacctaacattgtgaaggaagttttctctgccttctccttttaccttttctcagagtaaccacgaaataaatttgattctcacctctcttcttaccttaccccaagagagaacttatttacatacatatacatataaacacagtctttttcataaagtgtgcaatgggatgatgtgacctgaaataggctataccattttctccaaaggctgaatattatgaaaaacagaaattccccagagaacttttgagcagctgctttgaataatgattactgtttacttaactcaaccattccaacatcacccaatcaaaactcatttctttcttggccttataggtttattggtaaatggctgagacaaggccggggtggggctgnggagaagcatcatggatggnctaaaaccatgattggtcaatatgaggtacaaagctggg

SEQ ID NO: 409951 - DNA, 591 bp, Homo sapiens
aggagatttggtgcaggagttaggacaaagactcctgggacagcagccctcacttggggccatagtgaatgaatgggggccttttgcagaagggaaatggaggacatgtgtggtgaaggctttgctgaagcatctcttataaaaggggcaaaagcacttgctctcctcccagctctggctcagcctctctctcttcaagtccctggcatccctggaaaaccatgatttttccattctgcagccagcccaggcacctcctcccacccccgcacactgcagtctggtgtgtgtggtgggcacacatagaacacttgctggtcttgaaaatgaagccatcttttggggcccctagaaatcaaagagacccacttagccaagatatcactcttggacaccagcaagggtgagatcacttgataggtattttgccgtgtgtttctttttaactatataaaaaacaaaagggtggatgtgcaaacccaacccaagaataccttggctcaggctcaactagatgaaacttttaaaaatgatttaatgttatgttagactgttgcatattaaagcgatgtaatgccttctaaaaaaaaa

SEQ ID NO: 409952 - DNA, 614 bp, Homo sapiens
aattcattcagttgagaggcacagttagtctacaagctgagatacaggctgccaaatttaagataacgatcagtgagatactcgctaaccactcctatccctaggttagaaggtgaaacattattatgccaaaggataaaatcaccttaaatccctagcactgaagtcatctacttactgattagttctcactctatcttatcacttttatttaatctccagttcagaataagtttggttgatgaagcagactagaagtagaaagcactaaaaagtgtgggtcaggaagatggaggaaagggagaggaattcgtagacagatataacagtgtaagtgatagctgtacttcttgactttgaagcataaaagggaaaaaaataaacgtatgctgtctatgataattatcctggattattaaaaaatttataattcctatgatctgaataaaaactcaggaaatatacatttctaaaaaaagtttatccacagtggttttgtttgtttgtttcgtatgagaatgataaaactcttagcagtctttaaaaaaaaaaaagtcacctattagaatgtatagtccatccccacacctggctccaggggtactagataaata

SEQ ID NO: 409953 - DNA, 1536 bp, Homo sapiens
acgtggccgtgggggagggagcgggaggcgctttgtccgcctcgcggcccagctcagaccccggggccgctgggctgggaggggtgctgcgccccgtggccctgcccgcttcatcgcggctgtccccgccccgccgcgccccccatgcccccgcgtccctcctctccgctccccctgcggctgagcctgccccgagcgcgaagaaggggccgtctcggttggttttgaggaagaacgacagttcgagtcgggggaggttctcgctttacaaacaggaaaccgaaaaccactgacacactgtagtttttctgattgtagccggaggcggggccggtcccgcatctcgactgtagctccggtccctttctccaacctatttctctcccagcccccgcccccctagcgcccttccacggaggaggagattcactttgtgaacctgagactgagaatttaagaggcactgaaggtttcatgcctgcccaccccgcgtcctcttttcgtgtatttgtacaccccacgcgcatggattgcggagaaatgggctcctttcgggaggctccaaaattcccgtgccacagaatctctcacaacctttggggatcaaggactgctgtggcgtttacctcgccagctgggggaccctggaacaaaagccagtgccgttcccagtgccgggtctctggacacggcaagatgagtagagtttgcgaccagaaactttcggtgtttgggttgtgttctctggtttccgccctggtggagggagggctcgggtgcgcgcgcctggtttgtgatacactcgcaggtggaagcaagcccagcctcctgaccttactgggaagaagacagcaagcccaagccacagcttacttttgaaaatagaaagataatgcttgcttcaatagacagagacatcagctgtagatttcatagtgaatcccagtttagcaaattagcaacaaatagacttgaaagatgactgcctgaaaataaaattttctatcattttatgacaatgatttagcctgttgattagacttacgcactaataaatgccagggctgtgtacagaataggagtgtattttagcttcagctgtttcacatgcatctctcactggtatgtgtgatgagtgtgatgaatgtaatgtaagccttaactcttaagcagagttgcaagtaaattctgtgtaccaaaaaaaaaaaaaaaaaagaaagaaacatgctctacaagttatatttccttttaaaataattagtttaaaagttaaccttggcttctgagagtattttaacagtctgtattgaggtaaaatctcaaaaatagaggttgtaaagaaaacgttgctcttcattttcttgaattgactgcaggattatagttgtactccagtgaggcacagaacaattaaatgtagttctcagattgggcgctctatttggaaagccctaaagaaaaacaatgatcacccacaaccaaataataataacggtgatataaaaataaagatgaataggattctttactgtttca

SEQ ID NO: 409954 - DNA, 253 bp, Homo sapiens
tttcctcctggaagaccaattccctcctctctacttctgtctttaccttatcaagtcctaagtcaaatccaaccttttgcattttttagaaaaaaggtctcgttctgtttgttgtccaggctggagtgcagtggtgcaatcatggctcactgcattctcaaactgtgggctcaaggatcctcctgcctcagcttccagagtagctgagactacaggcacctgccaccatgttcagctaattaaaaaaaaaaaa

SEQ ID NO: 409955 - DNA, 1117 bp, Homo sapiens
ggatgggggaacgaccaaagcaaagccacacagggccgcttcccggaggaagtgtcaggaggcaggtggtctctggggaggcatgcgcgggcgcacacaggcgtgtctgggcagcaagcactcgatggctctttcttctcctcacgctgcccaccatgggatggcaaacccagcccctgacaaggctttggtgggaagccgagactgggtggagggcacaggacccaaaggtctccacactcacagtggctcccagtccccggcagggggcaaagcctgagggaaggctctttgcccagcagccctgtccaagtctgaccctgaaggtccgggggtgataaaaggtaggccagactttggggagaaggtcagagacctgcctggatggggagcaggagtgggagggagggctgtgtatcaggcaccttgtgccttcatttgcaactgcgacagaacctctgggaatcccggtgtgggggaagcggctaccttgggagctggcacggaaccaagagcaacaccagcctgctcagcacgacctggactgggaggcagggctgggtgtcctggagccctgggcaggcagcaggatggggtgggagttaaggaggtctggggaggagaggcttgggcggtacttggcagggagttctctccccagcctgtcaaagcctgctacaccatctcaccagacactcttccgagcccaggcgagccccctactctccccatggcagagcagtcatttggggaaacaggaaggggggcaggctgtagcctgtccccttcaagagaaccagagctctccatgcctgccaaggcccaagagaacacacctcaggatgtctgtcacagggaagaaaggagggggagaagggaccagagagggcaagtctgtcccccttaggagaaagcaccaaagggtggaaggaaggtttccgcatcccctcgctctggaagctgggagctgagggaagaggcaaggggttgaggcctggtgggggcttcaatgtccgcacagcactggaggcagacaagatggtgtgggggaaagggcagggcacaggtgctctctctcagtctctctttccctgcaagctcttgctgatgccagccg

SEQ ID NO: 409956 - DNA, 482 bp, Homo sapiens
ggctggagcagctgggatgcagggctcctgggcctggcctgtgaaaccattttttcctcctaaacttctgggcctgtgatgggagggcctgccttgaagacctctgacacgccctggagacattttccccattgtctttggctcctcattacttacgcaaatttctgcagccactactcaggaggctgaggcaggaggattgcttgagcccaggaggttgaggctgcagtgagccatggttgcagcactgcactccagctttggtgacagagtaagaccctgtctcaaaaaaaaaaaaagaaaaaatacaaaaagatctaacatgctaggagattcagtaaaggtagaggtggtagcagaatgtgttttatgttttagtttaatgaaaaagaaactatgttagcttgtggacataaaattggagtgcagtagcaacaaatgtgaagtgtctacttctgctagtacctacccattagtgtttg

SEQ ID NO: 409957 - DNA, 248 bp, Homo sapiens
tatattagcggccgctcgacccagaagtctagaggtatatttccaatggtcggtcatcttagatagctcataggcttctcacatctaatatgtttgaaatcactcttgatttttcttttttttcaaatctctctcacttagtgtctcccattttaataagtggctttatcatttacccagtaagtcaggccccaaatcttggagttatccttcattttttttcttctctaatttatcaccctgaatcc

SEQ ID NO: 409958 - DNA, 373 bp, Homo sapiens
tgtccaggttggtcttggactcctgggctccagcgatccacccaccttggcctcccaaagtggtgagattacaggcaggagccaccacgcccaggctacatgcattcagtaaataatgttataaacaatgtgaattgtattcacgtaatcatcaaatatctattaaatgcttactgcatggaagggaccataccaattatcacaggagacaaaccgaagggtcagctgagatccctgtcctcaccagggtaatggggagtggcaaggacagttctaaaaacaatgtttatgtcaagggaatgtgatcagtcattcgcgatataaacaaaacaatgccgtagttcagaggagagaaagatcatctgtttggaag

SEQ ID NO: 409959 - DNA, 450 bp, Homo sapiens
gcgtcgacagcctgggcgtggtggctcctgcctgtaatctcaccactttgggaggccaaggtgggtggatcgctggagcccaggagtccaagaccaacctggacaacattgcaagactacatggtactattcacacccaggctacattgtactattaaaacagaaaacaacttttctagcattcagtaaataatgttataaacaatgtgaattgtattcacgtaatcatcaaatatctattaaatgcttactgcatggaagggaccataccaattatcacaggagacaaaccgaagggtcagctgagatccctgtcctcaccagggtaatggggagtggcaaggacagttctaaaaacaatgtttatgtcaagggaatgtgatcagtcattcgcgatataaacaaaacaatgccgtagttcagaggagagaaagatcatctgtttggaag

SEQ ID NO: 409960 - DNA, 230 bp, Homo sapiens
aaatgaggtatatttgagagggtcaaatattctaaaagaatatttcagacaccacctcctccagcaacaaaaatagctacaaaccaatataaatttcatgttagttattttcatacatattgaaaactttactgtacattaaaaggttgtacagacagccctccatatctgtgggtttcacatccatgtattcaaccaagcatggatcaaaaatattcagtaaaaaaaaa

SEQ ID NO: 409961 - DNA, 379 bp, Homo sapiens
tcattagatggtgtaatcagaatgtatgggcgttagaagcagattgaaagtgctacataaatatattactaattaactactttaatagcagcaggatttagactccaaacttcattgattcaaagtggtagaagatgatggaggatctctattcactcccctacacccaccatcttaattctaatggcaaagtagacatttaaaaattttaccctgggggctttcacagtgcctgccctacctcatgaggtcagttcccaaattaaaatttgctactttactcagctgagagttagtagtaataatctattgaagcttaagtagtttttaaaccttttaatagtcacccctcttaacctcccactgccaaaaataaaaa

SEQ ID NO: 409962 - DNA, 259 bp, Homo sapiens
ataataattgagaaaaggaataataaggtggaaattatggaattctagaaagggacaaaaagacatactgagaaataaggaaatatagctctaatacaagttgtcttcagacactgtacacattcaattataattatgtttagcagtctctcccacaagaccaggagttcctcaagagcagggactgttttgaatttactacctatttgggccttggttagttaacatcaaagtttcgtgattaaaaaccagaaaattt

SEQ ID NO: 409963 - DNA, 796 bp, Homo sapiens
aatctccaataatttaccttaacccccgaggccaaagtttccattaacctaaaattgggccccgggcctccaccttgggcccaaaaaaaaaatcccttttcaggggaaaaaaaaaaaaaaaaaaaagctattgttttaactcccaccaattaacccatacaacagccatgcttattctactttcctctttctctctcccattttccatccaatttttattacaacatgtaacatttgtatatttgtcttataacttcaccttagtgtttttgtaatacatttggatatattaaaatcctcagtataataagttcttttggccaggtgtggtggctcactttgggggtactttgggaggttgaggcaggaggatggcttgagcccaggagctcgagaccagcctgggcaacacggggagaccccatctctaccaaaaaaaaaaaaaaaaggccaggtttgtagcatgcatctgtagtcccagctacttgggaggctgaggcaataggattgctcaagccaaggaagtcaaggctgcagtgggctgtgttcatgccactggactccagcctaggcgatagagcagtgggctgctgtgttcacgccactgcactcgaccctaggtgacagagcagtgggctgttcatgccactgcattccagcctaggtggtagagcagtgggctgtgttcacaccactgcactcgaacctaggtgatagagcaagaccctgtctcaggaaaaagttcttttgctgaagtttgtacagttatctgttggttggatgaagcttattctct

SEQ ID NO: 409964 - DNA, 433 bp, Homo sapiens
aactacaaattgtgatgcatactgtgaaggaagagagtacagcaagcagtgatcaagatgacttgcatcacaaaaagaggatgtataaagaccacaagtttaaattaaataccataacaaatttaaattaaataccataaatttcctggtacctctttagctactttttggaacacaacaataaatcttttgtgttctgatttctatttttttccaaagtactggttcattattttatcccccaaattgtgtagcaccacagagcagcatacaaaaatacggcaaaaattaaaaccaatgaattgtatgcttcaagactaaaaatattaattttggctaacttcttatgatttcacttttatcatgtatggtgtaatattttctctctcctttagcatactataatcttttctggtaaataaaagcatcggtg

SEQ ID NO: 409965 - DNA, 150 bp, Homo sapiens
tgggattacaggtgtgagggaatcacattttatattcccttcaaaatacaagtgtgtgaaggaaccggtgttttaatccaagagtgtaagaacgatttcaaacaaatggcaccctttacaaataaagaaactacatacatttaaagcttt

SEQ ID NO: 409966 - DNA, 182 bp, Homo sapiens
gcccaaaacagaaagcaaggcaaatgatcaatggtgcaactattctaaatccaatgacatacatacacacacacacacacacacatatgcccttgctaatattgccattgccccacagtgccttacacatatatggtaagaggtacaaagaatatgtgaggcaaccaagtacaaaaaaatgg

SEQ ID NO: 409967 - DNA, 468 bp, Homo sapiens
tgagacagagtctcactctgttgcccaggctggagtgcaatggtacaatctcggctcactgcaacctcctgagtagctgggaatacagacatgcatcaccatgcccagctaattttgtatttttagtagagatgagggaggtttcaccaggttgcccagactggtctctaactcctgacctcaagtgatccacctgcctcaacctcccaaagtactgggattacaggcatgagacagcacacctggcctcaagtttttcttttaatgcataattttacatatggaaaaccctaaagactgtatgaaaactattagaactaataaatgaattcagtaaagttaaagttaggtgaaatttctgtacactgaaaaccataaaacaccaataaaagaaattgaagaagacataaacaaatggaaagatatcctgtggttatgaattaaaagaattaatatttttaaaatatc

SEQ ID NO: 409968 - DNA, 470 bp, Homo sapiens
tttatttttgttttttgagatagagtctcactctgttgcccaggctggagtgcagtggtgcaatcttggctcgctacatcccctgtctcatgggctaaagtgattctcctgcctcagtctccggaatagctgggatcacaggcatttgccaccatgcccagataattgttctatttttagtagaggcggagtttcaccgtgttggccaggctggtctcgaactcctgacctcaggtgatccacccacctaggcctcccaaagtgctgggattacaggcctgagtcacctttttccacaggcggccgatctatggaaaacattttttgaatttaaaaatgagagcaagtctcagccaggtagagtggctcacacctgaaatcccaacactttgggaggccaaggagggacgattgcttgagaccaggagttcaagcccaccctgggcaataaagctacacctctgtctcta

SEQ ID NO: 409969 - DNA, 547 bp, Homo sapiens
acaatcaaccctgtatgtcagggcccttgagagcagagtagtgtcgggagagtgggtggtatggttgacacaaagacccacaggtatttttatgggttcacttaatgaagcaggggcttagttgagggtagagactgttcattaaaccagcctttgttgaccactccctgcagtatggacaggacatgatcaccatccttaagtcccactatagcaggggggaaacagtatgcttaattaagcttaattataaactctttgagttagaaaactggtgaaagtgttatttcctcctgaagtaattatgtatatatacatgccaattccaatcagaatgctaatttttctttttaaccccagagctgtgcaaaatgtttctcaaatttattcaggaacataaacaacagttggaaaggacaagaactgtctccagcataatggttaagaatgtggaggctgaggcaggacaatggtatgagctgagactgcactgcagcctgggcgacagaggcaagactccgtcttaaccaaaaaaaaaaaaaataat

SEQ ID NO: 409970 - DNA, 476 bp, Homo sapiens
tttttttttaactagaacgaagacaggagtgagattcagaggcagggttttatctacagtgggacactcaggactctacctgtggagggataaagtgctaggcatgctaataaaagcaagaaatatataaatcttttaaaaatacattagatgctacataagattttttccgaattttgtctaattagcatggactttttatatgaaaaatatttaaaatagtgacataacagttttaagctgagataaagttaatatgatctctctctggtttgggcttatgtaacccataagccataaggttatggcttttgacctctgggccattttaaagggacaatgagccttgcttcagctgcctcaagaagcttttactcactgtgaacacaggaaaaggaaggagctgtgaaaatactgccttaatatttcccaggatgtttatttgattagtaacagaaattctaaaaggctatgtg

SEQ ID NO: 409971 - DNA, 278 bp, Homo sapiens
tttcttctttgattttgttttggtatgttatatgtttctaagaatttatccatttcttcttggttatctagttagtccagtagcctatgaaattaccacgtaaaatgaaaacaattctgtgaggatttgttgagttttttcatccagattttataaatgtctttttaaaatcatctgaatagactgtctgatagtatcatgtaacaaggaacaagagattttcagtcatgtgtgatagaaactcaaatcaaactattttttaagtctgttgccttaca

SEQ ID NO: 409972 - DNA, 303 bp, Homo sapiens
acctgttgaaatgacagtattatgcatttattggtttaaatagaaattggtaaaatggatttcactcttttggtctactattaaaatgtagctactagaaaactaaaaattacatgtaatagctcgcatttgtggcccattgaacagtgttcatctagacacagaaaatctagatattgagtgtagacgagagggaagctttcaaaatagggctttgaatgaatatcttttatagaaacacaaaattatacaatgcagctgcgacttgggaaagtgggcattcagatggtcttgatcaaattt

SEQ ID NO: 409973 - DNA, 132 bp, Homo sapiens
ttttttttttctcatctagtatcagattttataagactaatctggacgaatgcctcaattcttgactttattccattcctctcaatggagccttaaaatactgcattgcagctaatcacatcaatgtcgaca

SEQ ID NO: 409974 - DNA, 527 bp, Homo sapiens
  misc_feature (21)..(21): n is a, c, g, or t
  misc_feature (43)..(43): n is a, c, g, or t
  misc_feature (73)..(73): n is a, c, g, or t
  misc_feature (94)..(94): n is a, c, g, or t
cattgccatcagactggtggnttttgggttcctcttttaatgngaatgctaatggtgtgatcctgttttaagnctgttgctgtcatggttgccnccagagaaggatctatccgctattggccaagccttgctggtgaagatacctacacagaggcttttgtagattcgggaggtgataagacttacagtttcctaacagcagtgcaggttcacaaagaaacaaaatctggctgagcatggtggctcatgcgtgcagtctcaccactttgaatggtcttgaactcctggtctcaagcagtcttcccgcttcggcctcccaaagtgctgagattatagacatgagccactgctccggccaggtctggtggactcttaagcacctaaagctagatgagcttaaatctcatctaagccaatatttataaaatgtatttgaccacaacatatggtaaaagctgatgttttatattctgtctttcaaaaatgttgagatctgcaaaatgacccgctgtttgaaaaaaaaaaaa

SEQ ID NO: 409975 - DNA, 472 bp, Homo sapiens
ttactgtgatatctgctgttgaggaccatgtaacagctgatgctcgtaacctgttcgatttcttgcttggttgtacagatctgatagtttttttttttttttttttaaagagacagggtctcactctctgtcgcccaggctacaggctggtgccacaatgcccggctaatttaaaattttttttgtagagacaaggtcttgccacgttccccaggctggtcttgaactcctggtctcaagcagtcttcccgcttcggcctcccaaagtgctgagattatagacatgagccactgctccggccaggtctggtggactcttaagcacctaaagctagatgagcttaaatctcatctaagccaatatttataaaatgtatttgaccacaacatatggtaaaagctgatgttttatattctgtctttcaaaaatgttgagatctgcaaaatgacccgctgtttgaaaaaaaaaaaa

SEQ ID NO: 409976 - DNA, 599 bp, Homo sapiens
cagaccagcctccaagataagatgtctggccaccacctctgcagccaaaaggggtggtgccgggggtggaggtgcagaatctgctgaggttggggagaatgattgaaagagggtctgaggggaattttctgaggtgatgggaatgttctacattttgctttggggggtggctccactgtgtatatcatcgtggaaactcctcaactgaacccttaagaactgcagactttacctaaattaacaaaaagtaccacttcctcagtgtgagggtaggagaggagctggctgtctcacctgtgagttaccaggcaattcacaaagttgtacaagtctgggctggagaaatagcattgaactctcctcccagttcaatgctatttctcaaccagagtcatttttattatgtcatctcatacaaactgataagaatgatacttcattagaagaagggacagaaaatggaacagtaatttacaagagaaatatatatggtcagtggcctctcctgtgaaatcttggttgataactgctaagttaccctcccaggaggttgtatcaggctggccttctacccgacctcccctggcctctagctcccc

SEQ ID NO: 409977 - DNA, 497 bp, Homo sapiens
ttttttttgagacgggatctcactacgtcacccaggctggaatgcaatggcacaatcatggctcactgccgcctcaacctcgcaggttcaagggatcctgctatctaagcttcccgagtagctgggactacaggtaaacaccaccacacccagttaatttttgtattttttagtagagatggggttttgccatgctgtccagggtggtcttaaactcctgggctcaagcaatccttctgtctcagcctcccaaagtactgggattacaggtgttaagctaccatgcccagcctgtatgaagttttaaaccaggaagtgagtcctccaacctttttattctttctcaagattgttttggccatttggcatcccttgagattccaaatgaatttcagaatcatttttctatttttgcaagaaatgttgaaattttgacaggcttgcattgaatctgtatatcccttcgggcaatactgacatgttaacaatattaagtc

SEQ ID NO: 409978 - DNA, 486 bp, Homo sapiens
aggagttcaagatcaacctgagcaagacagaccctatctctactaaagaaatattctaaaaattagctgggcatggtggcacacgcctataatcctagctacttggaaggctgaggcaagaggattgattgagcccagaagttcaaggttgtaatgacctgtgatagctccagcttgggtgacagggagattcccgtcttcttaaaaaatttttttcagccgggcttggtagctctgtaatcgcagcactttgggaggctgaggcaggtggatcacttgaggccaggagttcgagaccagcctggctaacttggcaaaaccccgtctctactaaaaatacaataattagctgggcatggtggcacccacctgtaatcccagctactttggaggctgaggcacgaaaattgcttgaacctgggatttggaggttgcaatgaaccaagatcataccactgcgctccagcctaggagacagtgaaactc

SEQ ID NO: 409979 - DNA, 466 bp, Homo sapiens
taaggagggaagggggaccttccttgaccccgtatattcctcctctagcaggaattaatcttccggcttccattctcagatgaacttcttgaaagagtagtctacatgcaccgccttcacactctcactttcatacattttctcaaaactctacaatacatctactgtccccattaatctactgaaacttctccaaactcaccagtggcttccactgtgccgaactcaacaaaacgtttcagtcttcagctctctagacctctctgcttaatgcaactctgttgataactcactttcctggcttccatgacacctctcagctctcctcccactctgtttcttctccatttccttcatgaactcttcctcctttgcttagcccttaaatatcttgttatttgggattccattctttgcccatgacatttttcaatgtctaaacattccctttgggccattaaatcca

SEQ ID NO: 409980 - DNA, 341 bp, Homo sapiens
gctactactaccaccccaaaggcccgtcgacgcatgcagatcaactgaggtcaggcgtgtgccaccatacctggctaattactgtatttttagtagatacgaggtttcgccatgttggccaggcgggtctcaaactcctgacctcagttgatctgcatgcctcggcctcccaaagtgctgggattaaaggcatgagccaccacgcctgggccaataggtgtattttttacgtagagagagcaaatgacaaagcaaaagagcaatatgttaataatagataaatgtgggcacaggtatgtaggtattctttgtactgttgctgcaacttttcaaaagtttgg

SEQ ID NO: 409981 - DNA, 455 bp, Homo sapiens
gctacaatgagctttgattgcaccactgcactccagcctggccgacagagtgagaccctgtctcaaaataataaagtgaaaaatagtatataaaaatgttttaagaagacatatatatattattcactggagctttccaccaacagaacaggctgatttattaaagaaacgagatgtcctatcatggaaatactctaggtaccacctgctggtgctgctgtgaaagggactttgaaaagttagcctgagtcacagctaagaggtctgtagatgccttttggaagagaggtaaacacataagcaaattccacttacactacgagagttgcacaggagagatttagggagagaataagtagttctggctattttttaaaatagagcctgcttttgccaggcatggtggctcacgcctgtaatcccagcactttgggaggctgaggtgggcggatcac

SEQ ID NO: 409982 - DNA, 495 bp, Homo sapiens
gggcaacaggagcaaaactctggcccaataataaaaataactaacccagattgtgtgacaggagataatggaaatgatctgagtggccacctaatttcagtgaaggaactagccaaggtaagtgacttgctcagtgtaagtccacaactaatttgtggccactcaggacattgaactgggtctcggagcaaattataagataggtaaaacagaggggacacaaacgtggaatagtgagagggtgaggagagtgcagttcaggctgggatcgtgtgtggcatattcgtaggaaaccacagaatctgaagttagttaggtttggatttcatttaccacttacaaactacgtgcatcagagtaagaaatttaatttctctgactgtaggttccttgattatagagatgttgtaaagattaaatgagatgacacgttggaagtttctggcactgtgtaggggacatcacatgttccatgatggcagctgttattgttct

SEQ ID NO: 409983 - DNA, 665 bp, Homo sapiens
tgctgagcgcagtggctcatgcctataatcctagcgctctgagaggccgagatgggagaatcgctaagtccagaagtttgggttagcctgggcgacacagtgggatctcatctcttgttttcctctttttatgagacagctctcaaattcatataaataagagaaataaaaatcaaacaaaaaaatggggctaagatataaacacatcattcacagaaaaggaaaatctaatggttaataaacacatgacatagggtcctactttactagtaataggcaatataaattaaaacactgaattccattttacatccattggagaggccgagtatgggtgagaatgtggaaaaacaggaactagtaaatcatgtgagggtgggtatggcccagtgataagtaatgtgacaacagacactaacggtaaagatacatatacgaacctaaaacctggctagttcacatggagacacacaacacagagaaacacttgctcatgtgcctatgtaaacgtgcacaaggatactcactgcagcatggtttgcgatggtgatgaattataaacaatcttaatgtccataacaagaaaatgattacaaattctgtactattcatacaatagaatacatgtactaactatatagattacaactaagtgggctatggct

SEQ ID NO: 409984 - DNA, 366 bp, Homo sapiens
tgtgagagagagttttgctcttgtcgcccatgctagagtgcagtggcacaatcttggctcactgcaacctccacctcctgggttcaagcaattctcctgcctcagtctcccaagtagctgagattacagacatgcgccactacgcccagctaatttttgttatttttagtagagacagggtttcaccatgttggccaggctgatcttgaactcctgacttgaggtgatccgcctgcttcggcctcccaaagggctgggattatagccatgagccatcgcacctggctaaacacatttctttactgcagaaattaagatcaaatgctgctctgattttctaaaaataataatgatgatgtcgccttt

SEQ ID NO: 409985 - DNA, 410 bp, Homo sapiens
tggatcatcttgtggatttttctaagtaagactctgtaatacatggagaggagcacaaagaaaaagtcatggagattattaaaagtttggaaagtaaaattcacaaaaaaagactgattgattggtattttcggccagaactgaaggctgaggtgtgatttaataacataccccaaatatatgaaggtcttcaccatgtaaaggatgggaaattgaagttcttgatctttaaaaacaaagcaagaggaaatgatttgggctatagatttaagttagaaatatgaacctcctgccaataaagattattaaatcctttctcccttctgatttttttttcctctgacctacaacccttttcaagtcttcctataaaaaaaaaagtcgacgcggccgcgaatttagtagtagta

SEQ ID NO: 409986 - DNA, 470 bp, Homo sapiens
ttttttcttttgagatggagtttccttcttgttgcccaggctggagtgttatggtgtggtctcggctcactgcaacctccgcctcccaggttcaagtgattctcctgtctcagcttccccaagtagctgggattacaggcacccgccacgaggcccagctaatttttgtatttttagtagagacagggtttcaccatgttggccaagctggtctcgaactcctgacctcaggcaatctgcctgccttggcctcccaaagtgctgggattataggcatgagccaccacacctggcctattttagagattttttaatgtgaagaaatgtgtccttgaaatagagtattattgttttacaaataaggaaaacaaggcacagaaaagtttagtaaagtagccaaggtcacacagcaagtatgtagaggagctgggattcatttccagagagtccgactttacagcccatgttaa

SEQ ID NO: 409987 - DNA, 434 bp, Homo sapiens
ccaaaacaaaacaaaatagaggccaggcatggtggctcacacctataatcccagcactttgggaggccgaggagggcagatcacctgaggtcaggagttcaagaccagcctggctaacatggcaaaaccccgtctctactaaaaatataaaaatcagctggccatggtgcctgtaatcccagctactcgggagactgaggcacaagaattgcttgaacccagtaggcagatgttgcagtgagccaagatggtgccactgcactgcagcctgggtgatggagcaagactctgtctccaaaaaaaaaaaaggaacaagaaagagttcttagaaagtaaacattgtaatagctgaaagaaaaattcagtagatgggttgaaagatcaagaaattacccagcaaaggcaaagaagtagaaaacaggaggaaaaaaaaa

SEQ ID NO: 409988 - DNA, 293 bp, Homo sapiens
gtgttttctccatgttggtcaggctggtctcaaacttccgaactcaggtgatcagactgcctcagcctcctaaagtgctgggattacaggcgtgagtcaccgtgcccagcccagttccttcttaattgagtctatttctacattattattagcaacttgcagctcttcttaatttcctttataccccttgcccaagttccctaaatctcctatttgtagccaacaggtctgttccccctgattttctcacttaacacacagtatttccatatcatacttgctaggcttagtct

SEQ ID NO: 409989 - DNA, 219 bp, Homo sapiens
gcatcattcaatacaaacagagtactttcttcccccagaactggtaactaaaaggggagcatgcgtgagaactggctaacagccactggaagtgcctgctggggtcctccctcacttttctttcatttccttattctggagccaaaggggaaaccaaaaaacttcctcccaccaaagactaaactctctgcttgatttgattaccctattttataatag

SEQ ID NO: 409990 - DNA, 184 bp, Homo sapiens
attttacagtgattttaggccataaacaatatacaaactgatttaacatcgtatcgtttaacctaacttgacttggaatgaagtatcttacacacttggattaataataattgaaatgctaaatcatgttttacatctgcttgtaaaaccttactttctaaaatgtgtttggccctaatttacc

SEQ ID NO: 409991 - DNA, 211 bp, Homo sapiens
aacaaggttgatcttattctttcagagaccaaaacataccacaaaaccacaataatgaaagcactgtgatattggcataagaatagaacataggccaggtgtggtggttcaccctgtaatcccagcactttgggaggttaaggcgggaggatcacttgaacccaggaatttgagatcagcctaagtatcatagtgagatccccatctctac

SEQ ID NO: 409992 - DNA, 684 bp, Homo sapiens
tttttttttttcccagagacaggggtcttggtatcttgtccaggctggtctcaaatgcctgtagtcaaatgatcttcccaccttggcctcccaaagtactgggaataccaggtccaccatgagccaccatgctcacctctagtcctctcttctactaagactcactttggttccacctgcacttctccatagccactatcggggccttcagtgttgatcatctcttttcctaaaaaacttgactttctggccaggcacggtggctcatgcctgtaatcccagcactttgggaggccaaaacaggtggatcacctgaggtcaggattttgagaccagcctggcttcaggggatctgcccgcctcggcctcccaaagtattgggattacaggcgtgcgccactgtgcccggccaaacctctgcattactttaaagtcccaagttgttattatcaagtgatgttctctgttctaaaggtacccttagtataaattttttggcatggtttgttacacaccagtagataactgaaaccaacatcatagagtagatgttcttgtcagactattggagaaatagaggtactccatcttccaactcttaaaatctcattgtttgtgacttacccccatgccaagcctctaccctgtgccaaatctcactgccccactgatatctgagatgtc

SEQ ID NO: 409993 - DNA, 4521 bp, Homo sapiens
taggaacaggggagagtgcacctgctaccagtcaagctcagccagactgcaagaggaggcgaggcggagccagccgagggagtgaaccatggacaagttgaaatgcccgagtttcttcaagtgcagggagaaggagaaagtgtcggcttcatcagagaatttccatgttggtgaaaatgatgagaatcaggaccgtggtaactggtccaaaaaatcggattatcttctatctatgattggatacgcagtgggattaggaaatgtgtggagatttccatatctgacctacagcaatggtggaggcgccttcttgataccttatgcaattatgttagcattggctggtttacctttgttctttctggagtgttcactgggacaatttgctagcttaggtccagtttcagtttggaggattcttccattgtttcaaggtgtgggaattacaatggtcctgatctccatttttgtgacaatctattacaatgtcataattgcctatagtctttactacatgtttgcttcttttcaaagtgaactaccatggaaaaattgttcttcgtggtcagataaaaactgtagcagatcaccaatagtaactcactgtaatgtgagtacagtgaataaaggaatacaagagatcatccaaatgaataaaagctgggtagacatcaacaattttacctgcatcaacggcagtgaaatttatcagccagggcagcttcccagtgaacaatattggaataaagtggcgctccaacggtcaagtggaatgaatgagactggagtaattgtttggtatttagcactttgtcttcttctggcttggctcatagttggagcagcactatttaaaggaatcaaatcgtctggcaaggtggtatattttacagctcttttcccctatgtggtcctactcatcctgttagtacgaggtgcaactctggagggtgcttcaaaaggcatttcatactatattggagcccagtcaaattttacaaaacttaaggaagctgaggtatggaaagatgctgccactcagatattttactccctttcagtggcttggggtggcttagttgctctatcatcttacaataagttcaaaaacaactgcttctctgatgccattgtggtttgtttgacaaactgtctcactagcgtgtttgctggatttgctattttttctatattgggacacatggcccatatatctggaaaggaagtttctcaagttgtaaaatcaggttttgatttggcattcattgcctatccagaggctctagcccaactcccaggtggtccattttggtccatattattttttttcatgcttttaactttgggtctcgattctcagtttgcttcgattgaaacgatcacaacaacaattcaagatttatttcccaaagtgatgaagaaaatgagggttcccataactttgggctgctgcttggttttgtttctccttggtctcgtctgtgtgactcaggctggaatttactgggttcatctgattgaccacttctgtgctggatggggcattttaattgcagctatactggagctagttggaatcatctggatttatggagggaacagattcattgaggatacagaaatgatgattggagcaaagaggtggatattctggctatggtggagagcttgctggtttgtaattacgcctatccttttgattgcaatatttatctggtcattggtgcaatttcatagacctaattatggcgcaattccataccctgactggggagttgctttaggctggtgtatgattgttttctgcattatttggattccaattatggctatcataaaaataattcaggctaaaggaaacatctttcaacgccttataagttgctgcagaccagcttctaactggggtccatacctggaacaacatcgtggggaaagatataaagacatggtagatcctaaaaaagaggctgaccatgaaatacctactgttagtggcagcagaaaaccggaatgagatctcattgaaaaaaatatatgattgtataatgtgattttttttagaatagggggaaccttatttatttgtgtgttaactgaataggaaaatgtacatactatgttcatgatagtgtgatttttttcacatttaagcaggaatgcaatataaaaatgtgaatctcttaattctcagccatgtgcttattatatttctttttagattgtctatctgtataacacacacacacacacctaagagtctctatttcacaattatatttttgtaaatagtatatgcatttttaatacattggaggctttattttgaactaatttcttagagaatagttatattttctattacacaagtttaaaaatattattaacttgtattttcttaatatacaatctatcttttccacaaatatgagtgggaaataaatcagcacatttgaaagaaagtgttaaaactgaaggcctcacttaattagaaacgtgataaatatatggacaaatggactatacatactataagaggactgtagtttaatactttttacccaaatatgtttaaaaacatcgtgcatttgttacagctcatgttttctatatgaacttagtcattaatgttctttataaaaagtgaaataagatggaaaaattaggatcctacagccagtacgtgataaatctagaaaattgagttttgagtacctcttttcccatatacaatcttccttccttaggtaatttggaagaaaactatgacccatttaatttctattgtgtttcaccaaattcagtgttgttcattatacctctctgaaatataggtttaatttcaaatagaatatggacttaaatgttaatgagaaactggctttaatcaattctagcattttattactgtaatacagggctgatagagtgattttgtcttatatgagtcagttactacttacaggtgataacttgcatactattggaagataaagttgtcaaacttgtcaagaatgagaaaagccaaattagaaaatcctatgtcctagtttccttaccaaggataattaaatatatcactaagagctttatatattgattatatattgttgacaactggtttaagcatcatagcctatgatgataaacactgcctatatatgtaaatagcttttcatcaattcttaaatttcttaacctaggcttcagggagcatatgaaaccaaaattatatggaacattttctgtgtgtacatgtacatgcatttttctagggagagagtccgtaggtttatcagaatatcaaggaaaactgtgacccaaagaagtttaagaatcacatacagtgctgctggctttttgtgcttggcaaatgagtgacaatagaagaaataatttttcttacacattttaaaacgttttctcttccttgtgattgaagatgaaaggagtaagaaattaaggcatttgtttaatttatactggtaacttatttaggggggaggggacatgaaggtaggtaaataggtaggcctctaattgaaccacctctctaagttatgtacgtatatataagctgaaattgtgtttgacattctgagggttttctttttctttttcctttttttttttttttggtggggggctgggggtcagagtcttgttctgttgcctgggctggagtgcagtggcatgatctcagctcactgcaacctctgccttctggattcaagtgattctcctgcctcagcctcttgagtagctgggactacaggtgcccgccaccacaccagctaatttttgtatttttagtagaggcgaagtttccccatgttggccaggctggtcttgaactcccgacctcaagtgatctgtctacctcggcctcctaaagtgctgagattacaggtgtgagccaccgtgcccggcccattctaagggttttctttgaagacaggtcaaatgctgttagtaagtttcaggagattgttaattcctcagttataccagattttataaaatatttgagaatagatggctaacaagaggttagaaatacttttccttaattttaatccacagtatgttacatgcattctaccactacattttggtgctatttaaggtgtgcaattttctataggtgacttttgcaattcagggaagatttgggcatattaaatgaaagaatatctaattgggggaggtgtgaagggaaagaaattcttttcaaaagctgaccacaaagagtagttaaaagtttttgtcactatcttcacaagtgtgtaaagcacagatttcaacagagtgcttggcatattgtagggtgctcaatggtggtttttattattattactcagattccacagtggcaagaaacatcattctacataatggaaaacatttacatcaaatcccacttactttaatgcgaacttggagataatttatggtattgtattgtaaaccattaatgaaaactttttcacagttgagtgaaattaaaatcactatatctca

SEQ ID NO: 409994 - DNA, 4353 bp, Homo sapiens
taggaacaggggagagtgcacctgctaccagtcaagctcagccagactgcaagaggaggcgaggcggagccagccgagggagtgaaccatggacaagttgaaatgcccgagtttcttcaagtgcagggagaaggagaaagtgtcggcttcatcagagaatttccatgttggtgaaaatgatgagaatcaggaccgtggtaactggtccaaaaaatcggattatcttctatctatgattggatacgcagtgggattaggaaatgtgtggagatttccatatctgacctacagcaatggtggaggcgccttcttgataccttatgcaattatgttagcattggctggtttacctttgttctttctggagtgttcactgggacaatttgctagcttaggtccagtttcagtttggaggattcttccattgtttcaaggtgtgggaattacaatggtcctgatctccatttttgtgacaatctattacaatgtcataattgcctatagtctttactacatgtttgcttcttttcaaagtgaactaccatggaaaaattgttcttcgtggtcagataaaaactgtagcagatcaccaatagtaactcactgtaatgtgagtacagtgaataaaggaatacaagagatcatccaaatgaataaaagctgggtagacatcaacaattttacctgcatcaacggcagtgaaatttatcagccagggcagcttcccagtgaacaatattggaataaagtggcgctccaacggtcaagtggaatgaatgagactggagtaattgtttggtatttagcactttgtcttcttctggcttggctcatagttggagcagcactatttaaaggaatcaaatcgtctggcaaggtggtatattttacagctcttttcccctatgtggtcctactcatcctgttagtacgaggtgcaactctggagggtgcttcaaaaggcatttcatactatattggagcccagtcaaattttacaaaacttaaggaagctgaggtatggaaagatgctgccactcagatattttactccctttcagtggcttggggtggcttagttgctctatcatcttacaataagttcaaaaacaactgcttctctgatgccattgtggtttgtttgacaaactgtctcactagcgtgtttgctggatttgctattttttctatattgggacacatggcccatatatctggaaaggaagtttctcaagttgtaaaatcaggttttgatttggcattcattgcctatccagaggctctagcccaactcccaggtggtccattttggtccatattattttttttcatgcttttaactttgggtctcgattctcagtttgcttcgattgaaacgatcacaacaacaattcaagatttatttcccaaagtgatgaagaaaatgagggttcccataactttgggctgctgcttggttttgtttctccttggtctcgtctgtgtgactcaggctggaatttactgggttcatctgattgaccacttctgtgctggatggggcattttaattgcagctatactggagctagttggaatcatctggatttatggagggaacagattcattgaggatacagaaatgatgattggagcaaagaggtggatattctggctatggtggagagcttgctggtttgtaattacgcctatccttttgattcgccttataagttgctgcagaccagcttctaactggggtccatacctggaacaacatcgtggggaaagatataaagacatggtagatcctaaaaaagaggctgaccatgaaatacctactgttagtggcagcagaaaaccggaatgagatctcattgaaaaaaatatatgattgtataatgtgattttttttagaatagggggaaccttatttatttgtgtgttaactgaataggaaaatgtacatactatgttcatgatagtgtgatttttttcacatttaagcaggaatgcaatataaaaatgtgaatctcttaattctcagccatgtgcttattatatttctttttagattgtctatctgtataacacacacacacacacctaagagtctctatttcacaattatatttttgtaaatagtatatgcatttttaatacattggaggctttattttgaactaatttcttagagaatagttatattttctattacacaagtttaaaaatattattaacttgtattttcttaatatacaatctatcttttccacaaatatgagtgggaaataaatcagcacatttgaaagaaagtgttaaaactgaaggcctcacttaattagaaacgtgataaatatatggacaaatggactatacatactataagaggactgtagtttaatactttttacccaaatatgtttaaaaacatcgtgcatttgttacagctcatgttttctatatgaacttagtcattaatgttctttataaaaagtgaaataagatggaaaaattaggatcctacagccagtacgtgataaatctagaaaattgagttttgagtacctcttttcccatatacaatcttccttccttaggtaatttggaagaaaactatgacccatttaatttctattgtgtttcaccaaattcagtgttgttcattatacctctctgaaatataggtttaatttcaaatagaatatggacttaaatgttaatgagaaactggctttaatcaattctagcattttattactgtaatacagggctgatagagtgattttgtcttatatgagtcagttactacttacaggtgataacttgcatactattggaagataaagttgtcaaacttgtcaagaatgagaaaagccaaattagaaaatcctatgtcctagtttccttaccaaggataattaaatatatcactaagagctttatatattgattatatattgttgacaactggtttaagcatcatagcctatgatgataaacactgcctatatatgtaaatagcttttcatcaattcttaaatttcttaacctaggcttcagggagcatatgaaaccaaaattatatggaacattttctgtgtgtacatgtacatgcatttttctagggagagagtccgtaggtttatcagaatatcaaggaaaactgtgacccaaagaagtttaagaatcacatacagtgctgctggctttttgtgcttggcaaatgagtgacaatagaagaaataatttttcttacacattttaaaacgttttctcttccttgtgattgaagatgaaaggagtaagaaattaaggcatttgtttaatttatactggtaacttatttaggggggaggggacatgaaggtaggtaaataggtaggcctctaattgaaccacctctctaagttatgtacgtatatataagctgaaattgtgtttgacattctgagggttttctttttctttttcctttttttttttttttggtggggggctgggggtcagagtcttgttctgttgcctgggctggagtgcagtggcatgatctcagctcactgcaacctctgccttctggattcaagtgattctcctgcctcagcctcttgagtagctgggactacaggtgcccgccaccacaccagctaatttttgtatttttagtagaggcgaagtttccccatgttggccaggctggtcttgaactcccgacctcaagtgatctgtctacctcggcctcctaaagtgctgagattacaggtgtgagccaccgtgcccggcccattctaagggttttctttgaagacaggtcaaatgctgttagtaagtttcaggagattgttaattcctcagttataccagattttataaaatatttgagaatagatggctaacaagaggttagaaatacttttccttaattttaatccacagtatgttacatgcattctaccactacattttggtgctatttaaggtgtgcaattttctataggtgacttttgcaattcagggaagatttgggcatattaaatgaaagaatatctaattgggggaggtgtgaagggaaagaaattcttttcaaaagctgaccacaaagagtagttaaaagtttttgtcactatcttcacaagtgtgtaaagcacagatttcaacagagtgcttggcatattgtagggtgctcaatggtggtttttattattattactcagattccacagtggcaagaaacatcattctacataatggaaaacatttacatcaaatcccacttactttaatgcgaacttggagataatttatggtattgtattgtaaaccattaatgaaaactttttcacagttgagtgaaattaaaatcactatatctca

SEQ ID NO: 409995 - DNA, 512 bp, Homo sapiens
gaattacaatggtcctgatctccatttttgtgacaatctattacaatgtcataattgcctatagtctttactacatgtttgcttcttttcaaagtgaactaccatggaaaaattgttcttcgtggtcagataaaaactgtagcagatcaccaataggtaaaatttgtcaacacccaaatagttcttttatatatattttttataagcttgaagggtcaaatcattctctaagcaacttaggtacaattttaaatgttccaaaggtcactggtgaaagcagaagatagcatatataatcagaaaaatgattaatacaatgtattaatctctgagagcagtcaggaaggctaaatcatgcctaagagtacttcttccaggcctaagtcttgggcaggagaggagaaactgagaaaatgataaagggagaaaagtgctatctaggatagttgtgtgtgtctcaggagacagtaggtgttgttcatgtcatatgttgctaatctttgggataacgt

SEQ ID NO: 409996 - DNA, 339 bp, Homo sapiens
gcatgcgcaggtctcgcatacagcagtgcagtgccgttattccagtctccgtagaaacgctgggactatggcggagccgactgggctgttggagatgtccgagctccccggagatagcagtgtcccacagaatatgtattctattcacaagactcaacaaaaaaaagtatcggccgggcgcactggcttacgcctgtaatcccagcactttgggaggccacggcgggtggatcacctgaggtcaggaattcaagaccaccctggccaacatggtgaaaccccatctctacgaaaaataaaaaattaactgggtgtggtggcacgcgcttgtagtcccag

SEQ ID NO: 409997 - DNA, 1334 bp, Homo sapiens
gcatgcgcaggtctcgcatacagcagtgcagtgccgttattccagtctccgtagaaacgctgggactatggcggagccgactgggctgttggagatgtccgagctccccggagatagcagtgtcccacaggtgggcaccgcgagtggcgtcagcgacgtactgcggggggcagtcggcggcggggttcgggtgcaggaggcccgggaaggcccagtggccgaagctgcgcggtccatggcgcggatgccgggccctgtgcccgggcccatccccagcagcgtcccgggcctggcctccgcgccagacccccatcagcagctcgctttcttagaaattaaccggcagctgttgttccgcgagtatctggatggtagctccatgattccggtcagattactacgggatttcgaggaacgccgcaggctgtttgtggaaggctgcaaggcgagggaagcagcctttgacgcggatcccccgcagatggacttcgctgctgtcgcgtttacggtagcgctgactgcctccgaggccctcagtcctctggccgactgagtcggctgtgatgatgacattggtggcaaggaatagccaagtgacccttttgggatcaaaagaacaggcaggctgtgccagtttagttaactcagtcattagggggaatgcaaactggaagggaatacggcaatgtgcaattgaaggaggaagcacactccgaaatggaaacagacaagactgttgaatcttgttttctttcttctttttagtattatttaaatagagaagggagtctcggcatccctaggctggtcccgaacgcttggacccgaggcgatcctcccgcttcggcctcccaaagtgctgggataactttacaggcgtgagccaccgcgccccggccgaatcttgttttcaaacaggtcccaagacacttctgacttagcactttgttagcaatgcattttcctgcatttgtgaagaatccttcatgactttcaccataaaggatggttttgcaaagatatgagaaaaaaaaaaatgccaataacagaacccatagaaatgaacctaagtgatgaaagaaaacaaagaaatagagttgtcaggaatccaggtgtacctgagttactaggattggaaggctattgagaggactttgaaatttcacaatttgtggtcatgtcaacaaatcctagtgtaagattcatatttgtgttttctgaggtactttagatgaacagtaaatattcaatagaaaaaaccacgtattatatgatcagtgttttcaagtctatgtgaaattgggtaggtgtggaataaacttgttttttgttaa

SEQ ID NO: 409998 - DNA, 275 bp, Homo sapiens
tgagttactaggattggaaggctattgagaggactttgaaatttcacaatttgtggtcatgtcaacaaatcctagtgtaagattcatatttgtgttttctgaggtactttagatgaacagtaaatattcaatagaaaaaaccacgtattatatgatcagtgttttcaagtctatgtgaaattgggtaggtgtggaataaacttgttttttgttaattttaagctttttattttattctagaatatgtattctattcacaagactcaacaaaaaaa

SEQ ID NO: 409999 - DNA, 778 bp, Homo sapiens
cggatgggctgggacgggttttgggggggtgtccccaattctgactgggagtggaggaacccctcctgagatctcttgtgggggtgccccctccccagggcactccccagtccctgagccagccgagaggaaggaggccagcgatgcgactggggcggctcctttctcctgcaccccaaatgtgagggatgcaccctaaattttgctcttttcaaaataggggaccaggatctcaggggagagtagctgaggccttgctcggagtcccaggagatccacaggtccggcatgaacagtgagaggtcagaggtggaaggctcagcaggagaggagaggaggatcagcagaggtcatgagaaggccagaatccagggtcaggctgtctggaacaggaagtaaaatgggccgagatggagcgagcccccagtgtgcttccaaggccactcccacctccctgaaacaccctgctacgtactgatccaatgccctgcgctgtgtatgagagcaccttctcttctgaaacccctatacaagggaggggcccctgcggagaccgtgccctgccatccagtcctcaaggggattctaaaaaactagtgacaaagtagggaagcagctgagctggaaaggagttctgaggacgatggaaccttgggtaaggaggaagaaggctgcccacccgcccttttctggcagccaccctccctcacactgtccgttccttgatgacacagctgatgtgattaagatcgtccccaaatcgcttcacagcagccct

SEQ ID NO: 410000 - DNA, 688 bp, Homo sapiens
tgcgtttcacagtggcctttatctgggccctgaagaaaagagagaagaggttaggaaaggagtcatcagagagactaacagaagaggggacgggaggggaaggggttctgggagtcccttcataagaatccaggtcggggccccaacccattggtagggttctcactttctcgaagttttacactcactcaggatggatggagtgtggagagtggagtccctgaactgagtagtgggaaaggcccatctcctaattctcttctgggagagacatcaggtagagcttggtgatttacaggtggattgagatttactgatcaactagttcagggtcaccatatccctggaaacactgcagtggggtcctcaaacatttatataaataaccaggggacttccatcatcaaatacaataacagcatctcaggcaacctaaattcacattcttggaaggattaccacagcattttaggaacttctgaccaactgtgacaattctattctttcagtcctcaaggggattctaaaaaactagtgacaaagtagggaagcagctgagctggaaaggagttctgaggacgatggaaccttgggtaaggaggaagaaggctgcccacccgcccttttctggcagccaccctccctcacactgtccgttccttgatgacacagctgatgtgattaagat

SEQ ID NO: 410001 - DNA, 485 bp, Homo sapiens
aaatgccttctgtctcagggaagcccttaccagaacctctaggtagagttagaggctaactccacggcaccctagagtccatagcatgttgttatcatgtgtgtatcgttgcatgtaaaaatattcctatttgttacggtttgcttgtatgtgtttgtcattaatctattaattcattcagtgaagagatgccaacttgtatactagcctgggaaacctctgtgtcctcagtgcctaatttaatactcctttttctatctagtagtaaaatgaatatgaatgtacatgtctgaggtctctataaattaaaaggtaaaaagtcttaagccaggtgtggtggcatgcacctgtattcgcagatatttgggaggttgaggtgggagcattgcttgaggccagaagtttgaggctgtagtgtgcaatgctcttacctgtgaatagccatggccctccaacatgggcaatgcagtgagaccctgtcttta

SEQ ID NO: 410002 - DNA, 332 bp, Homo sapiens
aaagatgaagtagttccaacgagaaggaatgggaattgagaatggctgtttgaggttatctttatggttttcagggttatccaggtcttagaaattacataatgatttctacaaatgatcatcggtagctttagactagtacctactaattctgtaagtgatgatcctcaacccttgctaatttgaatagatcttgttatttcaatgtgccgttaaattgacaaacttctctataaaactacgtagtatgatctttcaggtaacctagtctggtaatctagttatccgtgaactattcatatccatgatttaaaaaaaaaaaaaaaacaact

SEQ ID NO: 410003 - DNA, 798 bp, Homo sapiens
cttgttcatggcatctttagaaacaaactgcaattttatttcatttccttgtcgttcatacaaagattacaagactagcttatgtgtggactgtgactgttttaaggaaaaatcatgtcctcggctgggttatcaagccaagctatttaaaggtgttttaaaagaaaggatggaaggaagacctcttaggaccactgtgtttttggatacaagtggtacatatccattctgtacctattattttgttctcagtataattgttccagataaaactatgatggatggctcgttttcatttaaattattaaatcagcttggaatgattgaagagccaaggctttatgaaaagaacaaaccattttataaacttcaagaagtcaagattcttgctcaattttataatgactttgtaaatatttcaagcattggtttgacatatttccagagctcaaatctgcagtgttccacatgcacatacaagatccagagtctcatgttaaaatcacttacatacccagaaagaccaccactttgcaggtataatattgtacttaaagacagagaggaagtgtttcttaatccaaacacatgtacaccaaagaacacataagatgccttcttccatcaaatgcacttgcttgtgaattaatggacttgtaaatgaaacaatgcaatcagtcttttataatgcactgttcaatttgagattcaagtatttctatttcttggaaaaaattttaagaatcaaaaataaagaaaataaaaaatgcatacagttaaacattccaaaaaaaaact

SEQ ID NO: 410004 - DNA, 329 bp, Homo sapiens
cgccttagtgccaacctgcctccttctcatatcttattcatattgtaattattaccaccactttgcaggtataatattgtacttaaagacagagaggaagtgtttcttaatccaaacacatgtacaccaaagaacacataagatgccttcttccatcaaatgcacttgcttgtgaattaatggacttgtaaatgaaacaatgcaatcagtcttttataatgcactgttcaatttgagattcaagtatttctatttcttggaaaaaattttaagaatcaaaaataaagaaaataaaaaatgcatacagttaaacattccaaaaaaaaact

SEQ ID NO: 410005 - DNA, 336 bp, Homo sapiens
ttctatgagggaatgcatttattattattttgcatttattattttgttctgttataaattacggttttaattattttaataaatactgcaataatattttgtttggccttttccctataattttgttctctgtggcctcccttattaggattatattgattttagaattgagttatgtttcaaattattaatatgctgcgtgtatcaaattttctctctagaaagaacaaaccattttataaacttcaagaagtcaagattcttgctcaattttataatgactttgtaaatatttcaagcattggtttgacatatttccagagctcaaatctgcag

SEQ ID NO: 410006 - DNA, 481 bp, Homo sapiens
ctgtgtccccacccaaatctcatcttgaattcccgcatgttgtgggagggacctggtgggaggtaattgaatcatgggggcaagtttttcccatgctgttctcatgataatgagtaagtcttgcaagatctgactgtttaaaaaacgggagttttcctgcacaagttctctctctctttatctgcttccatccatgtaatatgtgacttgttcctcctttccttccaccatgattgcaagacctccccagccacgtggaactgtgagcccattaaacctctttcttttgtgaatttcccagtctcggatatgtatttatcagcagtgtgagaatggactgatacactctgcctgccttctcttctctttaacctcttcctctttgaccatttctgtcactgtttaagtagacatagtctttccatcttaaaattttaaaaatggggagatgaatggactgataaataaaaaggaaaaaaaa

SEQ ID NO: 410007 - DNA, 631 bp, Homo sapiens
tgaagatatgcgtgcttccccttcacccttctgccatgattgtaagtttcctgaggcttccccagccatgcctcctgtacagcctgtggaacttcaggacctgggagagaaaaaagctaccagcaacattcagactgagagaggccaaaatactaattcataattagcctggtacatatgaaggatcaaaaagaacaggactgtatgtctgacctctgacaggccctaccaccatagtagagactcagtatgtatacttaatgaaggaataatgaatacatcagcaagagaaataagagtgaccatatgttccttaagagaagcaaagagcagctcctgttcctgctggaatgagtctccattccttgcaacagaagtgtcctaagttatagccagaggacgggggcacattgacaaaacataaagcggatatgataataacaaggtaccattccagcaagaacatctgaagaaagaagcagtgttgtttatctttccttcatctattctgaaactaaaatccttaaccaaatttatttccgaagtttaaccctttaataaactggcctctgactccacctggtggagatacataaatctatgaaaataaaccaatccaaatgaagatttt

SEQ ID NO: 410008 - DNA, 579 bp, Homo sapiens
tgaagatatgcgtgcttccccttcacccttctgccatgatttcaggacctgggagagaaaaaagctaccagcaacattcagactgagagaggccaaaatactaattcataattagcctggtacatatgaaggatcaaaaagaacaggactgtatgtctgacctctgacaggccctaccaccatagtagagactcagtatgtatacttaatgaaggaataatgaatacatcagcaagagaaataagagtgaccatatgttccttaagagaagcaaagagcagctcctgttcctgctggaatgagtctccattccttgcaacagaagtgtcctaagttatagccagaggacgggggcacattgacaaaacataaagcggatatgataataacaaggtaccattccagcaagaacatctgaagaaagaagcagtgttgtttatctttccttcatctattctgaaactaaaatccttaaccaaatttatttccgaagtttaaccctttaataaactggcctctgactccacctggtggagatacataaatctatgaaaataaaccaatccaaatgaagatttt

SEQ ID NO: 410009 - DNA, 449 bp, Homo sapiens
taccaccatagtagagactcagtatgtatacttaatgaaggaataatgaatacatcagcaagagaaataagagtgaccatatgttccttaagagaagcaaagagcagctcctgttcctggtaagctctggctgtattttgttccttttccaaaaaagtctgtgatattccttgttgtgtatttataataacattcttttttcttgagccagctggaatgagtctccattccttgcaacagaagtgtcctaagttatagccagaggacgggggcacattgacaaaacataaagcggatatgataataacaaggtaccattccagcaagaacatctgaagaaagaagcagtgttgtttatctttccttcatctattctgaaactaaaatccttaaccaaatttatttccgaagtttaaccctttaataaactggcctctgactccacctgg

SEQ ID NO: 410010 - DNA, 517 bp, Homo sapiens
ttttttttttgagacggagtctcgctctgtttctcaggctggagtgcagtggcgcgatctcggctcactgcaagctccgcctcctgggttcacaccattctcctgcctcagcctcccgagtagctgggactacaggtgcccgccaccacgcccagctaattttttatatttttagtagagacggggtttcaccgtgttggccaggatggtctcgatctcctgatcttgtgatccgcccgcctcagcctcccaaagtgctgggattacaggcatgagcccccacgcccagcctccacgcgcccactctcacatgggtcaactcgtctaacccttcccgaaaccctccgaggcacttagtgagcgcctggtgtgcaaaaaggatgacttcagtcgccgtgggggcaagcctgcagcctcagctggactccagctcttccccctgctgtgtgacccctggcaaatgacttaacctctctgtgtctcaatgtcctcatcctcagtaaaatgaagataaaaa

SEQ ID NO: 410011 - DNA, 665 bp, Homo sapiens
actctggatgggtgctgtttagacaaacgccgtctcctatataagacctgacagcacaggcaccactccgccaggactgcaggcccacctgtctgcaacccagctgaggccatgccctccccagggaccgtctgcagcctcctgctcctcggcatgctctggctggacttggccatggcaggctccagcttcctgagccctgaacaccagagagtccagcagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaactgtatgctgatgttccaaatgggaatttatttcaaagaggaaaagttaatattttactttaaaaaaatcaaaataatac

SEQ ID NO: 410012 - DNA, 433 bp, Homo sapiens
cctcggcatgctctggctggacttggccatggcaggctccagcttcctgagccctgaacaccagagagtccaggtgagacctccccacaaagccccacatgttgttccagccctgccacttagcaaccagctctgtgacctggagcagcagcgccatctctgggcttcagtcttctcccagagcacaaaggactctgggtctgacctcactgtttctggaaggacatgggggcttagagtcctaaacagactgtttcccccttccagcagagaaaggagtcgaagaagccaccagccaagctgcagccccgagctctagcaggctggctccgcccggaagatggaggtcaagcagaaggggcagaggatgaactggaagtccgggtcggtacctctgcagttttatgcttctgtggcagcgaggagggtgggg

SEQ ID NO: 410013 - DNA, 427 bp, Homo sapiens
gccacgggcagcagtggccacaccccagtctccacagcaccgagactgacaccctgagccctctcttggttgttggtcaagtgaagtgaagccaggaagctccctggaggcagagtggagcacggtgaggcccagtcagcagtgggtggggaaggagccactccgaatgtgctcaccggggggtgttcgggattcctgtggctgctggaacaaaccactgttaaaaaaaaatcaccacaaagccaggacttgaaaccacacatcatccttccaggtcctataggtcagaagcctcttgggtaagttttacagacactaagatttgatcacctctattctagacagaatgtgttgttgataagcaaaactggaaccagctgtttgaggccttctctaacccctcaccctgtatcagtgaacatgctcc

SEQ ID NO: 410014 - DNA, 586 bp, Homo sapiens
agatttcataggtttaaaattttatgatgcaagtatattttcgaggaatggaaatataggctgaagagccagaacaaacacctaaaattcaatactaataacttcaagccattatatgaaggtttcaaataggtgatttaaagcagtgcaatgcattttatgctaattttcgttatgctatttgaaaaataaaacccttcttaatgctcaaaatttgaaataatgcaaatgccgcagatttgtttttagcctgaattatacactgcactgatagtatggccacacggtggcattgccgtggctcctgagcagcagccctgcctgcttgcctcaatgccttgcagccagcacttgctcagcccgtgggacttctaacagcactaatgttggttttgtagttattttcctttttacttttgtaatgatttaacttttttcacaccctgtaataagcgtaatagaagcattcattagtaacttccatagttagaaaattctgggtaacaaaatgccctaaaggatgccggacattgtcacagtatgttagagtgctgttaatttggaagagagaactatgaaaaaaaaa

SEQ ID NO: 410015 - DNA, 780 bp, Homo sapiens
tcccattccctcttcctccagtccctgaaaaccaccagtaatttgaatttgactactctgggtaccttatgtaagtggaatcatatagtatttgtctttttgcgagtggcttatttcacttagcataatgacttcaaggttcatccatgttgtaaacatgtatcagaatttcattccttttgaataagggtaaataatattccaccctatggatatatgccacattttgtttatccgtgcatatatcaatagacatttgggttgtttctaccttttgactattgtgaataatgctgctatgaacatgggttcgtgattgaacatatctgttcaagtccttgcttttagttcttttgggcatataccctgaagtagaattgctggataatatggtaattttatttttaattttttgaggaactaccatgtatgatcatgattgcattttgaagttagtgtgatctaaccctaatttattttccaacaggttataaccccctttaccatcaggccaggcaggtgactcatgtctgtaatctcatcacttttggggaggccaaggtgggaggactgcttgagcccaggagtttgagaccagcctgggtaacatagtgagatcctgtctcttaaaaaaaataccgagtgtggtggtacacgccggtagtcctagctacctgggaggctgagatgggaggattgctggagtccaggaggtcatggctgcagtgatccatgatcgtgccactgcactcctgggtgacagagcaagaccttgtctca

SEQ ID NO: 410016 - DNA, 2980 bp, Homo sapiens
  misc_feature (1)..(3): n is a, c, g, or t
  misc_feature (5)..(5): n is a, c, g, or t
  misc_feature (7)..(7): n is a, c, g, or t
  misc_feature (9)..(9): n is a, c, g, or t
  misc_feature (11)..(11): n is a, c, g, or t
  misc_feature (393)..(393): n is a, c, g, or t
  misc_feature (761)..(761): n is a, c, g, or t
  misc_feature (2244)..(2244): n is a, c, g, or t
  misc_feature (2973)..(2973): n is a, c, g, or t
nnnangntncnaaaattcatgctggagtgtgtatcagtacttcattcctttttgtggctgaataacattccattgtatggatgtatcatgctttgtgtatccagtcatcagctgatggacatttgagttgtttctatggtttggctatttttttttttttttttttgagatgagtctcactctagcccaggctggagtgcagtggcgcaatcttggctcactgcaacctccacttccgggtccctgttcaagcaattctcttgcctcagccttccgagtagctgggattacaggtgtgcgccaccacgcccggctaatttttgtattcttagtagagacggggtttcaccacgatggccaggctagtcttgaactcatgatccacccgcctcngccacccaaagtgctgggatttataggcgtgagccaccgtgcccggcccgtttggctattttgaacaatgctgcggtgaacgtttgtgtggaggtttttgtgtggatttgtttgcatttctcttggaataccttgttagaaaagcgtgcttatacgtattactactaaatttattttctgtcattaagctgtgtttcagttcatgcctctgaagtgatgtgctctgttcagcagagtcctatgctgtgccctccccttctggggctctagcttgccctttggagggtgtgtgtttgtgtgtgtgtgtgtgtgtgtgtgtgtgtgtgtggtaggggtcctcattttccttactgcctgtcactctccangtcactgtgggtggccaagagtggtctcatttcctctacccctttgcaaaccgtaaacactggtcacacgtgcttgtgctggaatcatatgctccagtggcttgatggtgggacttcagatttcctgcattaccttaggttttgactttcttgtggttacctctgtcagcattctttggcagaggactatggggagtagaatgacctagaaattatccctgattttcttctccttccaagcctgctgaaccaaaaatggtttttatttttctttgaaaaactacccttcgtaatgaactccattaagaaataggagttcttcaaaggaggagggatgttactgtattcttttgatttctctgaatttactagatttattttccccaagttggtgtgaaattgttgagattggtccttaactagagtcagacaattttttttttttttttttgagacagagtctcactttgtcgcccaggctggagtgcagtggcgcgatctccactcattgcaacctccgccttccggattcaagtgattctcctgcctcagcctccagagtagccaggattacaggcacccgccaccacgcctggctaatttttgtatttttagtagatacagggtttcaccttgttggccaggctggtctcaaactcctgacctcaggtgatctgcctgcctcggcctcccaaaatgctgggattacaggcgtgagccaccgtgcccggctggcaatttttattttttagatacagggtgtcgctgtgttacccaaactggagtgccgtgacgtgaacgcagctcactgcagccttaaccttcctgggctcaagcgatcctcccacctcaccctcccaagtagctgggactagagctgcgcttcaccatgcctggctaatttcaggcaatttttaattgttagaaaaactgtaaggcaacataagagaagtggatggtggggactgcaaatgtcatgtggcctagtggtattgagaagcattttgtgaagcagagagtgcgtgttccgattctgtaggagcacatgtcttggtgtgggtgtctttgccttcctagaacttcctgatgataagaagcctgtaaacaccagtgtgtccgtcagtatttggaatcttgtttattacatagtcctcaggttcattgtcaaaaaattctttactgatggtattaatcagtatttggaatcttatttatttcatagtgctcaaggtcattgtcaaaaaattctttactaatggtattaatcatgcttctcacactccagtttttctggtatggttttctgttccaaattgactcctgtgctcaggtcattagtttggcttactaacaggagccctgacagctatattcaatatttttctctgcagtggccaagtagccaagaatttactagtttagacacccacctcagtttagaaggtaggtgtgagtgtgtgtgtgtgtgtgtgtgtgtgtgtgngagagagagagatagagagagagagagaatatctaagaaggagttaatattttaaactttgcattgtttaactggaaatctgtgttctgccgggccgcttttatgtggtgtacctataacctatacacatacttgtgcctttcaaaggctaacgccacatccctcctactaaaattgcttattagagctaattttaagaattgagttagaactgccctataatgtaatgcagaatatttcccaataatgcctaggttaacaatgatagtcttgctgtattgtgcaaaaaaggcttctgttcagacccagctgggtttcaggcttaattcattgctctatggtgggatcaccacagctgctgtggggcctttacaaatgcaaaaaagctgtcagtgtttgtttcatcagctgcataagtgatgaggccaagttgaggaatccattccagtgcgcagtgtgcaggctgtagctattattgtttacagaattagtgtgttggagctttaaaatagttggcacatcgtctgccctttaaaagcacaagactaaggaatgagaccagttggttgtccttgtaatgttggccggatccagcccagcccttgtcttttaacagctactgctccgggctgtgctgtgggacttgactactctttggaggaagtgggggtgcttgctgagttcttgtctctgtagttctgcatcccaaacttaggtttgcattaaaanaaaaaaa

SEQ ID NO: 410017 - DNA, 2926 bp, Homo sapiens
  misc_feature (1)..(3): n is a, c, g, or t
  misc_feature (5)..(5): n is a, c, g, or t
  misc_feature (7)..(7): n is a, c, g, or t
  misc_feature (9)..(9): n is a, c, g, or t
  misc_feature (11)..(11): n is a, c, g, or t
  misc_feature (393)..(393): n is a, c, g, or t
  misc_feature (761)..(761): n is a, c, g, or t
  misc_feature (2190)..(2190): n is a, c, g, or t
  misc_feature (2919)..(2919): n is a, c, g, or t
nnnangntncnaaaattcatgctggagtgtgtatcagtacttcattcctttttgtggctgaataacattccattgtatggatgtatcatgctttgtgtatccagtcatcagctgatggacatttgagttgtttctatggtttggctatttttttttttttttttttgagatgagtctcactctagcccaggctggagtgcagtggcgcaatcttggctcactgcaacctccacttccgggtccctgttcaagcaattctcttgcctcagccttccgagtagctgggattacaggtgtgcgccaccacgcccggctaatttttgtattcttagtagagacggggtttcaccacgatggccaggctagtcttgaactcatgatccacccgcctcngccacccaaagtgctgggatttataggcgtgagccaccgtgcccggcccgtttggctattttgaacaatgctgcggtgaacgtttgtgtggaggtttttgtgtggatttgtttgcatttctcttggaataccttgttagaaaagcgtgcttatacgtattactactaaatttattttctgtcattaagctgtgtttcagttcatgcctctgaagtgatgtgctctgttcagcagagtcctatgctgtgccctccccttctggggctctagcttgccctttggagggtgtgtgtttgtgtgtgtgtgtgtgtgtgtgtgtgtgtgtgtggtaggggtcctcattttccttactgcctgtcactctccangtcactgtgggtggccaagagtggtctcatttcctctacccctttgcaaaccgtaaacactggtcacacgtgcttgtgctggaatcatatgctccagtggcttgatggtgggacttcagatttcctgcattaccttaggttttgactttcttgtggttacctctgtcagcattctttggcagaggactatggggagtagaatgacctagaaattatccctgattttcttctccttccaagcctgctgaaccaaaaatggtttttatttttctttgaaaaactacccttcgtaatgaactccattaagaaataggagttcttcaaaggaggagggatgttactgtattcttttgatttctctgaatttactagatttattttccccaagttggtgtgaaattgttgagattggtccttaactagagtcagacaattttttttttttttttttgagacagagtctcactttgtcgcccaggctggagtgcagtggcgcgatctccactcattgcaacctccgccttccggattcaagtgattctcctgcctcagcctccagagtagccaggattacaggcacccgccaccacgcctggctaatttttgtatttttagtagatacagggtttcaccttgttggccaggctggtctcaaactcctgacctcaggtgatctgcctgcctcggcctcccaaaatgctgggattacaggcgtgagccaccgtgcccggctggcaatttttattttttagatacagggtgtcgctgtgttacccaaactggagtgccgtgacgtgaacgcagctcactgcagccttaaccttcctgggctcaagcgatcctcccacctcaccctcccaagtagctgggactagagctgcgcttcaccatgcctggctaatttcaggcaatttttaattgttagaaaaactgtaaggcaacataagagaagtggatggtggggactgcaaatgtcatgtggcctagtggtattgagaagcattttgtgaagcagagagtgcgtgttccgattctgtaggagcacatgtcttggtgtgggtgtctttgccttcctagaacttcctgatgataagaagcctgtaaacaccagtgtgtccgtcagtatttggaatcttgtttattacatagtcctcaggttcattgtcaaaaaattctttactgatggtattaatcagtatttggaatcttatttatttcatagtgctcaaggtcattgtcaaatggttttctgttccaaattgactcctgtgctcaggtcattagtttggcttactaacaggagccctgacagctatattcaatatttttctctgcagtggccaagtagccaagaatttactagtttagacacccacctcagtttagaaggtaggtgtgagtgtgtgtgtgtgtgtgtgtgtgtgtgtgngagagagagagatagagagagagagagaatatctaagaaggagttaatattttaaactttgcattgtttaactggaaatctgtgttctgccgggccgcttttatgtggtgtacctataacctatacacatacttgtgcctttcaaaggctaacgccacatccctcctactaaaattgcttattagagctaattttaagaattgagttagaactgccctataatgtaatgcagaatatttcccaataatgcctaggttaacaatgatagtcttgctgtattgtgcaaaaaaggcttctgttcagacccagctgggtttcaggcttaattcattgctctatggtgggatcaccacagctgctgtggggcctttacaaatgcaaaaaagctgtcagtgtttgtttcatcagctgcataagtgatgaggccaagttgaggaatccattccagtgcgcagtgtgcaggctgtagctattattgtttacagaattagtgtgttggagctttaaaatagttggcacatcgtctgccctttaaaagcacaagactaaggaatgagaccagttggttgtccttgtaatgttggccggatccagcccagcccttgtcttttaacagctactgctccgggctgtgctgtgggacttgactactctttggaggaagtgggggtgcttgctgagttcttgtctctgtagttctgcatcccaaacttaggtttgcattaaaanaaaaaaa

SEQ ID NO: 410018 - DNA, 651 bp, Homo sapiens
gaacacgaggaagaggtgggaaaatagccaagaaaatgaaatgtgcatgcagaaatggccccttttgccattttcttttgagtcttttcttcaagtttcttttcagggaaggaaattcctaaactttctgcattgtcttgattcctacatgttttgttgttgttgttgttgttgttgttttgtttgaatcactgggagaaactccatgaagtttaatcctatccctcatgccacagcttatctgctttctgcgtagatacaaaaggctttttacctggccaaatgattcatgcgggaatacacctcagcttctctctgcaaactcttttttccctactgcccccaaacccttcccttctccttcttttcatttctgcccacgtatccttgtgccaaaccctttgacagtttttgagtctacactgggtttcaaggactggtcataagaggtacctcactggaagtaggggaggggggcaccaatagcagcagtgttgatagattcttagacctggtatagaagtgacctattttcagccgggagcggtggctcacacctgtaatcccagcactttgagaggccaaggcgggtggatcatgaggtcaggagttcgagaccagcctggccaagatggtgaaaccccgtcttta

SEQ ID NO: 410019 - DNA, 252 bp, Homo sapiens
attcgcggccgcgtcgacaaactggtaacttattggcaaattgatgtagttgctataatacaagatgccatatgattaagttagcagtttgagtcaaattagttaatgtcactttctactttagaattttaattggtataactcaaaaagtataggcttaacaccaagcctcaaaacacgttgatttcaaacacatttttattaaattggtgggaaagtagatggcttctcactttcatttttaaagtttat

SEQ ID NO: 410020 - DNA, 624 bp, Homo sapiens
aattatctacttttttttttttttttttttgagatggagtctcactctgtccccaggctggagtacagtggcacaatttcagctcactgcaagctccacctccctggttctcctgcctcagcctcccaagtagctgggactacaggcacccaccagcacactcggctaattttttgtatttttagtagagacggggtttcaccatgttagccaggatggtctcgatctcctgacctcgtgatccgcctgcagacatcattagcattgctagaaatggaaagaccaggcacaaggcagccttcaagaaaggatgtaagtgcctctggagtaccaggacctaaagtttaagaagctcccttatggaaagaaaaatttaccaaaaaaccggttatcccattggtcactgggcagatgcaagcccctttatcctctgaggaatcccaccccatgtatcaggaagctggctgatgatctcagccaagtatctaagaataaacccagttgaagtaattcacactaaagtgtaaatgactgatatgtttagatcagcacgacatggtttgtcgtatcaaaaaagtatgtcctcctggaatatgaaggtagatctttttttttttttttttt

SEQ ID NO: 410021 - DNA, 524 bp, Homo sapiens
aggagagcttatggtatatcaaagtaagaaatgagtttgaaactgggttagaagctcaggaaaatatgaagtggtcttgaactcctgacctcaagtgatcatcctggccaacatggtgaaaccccgtctgtactaaaaataccaaaaattagccaggcgtgatagcaggcgcctgtggttccagctatgggaggctgaggcaggagaatcagatgaacctgggagacggaggttgcagtgagctgagatcgcgccactgcactccagcctggtgacagagtgacactccgtctcaaaaaaaaaaagaaacgatcacatccagatgtcctgttactggaagggcaccatagtttatcctgcacctaacactaatacacctactctgggaattcttctacctacaactatttatttatctgatcccatctggtattaaagttctaaaagttaacagaattcttaaaggttcccaatgcctcccagaaaccccatcatctcaaaatcactagctattaaaagaagca

SEQ ID NO: 410022 - DNA, 558 bp, Homo sapiens
aggagagcttatggtatatcaaagtaagaaatgagtttgaaactgggttagaagctcaggaaaatatgaagtggtcttgaactcctgacctcaagtgatcatcctggccaacatggtgaaaccccgtctgtactaaaaataccaaaaattagccaggcgtgatagcaggcgcctgtggttccagctatgggaggctgaggcaggagaatcagatgaacctgggagacggaggttgcagtgagctgagatcgcgccactgcactccagcctggtgacagagtgacactccgtctcaaaaaaaaaaagaaacgatcacatccagatgtcctgttactggaagggcaccatagtttatcctgcacctaacactaatacacctactctgggaattcttctacctacaactatttatttatctgatcccatctggtattaaagttctaaaagttaacagaattcttaaaggttcccaatgcctcccagaaaccccatcatctcaaaaaaacaaaagaaacgatcacatccagatgtcctgttactggaagggcaccatagttt

SEQ ID NO: 410023 - DNA, 1924 bp, Homo sapiens
actggccgctgagagaagaatcgggtggagcagagagcagctgctgcagggcagacagccggacccccaaatctgcacgtaccagcagtcagccgccccacgcagggaccggcttacccctcgctccccgccctcactcactttctcccgccctcggcccggcctcccagctctctacttcgcgtgtctacaaactcaactcccggtttccgtgcctctccaccgctcgagttctctactctccatatccgaggggcccctcccagcatctacccccctcccaacctcgggggacctagccaagctaggggggactggatccgacgggtggagcagccaggtgagccccgaaaggtggggcggggcaggggcgctcccagccccaccccgggatctggtgacgctggggctggaatttgacaccggacggctgcggcggcgggcaggaggctgctgagggatggagttgggcccggcccccagacaaggcccgggggctccgccagcagcaggtccctcgggccccagccctcgctgccacccgggcctggagccccacacccgagggtgcagactggctgccaaggccacacttttggctaaaagaggcactgccaggtgtacagtcctgggcatgcgctgtttgagcttcgggggagagcccagcactggtccccggaaaggtgcctagaagaacaaggtgcaggaccccgtgctgcctcaacaggagggtgggggaacagctcaacaatggctgatgggcgctcctggtgttgatagagatggaacttggacttggaggcctctccacgctgtcccactgcccctggcctaggcggcagcctgccctgtggcccaccctggccgctctggctctgctgagcagcgtcgcagaggcctccctgggctccgcgccccgcagccctgccccccgcgaaggccccccgcctgtcctggcgtcccccgccggccacctgccggggggacgcacggcccgctggtgcagtggaagagcccggcggccgccgccgcagccttctcggcccgcgcccccgccgcctgcacccccatctgctcttccccgcgggggccgcgcggcgcgggctgggggcccgggcagccgcgctcgggcagcgggggcgcggggctgccgcctgcgctcgcagctggtgccggtgcgcgcgctcggcctgggccaccgctccgacgagctggtgcgtttccgcttctgcagcggctcctgccgccgcgcgcgctctccacacgacctcagcctggccagcctactgggcgccggggccctgcgaccgcccccgggctcccggcccgtcagccagccctgctgccgacccacgcgctacgaagcggtctccttcatggacgtcaacagcacctggagaaccgtggaccgcctctccgccaccgcctgcggctgcctgggctgagggctcgctccagggctttgcagactggacccttaccggtggctcttcctgcctgggaccctcccgcagagtcccactagccagcggcctcagccagggacgaaggcctcaaagctgagaggcccctaccggtgggtgatggatatcatccccgaacaggtgaagggacaactgactagcagccccagagccctcaccctgcggatcccagcctaaaagacaccagagacctcagctatggagcccttcggacccacttctcacagactctggcactggccaggcctcgaacctgggacccctcctctgatgaacactacagtggctgaggcatcagcccccgcccaggccctgtagggacagcatttgaaggacacatattgcagttgcttggttgaaagtgcctgtgctggaactggcctgtactcactcatgggagctggcccctatttattatttctaagttatttatttacttc

SEQ ID NO: 410024 - DNA, 1440 bp, Homo sapiens
ctctgagcttctctgagccttgtttgctcatctggaaaaaggggattaaaccatttacctcatggagttgtgaaagaatagctgcaaagcacctaacacatagtaaggttcccagtgcagctacttctgctgggttgagtctagctgtgtaggccccttgttcctcacctggagaaactggggtggcaggccggtcccccacaaaagataactcatctcttaatttgcaagctgcctcaacaggagggtgggggaacagctcaacaatggctgatgggcgctcctggtgttgatagagatggaacttggacttggaggcctctccacgctgtcccactgcccctggcctaggcggcagcctgccctgtggcccaccctggccgctctggctctgctgagcagcgtcgcagaggcctccctgggctccgcgccccgcagccctgccccccgcgaaggccccccgcctgtcctggcgtcccccgccggccacctgccggggggacgcacggcccgctggtgcagtggaagagcccggcggccgccgccgcagccttctcggcccgcgcccccgccgcctgcacccccatctgctcttccccgcgggggccgcgcggcgcgggctgggggcccgggcagccgcgctcgggcagcgggggcgcggggctgccgcctgcgctcgcagctggtgccggtgcgcgcgctcggcctgggccaccgctccgacgagctggtgcgtttccgcttctgcagcggctcctgccgccgcgcgcgctctccacacgacctcagcctggccagcctactgggcgccggggccctgcgaccgcccccgggctcccggcccgtcagccagccctgctgccgacccacgcgctacgaagcggtctccttcatggacgtcaacagcacctggagaaccgtggaccgcctctccgccaccgcctgcggctgcctgggctgagggctcgctccagggctttgcagactggacccttaccggtggctcttcctgcctgggaccctcccgcagagtcccactagccagcggcctcagccagggacgaaggcctcaaagctgagaggcccctaccggtgggtgatggatatcatccccgaacaggtgaagggacaactgactagcagccccagagccctcaccctgcggatcccagcctaaaagacaccagagacctcagctatggagcccttcggacccacttctcacagactctggcactggccaggcctcgaacctgggacccctcctctgatgaacactacagtggctgaggcatcagcccccgcccaggccctgtagggacagcatttgaaggacacatattgcagttgcttggttgaaagtgcctgtgctggaactggcctgtactcactcatgggagctggcccctatttattatttctaagttatttatttacttc

SEQ ID NO: 410025 - DNA, 1402 bp, Homo sapiens
ctctgagcttctctgagccttgtttgctcatctggaaaaaggggattaaaccatttacctcatggagttgtgaaagaatagctgcaaagcacctaacacatagtaaggttcccagtgcagctacttctgctgggttgagtctagctgtgtaggccccttgttcctcacctggagaaactggggtggcaggccggtcccccacaaaagataactcatctcttaatttgcaagctgcctcaacaggagggtgggggaacagctcaacaatggctgatgggcgctcctggtgttgatagagatggaacttggacttggaggcctctccacgctgtcccactgcccctggcctaggcggcagcctgccctgtggcccaccctggccgctctggctctgctgagcagcgtcgcagaggcctccctgggctccgcgccccgcagccctgccccccgcgaaggccccccgcctgtcctggcgtcccccgccggccacctgccggggggacgcacggcccgctggtgcagtggaagagcccggcggccgccgccgcagccttctcggcccgcgcccccgccgcctgcacccccatctgctcttccccgcgggggccgcgcggcgcgggctgggggcccgggcagccgcgctcgggcagcgggggcgcggggctgccgcctgcgctcgcagctggtgccggtgcgcgcgctcggcctgggccaccgctccgacgagctggtgcgtttccgcttctgcagcggctcctgccgccgcgcgcgctctccacacgacctcagcctggccagcctactgggcgccggggccctgcgaccgcccccgggctcccggcccgtcagccagccctgctgccgacccacgcgctacgaagcggtctccttcatggacgtcaacagcacctggagaaccgtggaccgcctctccgccaccgcctgcggctgcctgggctgagggctcgctccagggctttgcagactggacccttaccggtggctcttcctgcctgggaccctcccgcagagtcccactagccagcggcctcagccagggacgaaggcctcaaagctgagaggcccctaccggtgggtgatggatatcatccccgaacaggtgaagggacaactgactagcagccccagagccctcagctatggagcccttcggacccacttctcacagactctggcactggccaggcctcgaacctgggacccctcctctgatgaacactacagtggctgaggcatcagcccccgcccaggccctgtagggacagcatttgaaggacacatattgcagttgcttggttgaaagtgcctgtgctggaactggcctgtactcactcatgggagctggcccctatttattatttctaagttatttatttacttc

SEQ ID NO: 410026 - DNA, 1507 bp, Homo sapiens
tcctacctggtactgaggaaaggcggcttgactggtgagggagagcagggcttggcttgggcagcggttaggtgtgggagggaaaatggtcagggagggaccaggtgaatgggaggaggagcgggacttctctgaatggtcggtgcactcaggtgattcctcccctgggctcccagaggcagcaaacccattatactggaacctaggcccttcctgagtttcccctccacacagctaggagcccatgcccggcctgatctcagcccgaggacagcccctccttgaggtccttcctccccaagcccacctgggtgccctctttctccctgaggctccacttggtctctccgcgcagcctgccctgtggcccaccctggccgctctggctctgctgagcagcgtcgcagaggcctccctgggctccgcgccccgcagccctgccccccgcgaaggccccccgcctgtcctggcgtcccccgccggccacctgccgggtaggtgagagggcgagggggcggggcggggctggcccgggacaccgcgcgtgactgggtctcattccagggggacgcacggcccgctggtgcagtggaagagcccggcggccgccgccgcagccttctcggcccgcgcccccgccgcctgcacccccatctgctcttccccgcgggggccgcgcggcgcgggctgggggcccgggcagccgcgctcgggcagcgggggcgcggggctgccgcctgcgctcgcagctggtgccggtgcgcgcgctcggcctgggccaccgctccgacgagctggtgcgtttccgcttctgcagcggctcctgccgccgcgcgcgctctccacacgacctcagcctggccagcctactgggcgccggggccctgcgaccgcccccgggctcccggcccgtcagccagccctgctgccgacccacgcgctacgaagcggtctccttcatggacgtcaacagcacctggagaaccgtggaccgcctctccgccaccgcctgcggctgcctgggctgagggctcgctccagggctttgcagactggacccttaccggtggctcttcctgcctgggaccctcccgcagagtcccactagccagcggcctcagccagggacgaaggcctcaaagctgagaggcccctaccggtgggtgatggatatcatccccgaacaggtgaagggacaactgactagcagccccagagccctcaccctgcggatcccagcctaaaagacaccagagacctcagctatggagcccttcggacccacttctcacagactctggcactggccaggcctcgaacctgggacccctcctctgatgaacactacagtggctgaggcatcagcccccgcccaggccctgtagggacagcatttgaaggacacatattgcagttgcttggttgaaagtgcctgtgctggaactggcctgtactcactcatgggagctggcccctatttattatttctaagttatttatttacttc

SEQ ID NO: 410027 - DNA, 1437 bp, Homo sapiens
tcctacctggtactgaggaaaggcggcttgactggtgagggagagcagggcttggcttgggcagcggttaggtgtgggagggaaaatggtcagggagggaccaggtgaatgggaggaggagcgggacttctctgaatggtcggtgcactcaggtgattcctcccctgggctcccagaggcagcaaacccattatactggaacctaggcccttcctgagtttcccctccacacagctaggagcccatgcccggcctgatctcagcccgaggacagcccctccttgaggtccttcctccccaagcccacctgggtgccctctttctccctgaggctccacttggtctctccgcgcagcctgccctgtggcccaccctggccgctctggctctgctgagcagcgtcgcagaggcctccctgggctccgcgccccgcagccctgccccccgcgaaggccccccgcctgtcctggcgtcccccgccggccacctgccggggggacgcacggcccgctggtgcagtggaagagcccggcggccgccgccgcagccttctcggcccgcgcccccgccgcctgcacccccatctgctcttccccgcgggggccgcgcggcgcgggctgggggcccgggcagccgcgctcgggcagcgggggcgcggggctgccgcctgcgctcgcagctggtgccggtgcgcgcgctcggcctgggccaccgctccgacgagctggtgcgtttccgcttctgcagcggctcctgccgccgcgcgcgctctccacacgacctcagcctggccagcctactgggcgccggggccctgcgaccgcccccgggctcccggcccgtcagccagccctgctgccgacccacgcgctacgaagcggtctccttcatggacgtcaacagcacctggagaaccgtggaccgcctctccgccaccgcctgcggctgcctgggctgagggctcgctccagggctttgcagactggacccttaccggtggctcttcctgcctgggaccctcccgcagagtcccactagccagcggcctcagccagggacgaaggcctcaaagctgagaggcccctaccggtgggtgatggatatcatccccgaacaggtgaagggacaactgactagcagccccagagccctcaccctgcggatcccagcctaaaagacaccagagacctcagctatggagcccttcggacccacttctcacagactctggcactggccaggcctcgaacctgggacccctcctctgatgaacactacagtggctgaggcatcagcccccgcccaggccctgtagggacagcatttgaaggacacatattgcagttgcttggttgaaagtgcctgtgctggaactggcctgtactcactcatgggagctggcccctatttattatttctaagttatttatttacttc

SEQ ID NO: 410028 - DNA, 2018 bp, Homo sapiens
actggccgctgagagaagaatcgggtggagcagagagcagctgctgcagggcagacagccggacccccaaatctgcacgtaccagcagtcagccgccccacgcagggaccggcttacccctcgctccccgccctcactcactttctcccgccctcggcccggcctcccagctctctacttcgcgtgtctacaaactcaactcccggtttccgtgcctctccaccgctcgagttctctactctccatatccgaggggcccctcccagcatctacccccctcccaacctcgggggacctagccaagctaggggggactggatccgacgggtggagcagccaggtgagccccgaaaggtggggcggggcaggggcgctcccagccccaccccgggatctggtgacgctggggctggaatttgacaccggacggctgcggcggcgggcaggaggctgctgagggatggagttgggcccggcccccagacaaggcccgggggctccgccagcagcaggtccctcgggccccagccctcgctgccacccgggcctggagccccacacccgagggtgcagactggctgccaaggccacacttttggctaaaagaggcactgccaggtgtacagtcctgggcatgcgctgtttgagcttcgggggagagcccagcactggtccccggaaaggtgcctagaagaacaaggtgcaggaccccgtgctgcctcaacaggagggtgggggaacagctcaacaatggctgatgggcgctcctggtgttgatagagatggaacttggacttggaggcctctccacgctgtcccactgcccctggcctaggcggcaggctccacttggtctctccgcgcagcctgccctgtggcccaccctggccgctctggctctgctgagcagcgtcgcagaggcctccctgggctccgcgccccgcagccctgccccccgcgaaggccccccgcctgtcctggcgtcccccgccggccacctgccgggtaggtgagagggcgagggggcggggcggggctggcccgggacaccgcgcgtgactgggtctcattccagggggacgcacggcccgctggtgcagtggaagagcccggcggccgccgccgcagccttctcggcccgcgcccccgccgcctgcacccccatctgctcttccccgcgggggccgcgcggcgcgggctgggggcccgggcagccgcgctcgggcagcgggggcgcggggctgccgcctgcgctcgcagctggtgccggtgcgcgcgctcggcctgggccaccgctccgacgagctggtgcgtttccgcttctgcagcggctcctgccgccgcgcgcgctctccacacgacctcagcctggccagcctactgggcgccggggccctgcgaccgcccccgggctcccggcccgtcagccagccctgctgccgacccacgcgctacgaagcggtctccttcatggacgtcaacagcacctggagaaccgtggaccgcctctccgccaccgcctgcggctgcctgggctgagggctcgctccagggctttgcagactggacccttaccggtggctcttcctgcctgggaccctcccgcagagtcccactagccagcggcctcagccagggacgaaggcctcaaagctgagaggcccctaccggtgggtgatggatatcatccccgaacaggtgaagggacaactgactagcagccccagagccctcaccctgcggatcccagcctaaaagacaccagagacctcagctatggagcccttcggacccacttctcacagactctggcactggccaggcctcgaacctgggacccctcctctgatgaacactacagtggctgaggcatcagcccccgcccaggccctgtagggacagcatttgaaggacacatattgcagttgcttggttgaaagtgcctgtgctggaactggcctgtactcactcatgggagctggcccctatttattatttctaagttatttatttacttc

SEQ ID NO: 410029 - DNA, 1953 bp, Homo sapiens
actggccgctgagagaagaatcgggtggagcagagagcagctgctgcagggcagacagccggacccccaaatctgcacgtaccagcagtcagccgccccacgcagggaccggcttacccctcgctccccgccctcactcactttctcccgccctcggcccggcctcccagctctctacttcgcgtgtctacaaactcaactcccggtttccgtgcctctccaccgctcgagttctctactctccatatccgaggggcccctcccagcatctacccccctcccaacctcgggggacctagccaagctaggggggactggatccgacgggtggagcagccaggtgagccccgaaaggtggggcggggcaggggcgctcccagccccaccccgggatctggtgacgctggggctggaatttgacaccggacggctgcggcggcgggcaggaggctgctgagggatggagttgggcccggcccccagacaaggcccgggggctccgccagcagcaggtccctcgggccccagccctcgctgccacccgggcctggagccccacacccgagggtgcagactggctgccaaggccacacttttggctaaaagaggcactgccaggtgtacagtcctgggcatgcgctgtttgagcttcgggggagagcccagcactggtccccggaaaggtgcctagaagaacaaggtgcaggaccccgtgagatggaacttggacttggaggcctctccacgctgtcccactgcccctggcctaggcggcaggctccacttggtctctccgcgcagcctgccctgtggcccaccctggccgctctggctctgctgagcagcgtcgcagaggcctccctgggctccgcgccccgcagccctgccccccgcgaaggccccccgcctgtcctggcgtcccccgccggccacctgccgggtaggtgagagggcgagggggcggggcggggctggcccgggacaccgcgcgtgactgggtctcattccagggggacgcacggcccgctggtgcagtggaagagcccggcggccgccgccgcagccttctcggcccgcgcccccgccgcctgcacccccatctgctcttccccgcgggggccgcgcggcgcgggctgggggcccgggcagccgcgctcgggcagcgggggcgcggggctgccgcctgcgctcgcagctggtgccggtgcgcgcgctcggcctgggccaccgctccgacgagctggtgcgtttccgcttctgcagcggctcctgccgccgcgcgcgctctccacacgacctcagcctggccagcctactgggcgccggggccctgcgaccgcccccgggctcccggcccgtcagccagccctgctgccgacccacgcgctacgaagcggtctccttcatggacgtcaacagcacctggagaaccgtggaccgcctctccgccaccgcctgcggctgcctgggctgagggctcgctccagggctttgcagactggacccttaccggtggctcttcctgcctgggaccctcccgcagagtcccactagccagcggcctcagccagggacgaaggcctcaaagctgagaggcccctaccggtgggtgatggatatcatccccgaacaggtgaagggacaactgactagcagccccagagccctcaccctgcggatcccagcctaaaagacaccagagacctcagctatggagcccttcggacccacttctcacagactctggcactggccaggcctcgaacctgggacccctcctctgatgaacactacagtggctgaggcatcagcccccgcccaggccctgtagggacagcatttgaaggacacatattgcagttgcttggttgaaagtgcctgtgctggaactggcctgtactcactcatgggagctggcccctatttattatttctaagttatttatttacttc

SEQ ID NO: 410030 - DNA, 1948 bp, Homo sapiens
actggccgctgagagaagaatcgggtggagcagagagcagctgctgcagggcagacagccggacccccaaatctgcacgtaccagcagtcagccgccccacgcagggaccggcttacccctcgctccccgccctcactcactttctcccgccctcggcccggcctcccagctctctacttcgcgtgtctacaaactcaactcccggtttccgtgcctctccaccgctcgagttctctactctccatatccgaggggcccctcccagcatctacccccctcccaacctcgggggacctagccaagctaggggggactggatccgacgggtggagcagccaggtgagccccgaaaggtggggcggggcaggggcgctcccagccccaccccgggatctggtgacgctggggctggaatttgacaccggacggctgcggcggcgggcaggaggctgctgagggatggagttgggcccggcccccagacaaggcccgggggctccgccagcagcaggtccctcgggccccagccctcgctgccacccgggcctggagccccacacccgagggtgcagactggctgccaaggccacacttttggctaaaagaggcactgccaggtgtacagtcctgggcatgcgctgtttgagcttcgggggagagcccagcactggtccccggaaaggtgcctagaagaacaaggtgcaggaccccgtgctgcctcaacaggagggtgggggaacagctcaacaatggctgatgggcgctcctggtgttgatagagatggaacttggacttggaggcctctccacgctgtcccactgcccctggcctaggcggcaggctccacttggtctctccgcgcagcctgccctgtggcccaccctggccgctctggctctgctgagcagcgtcgcagaggcctccctgggctccgcgccccgcagccctgccccccgcgaaggccccccgcctgtcctggcgtcccccgccggccacctgccggggggacgcacggcccgctggtgcagtggaagagcccggcggccgccgccgcagccttctcggcccgcgcccccgccgcctgcacccccatctgctcttccccgcgggggccgcgcggcgcgggctgggggcccgggcagccgcgctcgggcagcgggggcgcggggctgccgcctgcgctcgcagctggtgccggtgcgcgcgctcggcctgggccaccgctccgacgagctggtgcgtttccgcttctgcagcggctcctgccgccgcgcgcgctctccacacgacctcagcctggccagcctactgggcgccggggccctgcgaccgcccccgggctcccggcccgtcagccagccctgctgccgacccacgcgctacgaagcggtctccttcatggacgtcaacagcacctggagaaccgtggaccgcctctccgccaccgcctgcggctgcctgggctgagggctcgctccagggctttgcagactggacccttaccggtggctcttcctgcctgggaccctcccgcagagtcccactagccagcggcctcagccagggacgaaggcctcaaagctgagaggcccctaccggtgggtgatggatatcatccccgaacaggtgaagggacaactgactagcagccccagagccctcaccctgcggatcccagcctaaaagacaccagagacctcagctatggagcccttcggacccacttctcacagactctggcactggccaggcctcgaacctgggacccctcctctgatgaacactacagtggctgaggcatcagcccccgcccaggccctgtagggacagcatttgaaggacacatattgcagttgcttggttgaaagtgcctgtgctggaactggcctgtactcactcatgggagctggcccctatttattatttctaagttatttatttacttc

SEQ ID NO: 410031 - DNA, 1775 bp, Homo sapiens
actggccgctgagagaagaatcgggtggagcagagagcagctgctgcagggcagacagccggacccccaaatctgcacgtaccagcagtcagccgccccacgcagggaccggcttacccctcgctccccgccctcactcactttctcccgccctcggcccggcctcccagctctctacttcgcgtgtctacaaactcaactcccggtttccgtgcctctccaccgctcgagttctctactctccatatccgaggggcccctcccagcatctacccccctcccaacctcgggggacctagccaagctaggggggactggatccgacgggtggagcagccaggtgagccccgaaaggtggggcggggcaggggcgctcccagccccaccccgggatctggtgacgctggggctggaatttgacaccggacggctgcggcggcgggcaggaggctgctgagggatggagttgggcccggcccccagacaaggcccgggggctccgccagcagcaggtccctcgggccccagccctcgctgccacccgggcctggagccccacacccgagctgcctcaacaggagggtgggggaacagctcaacaatggctgatgggcgctcctggtgttgatagagatggaacttggacttggaggcctctccacgctgtcccactgcccctggcctaggcggcagcctgccctgtggcccaccctggccgctctggctctgctgagcagcgtcgcagaggcctccctgggctccgcgccccgcagccctgccccccgcgaaggccccccgcctgtcctggcgtcccccgccggccacctgccggggggacgcacggcccgctggtgcagtggaagagcccggcggccgccgccgcagccttctcggcccgcgcccccgccgcctgcacccccatctgctcttccccgcgggggccgcgcggcgcgggctgggggcccgggcagccgcgctcgggcagcgggggcgcggggctgccgcctgcgctcgcagctggtgccggtgcgcgcgctcggcctgggccaccgctccgacgagctggtgcgtttccgcttctgcagcggctcctgccgccgcgcgcgctctccacacgacctcagcctggccagcctactgggcgccggggccctgcgaccgcccccgggctcccggcccgtcagccagccctgctgccgacccacgcgctacgaagcggtctccttcatggacgtcaacagcacctggagaaccgtggaccgcctctccgccaccgcctgcggctgcctgggctgagggctcgctccagggctttgcagactggacccttaccggtggctcttcctgcctgggaccctcccgcagagtcccactagccagcggcctcagccagggacgaaggcctcaaagctgagaggcccctaccggtgggtgatggatatcatccccgaacaggtgaagggacaactgactagcagccccagagccctcaccctgcggatcccagcctaaaagacaccagagacctcagctatggagcccttcggacccacttctcacagactctggcactggccaggcctcgaacctgggacccctcctctgatgaacactacagtggctgaggcatcagcccccgcccaggccctgtagggacagcatttgaaggacacatattgcagttgcttggttgaaagtgcctgtgctggaactggcctgtactcactcatgggagctggcccctatttattatttctaagttatttatttacttc

SEQ ID NO: 410032 - DNA, 1396 bp, Homo sapiens
tccccctagcgcagagggctcctaaggctgccctgcctgcctttccctccatcacggacaacagtcactggcctggctcggaggccttgattccacttagccaagaggcacacaccaggacctggaggacaaccccgggaaggcctgggggtctgttccacagctgcctcaacaggagggtgggggaacagctcaacaatggctgatgggcgctcctggtgttgatagagatggaacttggacttggaggcctctccacgctgtcccactgcccctggcctaggcggcaggctccacttggtctctccgcgcagcctgccctgtggcccaccctggccgctctggctctgctgagcagcgtcgcagaggcctccctgggctccgcgccccgcagccctgccccccgcgaaggccccccgcctgtcctggcgtcccccgccggccacctgccggggggacgcacggcccgctggtgcagtggaagagcccggcggccgccgccgcagccttctcggcccgcgcccccgccgcctgcacccccatctgctcttccccgcgggggccgcgcggcgcgggctgggggcccgggcagccgcgctcgggcagcgggggcgcggggctgccgcctgcgctcgcagctggtgccggtgcgcgcgctcggcctgggccaccgctccgacgagctggtgcgtttccgcttctgcagcggctcctgccgccgcgcgcgctctccacacgacctcagcctggccagcctactgggcgccggggccctgcgaccgcccccgggctcccggcccgtcagccagccctgctgccgacccacgcgctacgaagcggtctccttcatggacgtcaacagcacctggagaaccgtggaccgcctctccgccaccgcctgcggctgcctgggctgagggctcgctccagggctttgcagactggacccttaccggtggctcttcctgcctgggaccctcccgcagagtcccactagccagcggcctcagccagggacgaaggcctcaaagctgagaggcccctaccggtgggtgatggatatcatccccgaacaggtgaagggacaactgactagcagccccagagccctcaccctgcggatcccagcctaaaagacaccagagacctcagctatggagcccttcggacccacttctcacagactctggcactggccaggcctcgaacctgggacccctcctctgatgaacactacagtggctgaggcatcagcccccgcccaggccctgtagggacagcatttgaaggacacatattgcagttgcttggttgaaagtgcctgtgctggaactggcctgtactcactcatgggagctggcccctatttattatttctaagttatttatttacttc

SEQ ID NO: 410033 - DNA, 170 bp, Homo sapiens
tgtttattagcagtcaaattaaagtgaagtaacagtgattttctactttttccatcattgaacaaagctgaaaataaattagttacctagagtttggaaacataagacagatttttcaataatacaaataggagtgtaatttgcataatcttcttggagaatgtacttta

SEQ ID NO: 410034 - DNA, 1699 bp, Homo sapiens
  misc_feature (1624)..(1624): n is a, c, g, or t
  misc_feature (1627)..(1627): n is a, c, g, or t
  misc_feature (1677)..(1677): n is a, c, g, or t
acgcggcggggaggggaggggccgggccgggccgggcgggaggagccgctcgccggttttgccgcctccgcctttgccttcgcagccgcctccagtgttgtacattataaaccggggctgctgatgaggagtggggaactggctctctggaacgtgtgacagcaggcagaaggggtgagagtgaaatccaatccactttccatttagccgacctccgcttcaagctgccctgatatcatgggcaatttgcatatttctccaaagaaccatccagaacctgagcagcctgtcttcagacagagagaggcccacggctgtttcttgaaatctggcgctgggaatggccatgtggaacaggccatgccagaggctgcctcagcagcctctggtagctgagcccactgcagagggggagccacacctgcccacgggccgggagctgactgaggccaaccgcttcgcctatgctgccctctgtggcatctccctgtcccagttatttcctgaacccgaacacagctccttctgcacagagttcatggcaggcctggtgcagtggctggagttgtctgaagctgtcttgccaaccatgactgcttttgcgagcggcctgggaggtgaaggagcagatgtgtttgttcaaattttactgaaggaccccatcttgaaggacgacccgacggtgatcactcaggaccttctgagcttctcactcaaggatgggcactatgacgcccgggccagagtcctcgtttgccacatgacctccctgctccaagtgcccttggaggagctggatgtccttgaagagatgttcctggagagcctgaaggaaatcaaagaagaggaatctgaaatggccgaggcatcccgaaagaagaaagaaaaccggaggaaatggaagcgttatctcctgataggcctggcgactgtcggaggcggaacggtgatcggtgtgactggaggtctagctgcaccccttgttgccgctggagcagcgacgattattggcagcgccggggcagcggctctgggctcagcagccggcatagccatcatgacctcgctgtttggtgcagctggagctggcctgacaggatacaagatgaagaagcgagtgggagccattgaagagttcacgtttctgcctctgacggagggcaggcagctgcacatcaccatcgccgtcacggggtggctcgcttctggcaaataccgcaccttcagtgccccgtgggctgccctggcccacagccgtgagcagtactgcctggcctgggaagccaagtacctgatggagctcggcaatgccctggagaccatcctcagtggtctcgccaacatggtggcccaggaggccctaaagtacacagtgttgtctggcattgtggctgccctgacctggccagcctcactcctcagtgtcgccaatgtcatcgacaacccctggggggtgtgtctccatcgatcagcagaggttggcaagcacctggcccacatcctgctctcccggcagcaggggcgacgacctgtcaccttgattggcttcagcctgggagccagagtcatctacttctgtctgcaggagatggctcaagagaaagattgccaaggaatcatcgangangtcatcctgcctggtgcgcctgtggaggggagagccaagcattgggagcnttccggaagtggtgtccgggag

SEQ ID NO: 410035 - DNA, 1554 bp, Homo sapiens
  misc_feature (1479)..(1479): n is a, c, g, or t
  misc_feature (1482)..(1482): n is a, c, g, or t
  misc_feature (1532)..(1532): n is a, c, g, or t
acgcggcggggaggggaggggccgggccgggccgggcgggaggagccgctcgccggttttgccgcctccgcctttgccttcgcagccgcctccagggcaatttgcatatttctccaaagaaccatccagaacctgagcagcctgtcttcagacagagagaggcccacggctgtttcttgaaatctggcgctgggaatggccatgtggaacaggccatgccagaggctgcctcagcagcctctggtagctgagcccactgcagagggggagccacacctgcccacgggccgggagctgactgaggccaaccgcttcgcctatgctgccctctgtggcatctccctgtcccagttatttcctgaacccgaacacagctccttctgcacagagttcatggcaggcctggtgcagtggctggagttgtctgaagctgtcttgccaaccatgactgcttttgcgagcggcctgggaggtgaaggagcagatgtgtttgttcaaattttactgaaggaccccatcttgaaggacgacccgacggtgatcactcaggaccttctgagcttctcactcaaggatgggcactatgacgcccgggccagagtcctcgtttgccacatgacctccctgctccaagtgcccttggaggagctggatgtccttgaagagatgttcctggagagcctgaaggaaatcaaagaagaggaatctgaaatggccgaggcatcccgaaagaagaaagaaaaccggaggaaatggaagcgttatctcctgataggcctggcgactgtcggaggcggaacggtgatcggtgtgactggaggtctagctgcaccccttgttgccgctggagcagcgacgattattggcagcgccggggcagcggctctgggctcagcagccggcatagccatcatgacctcgctgtttggtgcagctggagctggcctgacaggatacaagatgaagaagcgagtgggagccattgaagagttcacgtttctgcctctgacggagggcaggcagctgcacatcaccatcgccgtcacggggtggctcgcttctggcaaataccgcaccttcagtgccccgtgggctgccctggcccacagccgtgagcagtactgcctggcctgggaagccaagtacctgatggagctcggcaatgccctggagaccatcctcagtggtctcgccaacatggtggcccaggaggccctaaagtacacagtgttgtctggcattgtggctgccctgacctggccagcctcactcctcagtgtcgccaatgtcatcgacaacccctggggggtgtgtctccatcgatcagcagaggttggcaagcacctggcccacatcctgctctcccggcagcaggggcgacgacctgtcaccttgattggcttcagcctgggagccagagtcatctacttctgtctgcaggagatggctcaagagaaagattgccaaggaatcatcgangangtcatcctgcctggtgcgcctgtggaggggagagccaagcattgggagcnttccggaagtggtgtccgggag

SEQ ID NO: 410036 - DNA, 1579 bp, Homo sapiens
  misc_feature (1504)..(1504): n is a, c, g, or t
  misc_feature (1507)..(1507): n is a, c, g, or t
  misc_feature (1557)..(1557): n is a, c, g, or t
acgcggcggggaggggaggggccgggccgggccgggcgggaggagccgctcgccggttttgccgcctccgcctttgccttcgcagccgcctccagtgttgtacattataaaccggggctgctgatgaggagtggggaactggctctctggaacgtgtgacagcaggcagaaggggtgagagtgaaatccaatccactttccatttagccgacctccgcttcaagctgccctgatatcatgggcaatttgcatatttctccaaagaaccatccagaacctgagcagcctgtcttcagacagagagaggcccacggctgtttcttgaaatctggcgctgggaatggccatgtggaacaggccatgccagaggctgcctcagcagcctctggtagctgagcccactgcagagggggagccacacctgcccacgggccgggagctgactgaggccaaccgcttcgcctatgctgccctctgtggcatctccctgtcccagttatttcctgaacccgaacacagctccttctgcacagagttcatggcaggcctggtgcagtggctggagttgtctgaagctgtcttgccaaccatgactgcttttgcgagcggcctgggaggtgaaggagcagatgtgtttgttcaaattttactgaaggaccccatcttgaaggacgacccgacggtgatcactcaggaccttctgagcttctcactcaaggatgggcactatgacgcccgggccagagtcctcgtttgccacatgacctccctgctccaagtgcccttggaggagctggatgtccttgaagagatgttcctggagagcctgaaggaaatcaaagaagaggaatctgaaatggccgaggcatcccgaaagaagaaagaaaaccggaggaaatggaagcgttatctcctgataggcctggcgactgtcggaggcggaacggtgatcggtgtgactggaggtctagctgcaccccttgttgccgctggagcagcgacgattattggcagcgccggggcagcggctctgggctcagcagccggcatagccatcatgacctcgctgtttggtgcagctggagctggcctgacaggcaccttcagtgccccgtgggctgccctggcccacagccgtgagcagtactgcctggcctgggaagccaagtacctgatggagctcggcaatgccctggagaccatcctcagtggtctcgccaacatggtggcccaggaggccctaaagtacacagtgttgtctggcattgtggctgccctgacctggccagcctcactcctcagtgtcgccaatgtcatcgacaacccctggggggtgtgtctccatcgatcagcagaggttggcaagcacctggcccacatcctgctctcccggcagcaggggcgacgacctgtcaccttgattggcttcagcctgggagccagagtcatctacttctgtctgcaggagatggctcaagagaaagattgccaaggaatcatcgangangtcatcctgcctggtgcgcctgtggaggggagagccaagcattgggagcnttccggaagtggtgtccgggag

SEQ ID NO: 410037 - DNA, 1234 bp, Homo sapiens
  misc_feature (1159)..(1159): n is a, c, g, or t
  misc_feature (1162)..(1162): n is a, c, g, or t
  misc_feature (1212)..(1212): n is a, c, g, or t
taggctaggtcgaggccggtgtaatcggccgaggattcctgaacccgatcacagctccttctgcacagagttcatggcaggcctggtgcagtggctggagttgtctgaagctgtcttgccaaccatgactgcttttgcgagcggcctgggaggtgaaggagcagatgtgtttgttcaaattttactgaaggaccccatcttgaaggacgacccgacggtgatcactcaggaccttctgagcttctcactcaaggatgggcactatgacgcccgggccagagtcctcgtttgccacatgacctccctgctccaagtgcccttggaggagctggatgtccttgaagagatgttcctggagagcctgaaggaaatcaaagaagaggaatctgaaatggccgaggcatcccgaaagaagaaagaaaaccggaggaaatggaagcgttatctcctgataggcctggcgactgtcggaggcggaacggtgatcggtgtgactggaggtctagctgcaccccttgttgccgctggagcagcgacgattattggcagcgccggggcagcggctctgggctcagcagccggcatagccatcatgacctcgctgtttggtgcagctggagctggcctgacaggatacaagatgaagaagcgagtgggagccattgaagagttcacgtttctgcctctgacggagggcaggcagctgcacatcaccatcgccgtcacggggtggctcgcttctggcaaataccgcaccttcagtgccccgtgggctgccctggcccacagccgtgagcagtactgcctggcctgggaagccaagtacctgatggagctcggcaatgccctggagaccatcctcagtggtctcgccaacatggtggcccaggaggccctaaagtacacagtgttgtctggcattgtggctgccctgacctggccagcctcactcctcagtgtcgccaatgtcatcgacaacccctggggggtgtgtctccatcgatcagcagaggttggcaagcacctggcccacatcctgctctcccggcagcaggggcgacgacctgtcaccttgattggcttcagcctgggagccagagtcatctacttctgtctgcaggagatggctcaagagaaagattgccaaggaatcatcgangangtcatcctgcctggtgcgcctgtggaggggagagccaagcattgggagcnttccggaagtggtgtccgggag

SEQ ID NO: 410038 - DNA, 1243 bp, Homo sapiens
  misc_feature (1168)..(1168): n is a, c, g, or t
  misc_feature (1171)..(1171): n is a, c, g, or t
  misc_feature (1221)..(1221): n is a, c, g, or t
acgcggcggggaggggaggggccgggccgggccgggcgggaggagccgctcgccggttttgccgcctccgcctttgccttcgcagccgcctccagtgttgtacattataaaccggggctgctgatgaggagtggggaactggctctctggaacgtgtgacagcaggcagaaggggtgagagtgaaatccaatccactttccatttagccgacctccgcttcaagctgccctgatatcatgggcaatttgcatatttctccaaagaaccatccagaacctgagcagcctgtcttcagacagagagaggcccacggctgtttcttgaaatctggcgctgggaatggccatgtggaacaggccatgccagaggctgcctcagcagcctctggtagctgagcccactgcagagggggagccacacctgcccacgggccgggagctgactgaggccaaccgcttcgcctatgctgccctctgtggcatctccctgtcccagttatttcctgaacccgaacacagaatggccgaggcatcccgaaagaagaaagaaaaccggaggaaatggaagcgttatctcctgataggcctggcgactgtcggaggcggaacggtgatcggtgtgactggaggtctagctgcaccccttgttgccgctggagcagcgacgattattggcagcgccggggcagcggctctgggctcagcagccggcatagccatcatgacctcgctgtttggtgcagctggagctggcctgacaggcaccttcagtgccccgtgggctgccctggcccacagccgtgagcagtactgcctggcctgggaagccaagtacctgatggagctcggcaatgccctggagaccatcctcagtggtctcgccaacatggtggcccaggaggccctaaagtacacagtgttgtctggcattgtggctgccctgacctggccagcctcactcctcagtgtcgccaatgtcatcgacaacccctggggggtgtgtctccatcgatcagcagaggttggcaagcacctggcccacatcctgctctcccggcagcaggggcgacgacctgtcaccttgattggcttcagcctgggagccagagtcatctacttctgtctgcaggagatggctcaagagaaagattgccaaggaatcatcgangangtcatcctgcctggtgcgcctgtggaggggagagccaagcattgggagcnttccggaagtggtgtccgggag

SEQ ID NO: 410039 - DNA, 186 bp, Homo sapiens
gcaccttcagtgccccgtgggctgccctggcccacagccgtgagcagtactgcctggcctgggaagccaagtacctgatggagctcggcaatgccctggagaccatcctcagtggtctcgccaacatggtggcccaggaggccctaaagtacacagtgttgtctggtaagtgcccccacctgcccc

SEQ ID NO: 410040 - DNA, 514 bp, Homo sapiens
aatacagctaacattttaatttggactccaagaatttgtaatccgtgataatgaccaacagagctaaaaattacctttaaacattacacgggaaaaaaagtacttgttctttaagccagaggttttaaacctagttgtacattgaaatcatctggagaagtaaaataacaagaatttagcttaaaaataatagatttcctggttttatcccaggccttctgaatcaaaatctctgtgatgcaggcttgagaatctgggattaaagcttctcaggtgattcttttgcagtcagccttggggaatcattgctgtaaattagtgactttatagtactgacaacacattagaatcaaatgggaaactctaaaaagtaataaacagaaatactatatgactgagcctaacctttaaaaaacaaaaacattctctggagggagaccccatagactgtgttttaaaaaaaggtcctctaagtgattttgatgcaagatctggcttaaaaaaaaaaaaaaag

SEQ ID NO: 410041 - DNA, 412 bp, Homo sapiens
gtgtgagcaactccacagcctcccctgctcgacgtccctccaacctctgcctgcaaccctgtcatgtgtacctactgatgtccttggaaaagttgtttaaagcatgttatcacacagcatgaaaatgttccagaagggaagcgcagacttgtaaaactgtgtcggtatttcctgattatctttttttttttggaggtcaagcccttcattttgacacttaatgaataaaatgcctgcactgcgagaaatagggtaatgaattataaaaagacataatcagcaatgactaaataattaagagaattgatatgcagagtcatctgggaatgcattaataataacacgatttgttccatatgctaaagaattctgtttttagaaaatcagtcatcacacatgctccatggcaaaa

SEQ ID NO: 410042 - DNA, 2939 bp, Homo sapiens
aacggctgcggcttcgggcggccgggtttctccggtctcccaacgccgaggagagcttgtaacaggcgctggagctggcccgccaccgccgcgtcagggacggcgctggagtcctccgttcccctcagcctctgagctgaggccccacaccagagtagggggcggcgcggcacccgtgccccggcatggcgacaccggacgcggggctccctggggctgagggcgtggagccggcgccctgggcgcagctggaggcccccgcccgcctcctgctgcaggcgctgcaggcggggcctgagggggcgcggcgcggcctgggggtgctccgggcgctgggcagccgcggctgggagcccttcgactggggtcgcttgctcgaggccctgtgccgggaggagccggtcgtgcaggggcctgacggccgtctggagctgaaaccactgttgctgcgattgccccggatatgccagaggaacctgatgtccctgctgatggccgttcggccatcgctgccggaaagtgggctcctctctgtgctgcagattgcccagcaggacctagcccctgaccccgatgcctggctccgtgccctgggggaattgctgcgaagggatttgggggtggggacctccatggagggagcttctccactgtctgaaagatgccagagacagctccaaagtctatgtagggggctgggcctggggggcaggaggttgaaatccccccaggctccagaccctgaagaagaggagaacagggactcccagcagcctgggaaacgcagaaaggactcagaggaagaggctgccagtcctgaggggaagagggtccccaaaagattacggtgttgggaagaggaagaagatcatgagaaggagagacccgaacataagtcactggaatccctggcagatggaggaagtgcatctcctattaaggaccagcctgtcatggcagttaagactggcgaggacggttcgaatctggatgatgctaaaggtctggctgagagtttggagttgcccaaagctatccaggaccagcttcccaggctgcagcagctgctgaagaccttggaggaggggttagagggattggaggatgcccccccagttgagctacagcttcttcacgaatgtagtcccagccagatggacttgctgtgtgcccagctgcagctccctcagctctcagacctcggtctcctgcggctctgcacctggctgctggccctttcacctgatctcagcctcagcaatgctactgtgctgaccagaagcctctttcttggacggatcctctccttgacttcctcagcctcccgcctgcttacaactgccctgacctccttctgtgccaaatatacataccctgtctgcagcgccctccttgaccctgtgctccaggccccaggcacaggtcctgctcaaacagagttactgtgttgccttgtgaagatggagtccctggagccagatgcacaggttctaatgctgggacagatcttggagctgccctggaaggaggaaactttcttggtgttgcagtcactcctagagcggcaggtggagatgacccctgagaagttcagtgtcttaatggagaagctctgtaaaaaggggctggcagccaccacctccatggcctatgccaagctcatgctgacagtgatgaccaagtatcaggctaacatcactgagacccagaggctgggcctggctatggccctagaacctaacaccaccttcctgaggaagtccctgaaggccgccttgaaacatttgggcccctgaccatccaccaagggaccaccctcttggtgctccatcaccagcttcctgaagggcatttctttcttcaccaccttgtcttgagccctagcctgaggataaaggctgagcctggccatcccagattgcaactgcctccctgttacaggctgcatagggaatattggcttcccagccagcagggaggctcctgggctaagggagctcagctatattttctttttcatttcttttgtttttgagagaaggtattgctctgtcatccaggctggagtgcagtgatgcgattgatcatggctcactgtaacctctgcctcccaggctcgatcctcccatgtcagcctcccaagtagctgggactacatgcacatgacactatgcccagctaattttttattttgtagataatatgctggtcagggctggtcttgaactcctgagctcaagtgatcttcctgccttggcacccaaagtgttgagatttacaggtgtgagccaccacaccaggccagagctatatttccaaaggctgctggccccaggcacactcctcatcaattctcaggctgcagggacaaactttccgatagggctcagtaggatcaagccgacccagagtgggcatgggatgctccaggaggtctggggtaccagtgggctcagatgaagctcttgtgctcatgtatattatgaccttctgtgtttttgtttctgacttgaataatttatcaatggtgttgaataaaagcaagttcaataatgaaaaaaaaaaaaaaaaaaaaaaaaaaaaaaaaaaaacacaacaaaacaaaaaaaaaaaaaaaaaacaaaaaaaaaaaaaaaaaaaaaaaaaaacacaacaaacaaagaaaaaaaaaaagaagaggagaggaaaaaaggagaagaagccgagagagacggagagcagccaagacagagcaaaagagaggaacggaaggacgaagaagagagggaagagaggagagggggagggagcagaggagacggcgcgggcgcgacagagaggaggaaagagggcagaaaggaggagggcaagaagaggaagaaaaagaagaaaaggaggagaggcacagaaggacgagcggcagaagaagagaaggcgaggagagggagacaaaggacaac

SEQ ID NO: 410043 - DNA, 3142 bp, Homo sapiens
aacggctgcggcttcgggcggccgggtttctccggtctcccaacgccgaggagagcttgtaacaggcgctggagctggcccgccaccgccgcgtcagggacggcgctggagtcctccgttcccctcagcctctgagctgaggccccacaccagagtagggggcggcgcggcacccgtgccccggcatggcgacaccggacgcggggctccctggggctgagggcgtggagccggcgccctgggcgcagctggaggcccccgcccgcctcctgctgcaggcgctgcaggcggggcctgagggggcgcggcgcggcctgggggtgctccgggcgctgggcagccgcggctgggagcccttcgactggggtcgcttgctcgaggccctgtgccgggaggagccggtcgtgcaggggcctgacggccgtctggagctgtaagtcctcgcccgcggccccttagcaggtatgggaggcggggggctgtcgggggaacgacacacacagaggtgaaataagccccttcagcgacggcctgccgcgcaccctatgagcaggggcacccttcactgagcacttgctgtgtgcgggacatcgaggatccgggaactcgaggcacacgccttctgttcgctgtaaggaaaccactgttgctgcgattgccccggatatgccagaggaacctgatgtccctgctgatggccgttcggccatcgctgccggaaagtgggctcctctctgtgctgcagattgcccagcaggacctagcccctgaccccgatgcctggctccgtgccctgggggaattgctgcgaagggatttgggggtggggacctccatggagggagcttctccactgtctgaaagatgccagagacagctccaaagtctatgtagggggctgggcctggggggcaggaggttgaaatccccccaggctccagaccctgaagaagaggagaacagggactcccagcagcctgggaaacgcagaaaggactcagaggaagaggctgccagtcctgaggggaagagggtccccaaaagattacggtgttgggaagaggaagaagatcatgagaaggagagacccgaacataagtcactggaatccctggcagatggaggaagtgcatctcctattaaggaccagcctgtcatggcagttaagactggcgaggacggttcgaatctggatgatgctaaaggtctggctgagagtttggagttgcccaaagctatccaggaccagcttcccaggctgcagcagctgctgaagaccttggaggaggggttagagggattggaggatgcccccccagttgagctacagcttcttcacgaatgtagtcccagccagatggacttgctgtgtgcccagctgcagctccctcagctctcagacctcggtctcctgcggctctgcacctggctgctggccctttcacctgatctcagcctcagcaatgctactgtgctgaccagaagcctctttcttggacggatcctctccttgacttcctcagcctcccgcctgcttacaactgccctgacctccttctgtgccaaatatacataccctgtctgcagcgccctccttgaccctgtgctccaggccccaggcacaggtcctgctcaaacagagttactgtgttgccttgtgaagatggagtccctggagccagatgcacaggttctaatgctgggacagatcttggagctgccctggaaggaggaaactttcttggtgttgcagtcactcctagagcggcaggtggagatgacccctgagaagttcagtgtcttaatggagaagctctgtaaaaaggggctggcagccaccacctccatggcctatgccaagctcatgctgacagtgatgaccaagtatcaggctaacatcactgagacccagaggctgggcctggctatggccctagaacctaacaccaccttcctgaggaagtccctgaaggccgccttgaaacatttgggcccctgaccatccaccaagggaccaccctcttggtgctccatcaccagcttcctgaagggcatttctttcttcaccaccttgtcttgagccctagcctgaggataaaggctgagcctggccatcccagattgcaactgcctccctgttacaggctgcatagggaatattggcttcccagccagcagggaggctcctgggctaagggagctcagctatattttctttttcatttcttttgtttttgagagaaggtattgctctgtcatccaggctggagtgcagtgatgcgattgatcatggctcactgtaacctctgcctcccaggctcgatcctcccatgtcagcctcccaagtagctgggactacatgcacatgacactatgcccagctaattttttattttgtagataatatgctggtcagggctggtcttgaactcctgagctcaagtgatcttcctgccttggcacccaaagtgttgagatttacaggtgtgagccaccacaccaggccagagctatatttccaaaggctgctggccccaggcacactcctcatcaattctcaggctgcagggacaaactttccgatagggctcagtaggatcaagccgacccagagtgggcatgggatgctccaggaggtctggggtaccagtgggctcagatgaagctcttgtgctcatgtatattatgaccttctgtgtttttgtttctgacttgaataatttatcaatggtgttgaataaaagcaagttcaataatgaaaaaaaaaaaaaaaaaaaaaaaaaaaaaaaaaaaacacaacaaaacaaaaaaaaaaaaaaaaaacaaaaaaaaaaaaaaaaaaaaaaaaaaacacaacaaacaaagaaaaaaaaaaagaagaggagaggaaaaaaggagaagaagccgagagagacggagagcagccaagacagagcaaaagagaggaacggaaggacgaagaagagagggaagagaggagagggggagggagcagaggagacggcgcgggcgcgacagagaggaggaaagagggcagaaaggaggagggcaagaagaggaagaaaaagaagaaaaggaggagaggcacagaaggacgagcggcagaagaagagaaggcgaggagagggagacaaaggacaac

SEQ ID NO: 410044 - DNA, 2870 bp, Homo sapiens
aacggctgcggcttcgggcggccgggtttctccggtctcccaacgccgaggagagcttgtaacaggcgctggagctggcccgccaccgccgcgtcagggacggcgctggagtcctccgttcccctcagcctctgagctgaggccccacaccagagtagggggcggcgcggcacccgtgccccggcatggcgacaccggacgcggggctccctggggctgagggcgtggagccggcgccctgggcgcagctggaggcccccgcccgcctcctgctgcaggcgctgcaggcggggcctgagggggcgcggcgcggcctgggggtgctccgggcgctgggcagccgcggctgggagcccttcgactggggtcgcttgctcgaggccctgtgccgggaggagccggtcgtgcaggggcctgacggccgtctggagctgaaaccactgttgctgcgattgccccggatatgccagaggaacctgatgtccctgctgatggccgttcggccatcgctgccggaaagtgggctcctctctgtgctgcagattgcccagcaggacctagcccctgaccccgatgcctggctccgtgccctgggggaattgctgcgaagggatttgggggtggggacctccatggagggagcttctccactgtctgaaagatgccagagacagctccaaagtctatgtagggggctgggcctggggggcaggaggttgaaatccccccaggctccagaccctgaagaagaggagaacagggactcccagcagcctgggaaacgcagaaaggactcagaggaagaggctgccagtcctgaggggaagagggtccccaaaagattacggtgttgggaagaggaagaagatcatgagaaggagagacccgaacataagtcactggaatccctggcagatggaggaagtgcatctcctattaaggaccagcctgtcatggcagttaagactggcgaggacggttcgaatctggatgatgctaaaggtctggctgagagtttggagttgcccaaagctatccaggaccagcttcccaggctgcagcagctgctgaagaccttggaggagatggacttgctgtgtgcccagctgcagctccctcagctctcagacctcggtctcctgcggctctgcacctggctgctggccctttcacctgatctcagcctcagcaatgctactgtgctgaccagaagcctctttcttggacggatcctctccttgacttcctcagcctcccgcctgcttacaactgccctgacctccttctgtgccaaatatacataccctgtctgcagcgccctccttgaccctgtgctccaggccccaggcacaggtcctgctcaaacagagttactgtgttgccttgtgaagatggagtccctggagccagatgcacaggttctaatgctgggacagatcttggagctgccctggaaggaggaaactttcttggtgttgcagtcactcctagagcggcaggtggagatgacccctgagaagttcagtgtcttaatggagaagctctgtaaaaaggggctggcagccaccacctccatggcctatgccaagctcatgctgacagtgatgaccaagtatcaggctaacatcactgagacccagaggctgggcctggctatggccctagaacctaacaccaccttcctgaggaagtccctgaaggccgccttgaaacatttgggcccctgaccatccaccaagggaccaccctcttggtgctccatcaccagcttcctgaagggcatttctttcttcaccaccttgtcttgagccctagcctgaggataaaggctgagcctggccatcccagattgcaactgcctccctgttacaggctgcatagggaatattggcttcccagccagcagggaggctcctgggctaagggagctcagctatattttctttttcatttcttttgtttttgagagaaggtattgctctgtcatccaggctggagtgcagtgatgcgattgatcatggctcactgtaacctctgcctcccaggctcgatcctcccatgtcagcctcccaagtagctgggactacatgcacatgacactatgcccagctaattttttattttgtagataatatgctggtcagggctggtcttgaactcctgagctcaagtgatcttcctgccttggcacccaaagtgttgagatttacaggtgtgagccaccacaccaggccagagctatatttccaaaggctgctggccccaggcacactcctcatcaattctcaggctgcagggacaaactttccgatagggctcagtaggatcaagccgacccagagtgggcatgggatgctccaggaggtctggggtaccagtgggctcagatgaagctcttgtgctcatgtatattatgaccttctgtgtttttgtttctgacttgaataatttatcaatggtgttgaataaaagcaagttcaataatgaaaaaaaaaaaaaaaaaaaaaaaaaaaaaaaaaaaacacaacaaaacaaaaaaaaaaaaaaaaaacaaaaaaaaaaaaaaaaaaaaaaaaaaacacaacaaacaaagaaaaaaaaaaagaagaggagaggaaaaaaggagaagaagccgagagagacggagagcagccaagacagagcaaaagagaggaacggaaggacgaagaagagagggaagagaggagagggggagggagcagaggagacggcgcgggcgcgacagagaggaggaaagagggcagaaaggaggagggcaagaagaggaagaaaaagaagaaaaggaggagaggcacagaaggacgagcggcagaagaagagaaggcgaggagagggagacaaaggacaac

SEQ ID NO: 410045 - DNA, 2013 bp, Homo sapiens
tgtgggaaatgtgggaggggattttgttgttttctctctcagcgataggggtcaccctgtgtagtatcttttagcccttggttccttcccctagggcagctctcccagactttctttgccctggagtatctttgccctgctctgtctgctgtccagttgcttgagacagcctagcagaggcagagtgcatgtcccggtgtcctctctccccccgcactctgtaagcagatggacttgctgtgtgcccagctgcagctccctcagctctcagacctcggtctcctgcggctctgcacctggctgctggccctttcacctgatctcagcctcagcaatgctactgtgctgaccagaagcctctttcttggacggatcctctccttgacttcctcagcctcccgcctgcttacaactgccctgacctccttctgtgccaaatatacataccctgtctgcagcgccctccttgaccctgtgctccaggccccaggcacaggtcctgctcaaacagagttactgtgttgccttgtgaagatggagtccctggagccagatgcacaggttctaatgctgggacagatcttggagctgccctggaaggaggaaactttcttggtgttgcagtcactcctagagcggcaggtggagatgacccctgagaagttcagtgtcttaatggagaagctctgtaaaaaggggctggcagccaccacctccatggcctatgccaagctcatgctgacagtgatgaccaagtatcaggctaacatcactgagacccagaggctgggcctggctatggccctagaacctaacaccaccttcctgaggaagtccctgaaggccgccttgaaacatttgggcccctgaccatccaccaagggaccaccctcttggtgctccatcaccagcttcctgaagggcatttctttcttcaccaccttgtcttgagccctagcctgaggataaaggctgagcctggccatcccagattgcaactgcctccctgttacaggctgcatagggaatattggcttcccagccagcagggaggctcctgggctaagggagctcagctatattttctttttcatttcttttgtttttgagagaaggtattgctctgtcatccaggctggagtgcagtgatgcgattgatcatggctcactgtaacctctgcctcccaggctcgatcctcccatgtcagcctcccaagtagctgggactacatgcacatgacactatgcccagctaattttttattttgtagataatatgctggtcagggctggtcttgaactcctgagctcaagtgatcttcctgccttggcacccaaagtgttgagatttacaggtgtgagccaccacaccaggccagagctatatttccaaaggctgctggccccaggcacactcctcatcaattctcaggctgcagggacaaactttccgatagggctcagtaggatcaagccgacccagagtgggcatgggatgctccaggaggtctggggtaccagtgggctcagatgaagctcttgtgctcatgtatattatgaccttctgtgtttttgtttctgacttgaataatttatcaatggtgttgaataaaagcaagttcaataatgaaaaaaaaaaaaaaaaaaaaaaaaaaaaaaaaaaaacacaacaaaacaaaaaaaaaaaaaaaaaacaaaaaaaaaaaaaaaaaaaaaaaaaaacacaacaaacaaagaaaaaaaaaaagaagaggagaggaaaaaaggagaagaagccgagagagacggagagcagccaagacagagcaaaagagaggaacggaaggacgaagaagagagggaagagaggagagggggagggagcagaggagacggcgcgggcgcgacagagaggaggaaagagggcagaaaggaggagggcaagaagaggaagaaaaagaagaaaaggaggagaggcacagaaggacgagcggcagaagaagagaaggcgaggagagggagacaaaggacaac

SEQ ID NO: 410046 - DNA, 1640 bp, Homo sapiens
caaaaggaaggtagctgtcacagtagagtgtctgtgaacctcagttttctcctctgtaaaatgggagggtcttgaggattatatacagcaatgcatatatatgatgtatatgtatgtttgtatatggattgatgcatataaagtgctgccacatagtaaacacacaatgattgtcaactgttactaatgtggccggcttagtaaattgtgcagctagtatttggcaccaggtctacctcgttaaccatggtgaaataatgagattagattgctcaggagtctcctcctctttccatcctcctggcctcctctctcctcaatagagcccctggggtagtcgggagacgggagggatcagttgctggagtcctgacatgatttttccttctccccagatcactgagacccagaggctgggcctggctatggccctagaacctaacaccaccttcctgaggaagtccctgaaggccgccttgaaacatttgggcccctgaccatccaccaagggaccaccctcttggtgctccatcaccagcttcctgaagggcatttctttcttcaccaccttgtcttgagccctagcctgaggataaaggctgagcctggccatcccagattgcaactgcctccctgttacaggctgcatagggaatattggcttcccagccagcagggaggctcctgggctaagggagctcagctatattttctttttcatttcttttgtttttgagagaaggtattgctctgtcatccaggctggagtgcagtgatgcgattgatcatggctcactgtaacctctgcctcccaggctcgatcctcccatgtcagcctcccaagtagctgggactacatgcacatgacactatgcccagctaattttttattttgtagataatatgctggtcagggctggtcttgaactcctgagctcaagtgatcttcctgccttggcacccaaagtgttgagatttacaggtgtgagccaccacaccaggccagagctatatttccaaaggctgctggccccaggcacactcctcatcaattctcaggctgcagggacaaactttccgatagggctcagtaggatcaagccgacccagagtgggcatgggatgctccaggaggtctggggtaccagtgggctcagatgaagctcttgtgctcatgtatattatgaccttctgtgtttttgtttctgacttgaataatttatcaatggtgttgaataaaagcaagttcaataatgaaaaaaaaaaaaaaaaaaaaaaaaaaaaaaaaaaaacacaacaaaacaaaaaaaaaaaaaaaaaacaaaaaaaaaaaaaaaaaaaaaaaaaaacacaacaaacaaagaaaaaaaaaaagaagaggagaggaaaaaaggagaagaagccgagagagacggagagcagccaagacagagcaaaagagaggaacggaaggacgaagaagagagggaagagaggagagggggagggagcagaggagacggcgcgggcgcgacagagaggaggaaagagggcagaaaggaggagggcaagaagaggaagaaaaagaagaaaaggaggagaggcacagaaggacgagcggcagaagaagagaaggcgaggagagggagacaaaggacaac

SEQ ID NO: 410047 - DNA, 1994 bp, Homo sapiens
  misc_feature (905)..(905): n is a, c, g, or t
gtgttaggtgcttttgcccaactttagactaatttaagtgttctgatcacatttaaggtaggctaggctaagctatgacgtttagtagtagatattttcaactcatgatgggtttgtcaggatgtaaccccatcataagtcaaagagcatctgtaaagacaaagtactttagaaaaaaatacagtgataggatgacaagatcagaaaagagattaagcataggtaggtttgctgtagtgctgttgaaatctaaccttctaaaaacggtctgccaaacctgcatctgctcctccttgtaaaagaagtgaaaggtaatataatattatcaagaatataaaattaaacagacgggaactcttgtaactcagtacacaaaatttctaaaacatggccttaaaggctaagcatgtctgtatttttcctttctgtcttgacagaaaaaatctaacctttctataggtcagactaagcaagttctattaattagcccaaacttcaataggacagattatctgagaatgttcttacttgtagggcactttaattgaaataagactaattctgactcctgattttacgggtgagaaagttgagatccaacaaaattaattaccataaagaacaaaaatctgattgccatttttgttcctttttcaatatacttagtagcccttcctcaaagaaagttttagcacaaaatgtattctcttacttggaattacttctgctgtttgtttctgtatgtaatctgaataaatataatgttaacactggaaaagttcctagaaattagctgttcttcatcttttttggatcaaagatcattttgagaattggataaaatgtgtttgctatgccctgtccatagactactgacttagatatgtaataatttctgacatagntggaaaaacccaagaccaggagatggtaattgtttgaagattcaaaagcaggtcaatgttagaagaaattagaatggtctactcatgcattacccataatagttaagttcttcatattataataatgagatagttttctttcctgtttgccttcccctcctctacactttacaatactagtatcagttttctgagttaatctgcatgttctctgctatatggagacttcttcagtgtatcctcatcatagttagaacttgatttttactcttatttacacatttagttttgccttaatgactgcattgttttccattttatgaaagtcccatttgtttaacctgtctccaatatagaagcttaaatttaaaatatatatgtatgttacattcagtactatggtaaacattctggtacataactgttctgcaagtatatgtgccagaaattcctagaaataaaattgctgggtgaaagaggaagcacaaaaaaaaatttctatgaattactgtttgccttccaaaaagattgaaccaatttgtacctaaccagcaaaacatacagttcatgtttctgtgtaacctcgccatttttaacccttcttttgtgatctttgcaagtctggtaactggaggtatcttacttttatttaatctgtatgtcattaagtattagtgcaattgagctcaatattgttaagatgtcagtttgccccagtgtgacatatatattcagtgtaatcatgatcaaaatcccagcatattttttgtagatattgacaagctaattctaaaacttatgtggaaaggcaagtgaactagaagagcccccaaaatttgaaatggaaaaagaggaacaaagttgagaattcacactacccaattttaatataaggctacataagtcaagccagtggggtcctggccaaaggataaacatataattcagtgagacagaatagagagctcagaaatagacccacacaaatattatcaactgactgttggcagaagctaaaaagaaattccacaggaaaagggtagttttttcaataaatggtactggaacaatgaacagctttatgcaaaa

SEQ ID NO: 410048 - DNA, 214 bp, Homo sapiens
ggttacacaaatttatacgcaccttcaaactcagaactggataccaaaagcaaagcaaacactgtgaacatgtatcatatggtggttgcatgggggtatatatatatttgtccagattaactaagcatttaaaattgatgaatttactaatctgggcaacatagtgagaacctgactctacaaaaaattaagaagaaaaaaaaaataccaggcg

SEQ ID NO: 410049 - DNA, 386 bp, Homo sapiens
gagctcggtacccgactgcaaccaacgccgctgactgcatccaacgccgctgactgcatccaacgccgcctgactgcatccaacgccgcctgactgcatccaacgccgcctgactgcatcccacgccgcctgactgcatcccacgccgctgtgctttggctttagaaagggatggatgagaagacagacctgagaccaatctgggtagaagcaaaaagttgaaccttttaaagtgctgaacacaaatccaaattcgaatggttcaagcagccgtgaaatcgctcttcataaagtgggcttaattctctagtttaagttcttttgatggaatgaattaattaatgtctccgcggctgttgatgcagtcgggatcctctacgatctca

SEQ ID NO: 410050 - DNA, 2099 bp, Homo sapiens
tactccagcaccattggccgatcaatatttaatgcttggagattctgactctgcgggagtcatgtcaggggaccttgggagccaatctgcttgagcttctgagtgataattattcatgggctcctgcctcttgctctttctctagcacggtcccactctgcagactcagtgccttattcagtcttctctctcgctctctccgctgctgtagccggaccctttgccttcgccactgctcagcgtctgcacatccctacaatggctaaaacagcaatggcctacaaggaaaaaatgaaggagctgtccatgctgtcactgatctgctcttgcttttacccggaacctcgcaacatcaacatctatacttacgatgatatggaagtgaagcaaatcaacaaacgtgcctctggccaggcttttgagctgatcttgaagccaccatctcctatctcagaagccccacgaactttagcttctccaaagaagaaagacctgtccctggaggagatccagaagaaactggaggctgcagaggaaagaagaaagtctcaggaggcccaggtgctgaaacaattggcagagaagagggaacacgagcgagaagtccttcagaaggctttggaggagaacaacaacttcagcaagatggcggaggaaaagctgatcctgaaaatggaacaaattaaggaaaaccgtgaggctaatctagctgctattattgaacgtctgcaggaaaaggagaggcatgctgcggaggtgcgcaggaacaaggaactccaggttgaactgtctggctgaagcaagggagggtctggcacgccccaccaatagtaaatccccctgcctatattataatggatcatgcgatatcaggatggggaatgtatgacatggtttaaaaagaactcattataaaaaaaaaaaaacaaaaaaaatcaaaaattaaaaaaaatcaatgcggtctctttgcagaatgttttgcttgatgtttaaaaaataccttggatcttattttgtaaatacttacatttttgttaaaaaatacaagtattgcattatgcaagttatttcataatcttacatgtcctgtaacaggcttttgatgttgtgtctttccactcaaatgaatttgctaggtctgttctttttgaagctccccatgtctaactccattccaaaagaaaaatgaggtcagtagacagtctatggtgctagaaacccaccattgcctaatgacctagaaggctttgttgtctctgagcttgactaagaccatacctagatcacaggtattatgactccacatgaaccttcacatttgttcgctcataatctacttactgcctaaaaactacaaaaccaggctaagaaataccaccagtcatagcatttacttctgcttctcctggattatgtgctacaaatgtgctttggctttagaaagggatggatgagaagacagacctgagaccaatctgggtagaagcaaaaagttgaaccttttaaagtgctgaacacaaatccaaattcgaatggttcaagcagccgtgaaatcgctcttcataaagtgggcttaattctctagtttaagttcttttgatggaatgaattaattaatgtgtcaggtggcttatttgtggatgccatgattgatgatgttcattttaagctcttacctatagtacaagtacatgatgctactgaatatttttccacttggaaactgtgagctggttgttgcattaaaacacacatacaaacaaaatcaaaaacactgcggactttcactcaagctggtctttcttccccagtgtaaggcaatcctgcctactaacaacaccaacaacaaaacactccatctgtgaagctgacgcagttaagggggctaggcagggcatttgtgccaactaagaatcaccagatacccaccataagtacctatcgcagttttgaagtcgtttctccccaactcccaactcctgaaggttgctgcctgcatatttactcttcattagtgctattttcctgtatgtcattgtgagcaagctgtgattaataaagaattggagttctgtgaactaataaaggtttggtctgtt

SEQ ID NO: 410051 - DNA, 2045 bp, Homo sapiens
tactccagcaccattggccgatcaatatttaatgcttggagattctgactctgcgggagtcatgtcaggggaccttgggagccaatctgcttgagcttctgagtgataattattcatgggctcctgcctcttgctctttctctagcacggtcccactctgcagactcagtgccttattcagtcttctctctcgctctctccgctgctgtagccggaccctttgccttcgccactgctcagcgtctgcacatccctacaatggctaaaacagcaatggcctacaaggaaaaaatgaaggagctgtccatgctgtcactgatctgctcttgcttttacccggaacctcgcaacatcaacatctatacttacgatgatatggaagtgaagcaaatcaacaaacgtgcctctggccaggcttttgagctgatcttgaagccaccatctcctatctcagaagccccacgaactttagcttctccaaagaagaaagacctgtccctggaggagatccagaagaaactggaggctgcagaggaaagaagaaagtctcaggaggcccaggtgctgaaacaattggcagagaagagggaacacgagcgagaagtccttcagaaggctttggaggagaacaacaacttcagcaagatggcggaggaaaagctgatcctgaaaatggaacaaattaaggaaaaccgtgaggctaatctagctgctattattgaacgtctgcaggaaaaggagaggcatgctgcggaggtgcgcaggaacaaggaactccaggttgaactgtctggctgaagcaagggagggtctggcacgccccaccaatagtaaatccccctgcctatattataatggatcatgcgatatcaggatggggaatgtatgacatggtttaaaaagaactcattataaaaaaaaaaaaacaaaaaaaatcaaaaattaaaaaaaatcaatgcggtctctttgcagaatgttttgcttgatgtttaaaaaataccttggatcttattttgtaaatacttacatttttgttaaaaaatacaagtattgcattatgcaagttatttcataatcttacatgtcctgtaacaggcttttgatgttgtgtctttccactcaaatgaatttgctaggtctgttctttttgaagctccccatgtctaactccattccaaaagaaaaatgaggtcagtagacagtctatggtgctagaaacccaccattgcctaatgacctagaaggctttgttgtctctgagcttgactaagaccatacctagatcacaggtattatgactccacatgaaccttcacatttgttcgctcataatctacttactgcctaaaaactacaaaaccaggctaagaaataccaccagtcatagcatttacttctgcttctcctggattatgtgctacaaatgtgctttggctttagaaagggatggatgagaagacagacctgagaccaatctgggtagaagcacagccgtgaaatcgctcttcataaagtgggcttaattctctagtttaagttcttttgatggaatgaattaattaatgtgtcaggtggcttatttgtggatgccatgattgatgatgttcattttaagctcttacctatagtacaagtacatgatgctactgaatatttttccacttggaaactgtgagctggttgttgcattaaaacacacatacaaacaaaatcaaaaacactgcggactttcactcaagctggtctttcttccccagtgtaaggcaatcctgcctactaacaacaccaacaacaaaacactccatctgtgaagctgacgcagttaagggggctaggcagggcatttgtgccaactaagaatcaccagatacccaccataagtacctatcgcagttttgaagtcgtttctccccaactcccaactcctgaaggttgctgcctgcatatttactcttcattagtgctattttcctgtatgtcattgtgagcaagctgtgattaataaagaattggagttctgtgaactaataaaggtttggtctgtt

SEQ ID NO: 410052 - DNA, 2024 bp, Homo sapiens
  misc_feature (2004)..(2004): n is a, c, g, or t
tactccagcaccattggccgatcaatatttaatgcttggagattctgactctgcgggagtcatgtcaggggaccttgggagccaatctgcttgagcttctgagtgataattattcatgggctcctgcctcttgctctttctctagcacggtcccactctgcagactcagtgccttattcagtcttctctctcgctctctccgctgctgtagccggaccctttgccttcgccactgctcagcgtctgcacatccctacaatggctaaaacagcaatggcctacaaggaaaaaatgaaggagctgtccatgctgtcactgatctgctcttgcttttacccggaacctcgcaacatcaacatctatacttacgatgatatggaagtgaagcaaatcaacaaacgtgcctctggccaggcttttgagctgatcttgaagccaccatctcctatctcagaagccccacgaactttagcttctccaaagaagaaagacctgtccctggaggagatccagaagaaactggaggctgcagaggaaagaagaaagtctcaggaggcccaggtgctgaaacaattggcagagaagagggaacacgagcgagaagtccttcagaaggctttggaggagaacaacaacttcagcaagatggcggaggaaaagctgatcctgaaaatggaacaaattaaggaaaaccgtgaggctaatctagctgctattattgaacgtctgcaggaaaaggagaggcatgctgcggaggtgcgcaggaacaaggaactccaggttgaactgtctggctgaagcaagggagggtctggcacgccccaccaatagtaaatccccctgcctatattataatggatcatgcgatatcaggatggggaatgtatgacatggtttaaaaagaactcattataaaaaaaaaaaaacaaaaaaaatcaaaaattaaaaaaaatcaatgcggtctctttgcagaatgttttgcttgatgtttaaaaaataccttggatcttattttgtaaatacttacatttttgttaaaaaatacaagtattgcattatgcaagttatttcataatcttacatgtcctgtaacaggcttttgatgttgtgtctttccactcaaatgaatttgctaggtctgttctttttgaagctccccatgtctaactccattccaaaagaaaaatgaggtcagtagacagtctatggtgctagaaacccaccattgcctaatgacctagaaggctttgttgtctctgagcttgactaagaccatacctagatcacaggtattatgactccacatgaaccttcacatttgttcgctcataatctacttactgcctaaaaactacaaaaccaggctaagaaataccaccagtcatagcatttacttctgcttctcctggattatgtgctacaaatgtgctttggctttagaaagggatggatgagaagacagacctgagaccaatctgggtagaagcaaaaagttgaaccttttaaagtgctgaacacaaatccaaattcgaatggttcaagcagccgtgaaatcgctcttcataaagtgggcttaattctctagtttaagttcttttgatggaatgaattaattaatgtgtcaggtggcttatttgtggatgccatgattgatgatgttcattttaagctcttacctatagtacaagtacatgatgctactgaatatttttccacttggaaactgtgagctggttgttgcattaaaacacacatacaaacaaaatcaaaaacactgcggactttcactcaagctggtctttcttccccagtgtaaggcaatcctgcctactaacaacaccaacaacaaaacactccatctgtgaagctgacgcagttaagggggctaggcagggcatttgtgccaactaagaatcaccagatacccaccataagtacctatcgcagttttgaagtcgtttctccccaactcccaactcctgaaggttgctgcctgcatattcncccccccccacccccccccc

SEQ ID NO: 410053 - DNA, 1786 bp, Homo sapiens
tactccagcaccattggccgatcaatatttaatgcttggagattctgactctgcgggagtcatgtcaggggaccttgggagccaatctgcttgagcttctgagtgataattattcatgggctcctgcctcttgctctttctctagcacggtcccactctgcagactcagtgccttattcagtcttctctctcgctctctccgctgctgtagccggaccctttgccttcgccactgctcagcgtctgcacatccctacaatggctaaaacagcaatggcctacaaggaaaaaatgaaggagctgtccatgctgtcactgatctgctcttgcttttacccggaacctcgcaacatcaacatctatacttacgatgatatggaagtgaagcaaatcaacaaacgtgcctctggccaggcttttgagctgatcttgaagccaccatctcctatctcagaagccccacgaactttagcttctccaaagaagaaagacctgtccctggaggagatccagaagaaactggaggctgcagaggaaagaagaaagtctcaggaggcccaggtgctgaaacaattggcagagaagagggaacacgagcgagaagtccttcagaaggctttggaggagaacaacaacttcagcaagatggcggaggaaaagctgatcctgaaaatggaacaaattaaggaaaaccgtgaggctaatctagctgctattattgaacgtctgcaggaaaaggagaggcatgctgcggaggtgcgcaggaacaaggaactccaggttgaactgtctggctgaagcaagggagggtctggcacgccccaccaatagtaaatccccctgcctatattataatggatcatgcgatatcaggatggggaatgtatgacatggtttaaaaagaactcattataaaaaaaaaaaaacaaaaaaaatcaaaaattaaaaaaaatcaatgcggtctctttgcagaatgttttgcttgatgtttaaaaaataccttggatcttattttgtaaatacttacatttttgttaaaaaatacaagtattgcattatgcaagttatttcataatcttacatgtcctgtaacaggcttttgatgttgtgtctttccactcaaatgaatttgctaggtctgttctttttgaagctccccatgtctaactccattccaaaagaaaaatgaggtcagtagacagtctatggtgctagaaacccaccattgcctaatgacctagaaggctttgttgtctctgagcttgactaagaccatacctagatcacaggtattatgactccacatgaaccttcacatttgttcgctcataatctacttactgcctaaaaactacaaaaccaggctaagaaataccaccagtcatagcatttacttctgcttctcctggattatgtgctacaaatgtgctttggctttagaaagggatggatgagaagacagacctgagaccaatctgggtagaagcaaaaagttgaaccttttaaagtgctgaacacaaatccaaattcgaatggttcaagcagccgtgaaatcgctcttcataaagtgggcttaattctctagtttaagttcttttgatggaatgaattaattaatgtgtcaggtggcttatttgtggatgccatgattgatgatgttcattttaagctcttacctatagtacaagtacatgatgctactgaatatttttccacttggaaactgtgacaagctgtgattaataaagaattggagttctgtgaactaataaaggtttggtctgtt

SEQ ID NO: 410054 - DNA, 1768 bp, Homo sapiens
gattgcatcagggtgaacctactatatgtgacgagtgagactgggagtgagtcacacggagcaatcggtgctactgaggctcggacatttcgtaaactcgagcgttgatagctgttatctcagaagccccacgaactttagcttctccaaagaagaaagacctgtccctggaggagatccagaagaaactggaggctgcagaggaaagaagaaagtctcaggaggcccaggtgctgaaacaattggcagagaagagggaacacgagcgagaagtccttcagaaggctttggaggagaacaacaacttcagcaagatggcggaggaaaagctgatcctgaaaatggaacaaattaaggaaaaccgtgaggctaatctagctgctattattgaacgtctgcaggaaaaggagaggcatgctgcggaggtgcgcaggaacaaggaactccaggttgaactgtctggctgaagcaagggagggtctggcacgccccaccaatagtaaatccccctgcctatattataatggatcatgcgatatcaggatggggaatgtatgacatggtttaaaaagaactcattataaaaaaaaaaaaacaaaaaaaatcaaaaattaaaaaaaatcaatgcggtctctttgcagaatgttttgcttgatgtttaaaaaataccttggatcttattttgtaaatacttacatttttgttaaaaaatacaagtattgcattatgcaagttatttcataatcttacatgtcctgtaacaggcttttgatgttgtgtctttccactcaaatgaatttgctaggtctgttctttttgaagctccccatgtctaactccattccaaaagaaaaatgaggtcagtagacagtctatggtgctagaaacccaccattgcctaatgacctagaaggctttgttgtctctgagcttgactaagaccatacctagatcacaggtattatgactccacatgaaccttcacatttgttcgctcataatctacttactgcctaaaaactacaaaaccaggctaagaaataccaccagtcatagcatttacttctgcttctcctggattatgtgctacaaatgtgctttggctttagaaagggatggatgagaagacagacctgagaccaatctgggtagaagcaaaaagttgaaccttttaaagtgctgaacacaaatccaaattcgaatggttcaagcagccgtgaaatcgctcttcataaagtgggcttaattctctagtttaagttcttttgatggaatgaattaattaatgtgtcaggtggcttatttgtggatgccatgattgatgatgttcattttaagctcttacctatagtacaagtacatgatgctactgaatatttttccacttggaaactgtgagctggttgttgcattaaaacacacatacaaacaaaatcaaaaacactgcggactttcactcaagctggtctttcttccccagtgtaaggcaatcctgcctactaacaacaccaacaacaaaacactccatctgtgaagctgacgcagttaagggggctaggcagggcatttgtgccaactaagaatcaccagatacccaccataagtacctatcgcagttttgaagtcgtttctccccaactcccaactcctgaaggttgctgcctgcatatttactcttcattagtgctattttcctgtatgtcattgtgagcaagctgtgattaataaagaattggagttctgtgaactaataaaggtttggtctgtt

SEQ ID NO: 410055 - DNA, 1859 bp, Homo sapiens
tactccagcaccattggccgatcaatatttaatgcttggagattctgactctgcgggagtcatgtcaggggaccttgggagccaatctgcttgagcttctgagtgataattattcatgggctcctgcctcttgctctttctctagcacggtcccactctgcagactcagtgccttattcagtcttctctctcgctctctccgctgctgtagccggaccctttgccttcgccactgctcagcgtctgcacatccctacaatggctaaaacagcaatggcctacaaggaaaaaatgaaggagctgtccatgctgtcactgatctgctcttgcttttacccggaacctcgcaacatcaacatctatacttacgatgaggctttggaggagaacaacaacttcagcaagatggcggaggaaaagctgatcctgaaaatggaacaaattaaggaaaaccgtgaggctaatctagctgctattattgaacgtctgcaggaaaaggagaggcatgctgcggaggtgcgcaggaacaaggaactccaggttgaactgtctggctgaagcaagggagggtctggcacgccccaccaatagtaaatccccctgcctatattataatggatcatgcgatatcaggatggggaatgtatgacatggtttaaaaagaactcattataaaaaaaaaaaaacaaaaaaaatcaaaaattaaaaaaaatcaatgcggtctctttgcagaatgttttgcttgatgtttaaaaaataccttggatcttattttgtaaatacttacatttttgttaaaaaatacaagtattgcattatgcaagttatttcataatcttacatgtcctgtaacaggcttttgatgttgtgtctttccactcaaatgaatttgctaggtctgttctttttgaagctccccatgtctaactccattccaaaagaaaaatgaggtcagtagacagtctatggtgctagaaacccaccattgcctaatgacctagaaggctttgttgtctctgagcttgactaagaccatacctagatcacaggtattatgactccacatgaaccttcacatttgttcgctcataatctacttactgcctaaaaactacaaaaccaggctaagaaataccaccagtcatagcatttacttctgcttctcctggattatgtgctacaaatgtgctttggctttagaaagggatggatgagaagacagacctgagaccaatctgggtagaagcaaaaagttgaaccttttaaagtgctgaacacaaatccaaattcgaatggttcaagcagccgtgaaatcgctcttcataaagtgggcttaattctctagtttaagttcttttgatggaatgaattaattaatgtgtcaggtggcttatttgtggatgccatgattgatgatgttcattttaagctcttacctatagtacaagtacatgatgctactgaatatttttccacttggaaactgtgagctggttgttgcattaaaacacacatacaaacaaaatcaaaaacactgcggactttcactcaagctggtctttcttccccagtgtaaggcaatcctgcctactaacaacaccaacaacaaaacactccatctgtgaagctgacgcagttaagggggctaggcagggcatttgtgccaactaagaatcaccagatacccaccataagtacctatcgcagttttgaagtcgtttctccccaactcccaactcctgaaggttgctgcctgcatatttactcttcattagtgctattttcctgtatgtcattgtgagcaagctgtgattaataaagaattggagttctgtgaactaataaaggtttggtctgtt

SEQ ID NO: 410056 - DNA, 1932 bp, Homo sapiens
tactccagcaccattggccgatcaatatttaatgcttggagattctgactctgcgggagtcatgtcaggggaccttgggagccaatctgcttgagcttctgagtgataattattcatgggctcctgcctcttgctctttctctagcacggtcccactctgcagactcagtgccttattcagtcttctctctcgctctctccgctgctgtagccggaccctttgccttcgccactgctcagcgtctgcacatccctacaatggctaaaacagcaatggcctacaaggaaaaaatgaaggagctgtccatgctgtcactgatctgctcttgcttttacccggaacctcgcaacatcaacatctatacttacgatgatatggaagtgaagcaaatcaacaaacgtgcctctggccaggcttttgagctgatcttgaagccaccatctccaggctttggaggagaacaacaacttcagcaagatggcggaggaaaagctgatcctgaaaatggaacaaattaaggaaaaccgtgaggctaatctagctgctattattgaacgtctgcaggaaaaggagaggcatgctgcggaggtgcgcaggaacaaggaactccaggttgaactgtctggctgaagcaagggagggtctggcacgccccaccaatagtaaatccccctgcctatattataatggatcatgcgatatcaggatggggaatgtatgacatggtttaaaaagaactcattataaaaaaaaaaaaacaaaaaaaatcaaaaattaaaaaaaatcaatgcggtctctttgcagaatgttttgcttgatgtttaaaaaataccttggatcttattttgtaaatacttacatttttgttaaaaaatacaagtattgcattatgcaagttatttcataatcttacatgtcctgtaacaggcttttgatgttgtgtctttccactcaaatgaatttgctaggtctgttctttttgaagctccccatgtctaactccattccaaaagaaaaatgaggtcagtagacagtctatggtgctagaaacccaccattgcctaatgacctagaaggctttgttgtctctgagcttgactaagaccatacctagatcacaggtattatgactccacatgaaccttcacatttgttcgctcataatctacttactgcctaaaaactacaaaaccaggctaagaaataccaccagtcatagcatttacttctgcttctcctggattatgtgctacaaatgtgctttggctttagaaagggatggatgagaagacagacctgagaccaatctgggtagaagcaaaaagttgaaccttttaaagtgctgaacacaaatccaaattcgaatggttcaagcagccgtgaaatcgctcttcataaagtgggcttaattctctagtttaagttcttttgatggaatgaattaattaatgtgtcaggtggcttatttgtggatgccatgattgatgatgttcattttaagctcttacctatagtacaagtacatgatgctactgaatatttttccacttggaaactgtgagctggttgttgcattaaaacacacatacaaacaaaatcaaaaacactgcggactttcactcaagctggtctttcttccccagtgtaaggcaatcctgcctactaacaacaccaacaacaaaacactccatctgtgaagctgacgcagttaagggggctaggcagggcatttgtgccaactaagaatcaccagatacccaccataagtacctatcgcagttttgaagtcgtttctccccaactcccaactcctgaaggttgctgcctgcatatttactcttcattagtgctattttcctgtatgtcattgtgagcaagctgtgattaataaagaattggagttctgtgaactaataaaggtttggtctgtt

SEQ ID NO: 410057 - DNA, 1953 bp, Homo sapiens
  misc_feature (19)..(20): n is a, c, g, or t
  misc_feature (140)..(140): n is a, c, g, or t
  misc_feature (147)..(147): n is a, c, g, or t
  misc_feature (152)..(152): n is a, c, g, or t
  misc_feature (154)..(154): n is a, c, g, or t
  misc_feature (179)..(179): n is a, c, g, or t
  misc_feature (182)..(182): n is a, c, g, or t
  misc_feature (233)..(233): n is a, c, g, or t
  misc_feature (258)..(258): n is a, c, g, or t
  misc_feature (264)..(264): n is a, c, g, or t
  misc_feature (281)..(281): n is a, c, g, or t
  misc_feature (300)..(300): n is a, c, g, or t
  misc_feature (327)..(327): n is a, c, g, or t
  misc_feature (360)..(360): n is a, c, g, or t
  misc_feature (377)..(378): n is a, c, g, or t
  misc_feature (384)..(384): n is a, c, g, or t
  misc_feature (401)..(401): n is a, c, g, or t
  misc_feature (408)..(408): n is a, c, g, or t
  misc_feature (414)..(414): n is a, c, g, or t
  misc_feature (422)..(422): n is a, c, g, or t
  misc_feature (430)..(431): n is a, c, g, or t
  misc_feature (450)..(450): n is a, c, g, or t
  misc_feature (459)..(459): n is a, c, g, or t
  misc_feature (462)..(462): n is a, c, g, or t
  misc_feature (464)..(464): n is a, c, g, or t
gctcaaggatccttaattnnttaatcccccccccctcttctctctcgctctctccgctgctgtagccggaccctttgccttcgccactgctcagcgtctgcacatccctacaatggctaaaacagcaatggaaaaaaagnaaaaaanaaagnanaagtaaatgaagaaaataaaaaganaangaataaaaaagaaaaatagaaaaaaaaaaaaaaaaaaaaaaaaaaaaaagnaaataaaaaaaaataaaaaaaagtnaataangaaaggattaaaaaaanaaaaaaaagaaaaaaaatnaaaaaaaaaaagaaaaaaaaaataaanaatataaaaaaaaaaaaaaaaagaaaatgaagnaaaaaaaaaaaaaaaannaggatnaaaaaaaaaaaaaaaanaaaaaanaggacnaggagaanaaaaaatnngaaaaaaagagggaaaaanaaaaaaaanaantnaaaaggctttggaggagaacaacaacttcagcaagatggcggaggaaaagctgatcctgaaaatggaacaaattaaggaaaaccgtgaggctaatctagctgctattattgaacgtctgcaggaaaaggagaggcatgctgcggaggtgcgcaggaacaaggaactccaggttgaactgtctggctgaagcaagggagggtctggcacgccccaccaatagtaaatccccctgcctatattataatggatcatgcgatatcaggatggggaatgtatgacatggtttaaaaagaactcattataaaaaaaaaaaaacaaaaaaaatcaaaaattaaaaaaaatcaatgcggtctctttgcagaatgttttgcttgatgtttaaaaaataccttggatcttattttgtaaatacttacatttttgttaaaaaatacaagtattgcattatgcaagttatttcataatcttacatgtcctgtaacaggcttttgatgttgtgtctttccactcaaatgaatttgctaggtctgttctttttgaagctccccatgtctaactccattccaaaagaaaaatgaggtcagtagacagtctatggtgctagaaacccaccattgcctaatgacctagaaggctttgttgtctctgagcttgactaagaccatacctagatcacaggtattatgactccacatgaaccttcacatttgttcgctcataatctacttactgcctaaaaactacaaaaccaggctaagaaataccaccagtcatagcatttacttctgcttctcctggattatgtgctacaaatgtgctttggctttagaaagggatggatgagaagacagacctgagaccaatctgggtagaagcaaaaagttgaaccttttaaagtgctgaacacaaatccaaattcgaatggttcaagcagccgtgaaatcgctcttcataaagtgggcttaattctctagtttaagttcttttgatggaatgaattaattaatgtgtcaggtggcttatttgtggatgccatgattgatgatgttcattttaagctcttacctatagtacaagtacatgatgctactgaatatttttccacttggaaactgtgagctggttgttgcattaaaacacacatacaaacaaaatcaaaaacactgcggactttcactcaagctggtctttcttccccagtgtaaggcaatcctgcctactaacaacaccaacaacaaaacactccatctgtgaagctgacgcagttaagggggctaggcagggcatttgtgccaactaagaatcaccagatacccaccataagtacctatcgcagttttgaagtcgtttctccccaactcccaactcctgaaggttgctgcctgcatatttactcttcattagtgctattttcctgtatgtcattgtgagcaagctgtgattaataaagaattggagttctgtgaactaataaaggtttggtctgtt

SEQ ID NO: 410058 - DNA, 1145 bp, Homo sapiens
  misc_feature (974)..(974): n is a, c, g, or t
tactccagcaccattggccgatcaatatttaatgcttggagattctgactctgcgggagtcatgtcaggggaccttgggagccaatctgcttgagcttctgagtgataattattcatgggctcctgcctcttgctctttctctagcacggtcccactctgcagactcagtgccttattcagtcttctctctcgctctctccgctgctgtagccggaccctttgccttcgccactgctcagcgtctgcacatccctacaatggctaaaacagcaatggcctacaaggaaaaaatgaaggagctgtccatgctgtcactgatctgctcttgcttttacccggaacctcgcaacatcaacatctatacttacgatgatatggaagtgaagcaaatcaacaaacgtgcctctggccaggcttttgagctgatcttgaagccaccatctcctatctcagaagccccacgaactttagcttctccaaagaagaaagacctgtccctggaggagatccagaagaaactggaggctgcagaggaaagaagaaagtctcaggaggcccaggtgctgaaacaattggcagagaagagggaacacgagcgagaagtccttcagaaggctttggaggagaacaacaacttcagcaagatggcggaggaaaagctgatcctgaaaatggaacaaattaaggaaaaccgtgaggctaatctagctgctattattgaacgtctgcaggaaaaggagaggcatgctgcggaggtgcgcaggaacaaggaactccaggttgaactgtctggctgaagcaagggagggtctggcacgccccaccaatagtaaatccccctgcctatattataatggatcatgcgatatcaggatggggaatgtatgacatggtttaaaaagaactggtgtccccacatagcctttcctctgtgtgttctcagagagagagcacgtaagcccagaagtgagtnagctcttgtctttttctcttcttataaggacaccagctctatcaaattaggggcccgctgttatagcctcatttaaccttaattacttctttaaagaccctatctgtaaaatggagtcacattgtggggtcagggcctcagcatatgaaattttcaagggggcaaatttca

SEQ ID NO: 410059 - DNA, 1242 bp, Homo sapiens
ttaattaattataattaattaattaattaattaattaattataattaattaattaattaattaattaattataattaattaattaattaattaattaattataattaattaattaattaattaattaattataattaattaattaattaattaattaattataattaattaattaattaattaattaattataattaattaattaattaattaattaattataattaattaattaattaattaattaattataattaattaattaattaattaattaattataattaattaattaattaattaattaattataattaattaattaattaattaattaattataattaattaattaattaattaattaattataattaattaattaattaattaattaattataattaattaattaattaattaattaattataattaattaattaattaattaattaattataattaattaattaattaattaattaattataattaattaattaattaattaattaattataattaattaattaattaattaattaattataattaattaattaattaattaattaattataattaattaattaattaattaattaattataattaattaattaattaattaattaattataattaattaattaattaattaattaattataattaattaattaattaattaattaattataattaattaattaattaattctctagtttaagttcttttgatggaatgaattaattaatgtgtcaggtggcttatttgtggatgccatgattgatgatgttcattttaagctcttacctatagtacaagtacatgatgctactgaatatttttccacttggaaactgtgagctggttgttgcattaaaacacacatacaaacaaaatcaaaaacactgcggactttcactcaagctggtctttcttccccagtgtaaggcaatcctgcctactaacaacaccaacaacaaaacactccatctgtgaagctgacgcagttaagggggctaggcagggcatttgtgccaactaagaatcaccagatacccaccataagtacctatcgcagttttgaagtcgtttctccccaactcccaactcctgaaggttgctgcctgcatatttactcttcattagtgctattttcctgtatgtcattgtgagcaagctgtgattaataaagaattggagttctgtgaactaataaaggtttggtctgtt

SEQ ID NO: 410060 - DNA, 816 bp, Homo sapiens
tactccagcaccattggccgatcaatatttaatgcttggagattctgactctgcgggagtcatgtcaggggaccttgggagccaatctgcttgagcttctgagtgataattattcatgggctcctgcctcttgctctttctctagcacggtcccactctgcagactcagtgccttattcagtcttctctctcgctctctccgctgctgtagccggaccctttgccttcgccactgctcagcgtctgcacatccctacaatggctaaaacagcaatggcctacaaggaaaaaatgaaggagctgtccatgctgtcactgatctgctcttgcttttacccggaacctcgcaacatcaacatctatacttacgatgatatggaagtgaagcaaatcaacaaacgtgcctctggccaggcttttgagctgatcttgaagccaccatctcctatctcagaagccccacgaactttagcttctccaaatcaaaaacactgcggactttcactcaagctggtctttcttccccagtgtaaggcaatcctgcctactaacaacaccaacaacaaaacactccatctgtgaagctgacgcagttaagggggctaggcagggcatttgtgccaactaagaatcaccagatacccaccataagtacctatcgcagttttgaagtcgtttctccccaactcccaactcctgaaggttgctgcctgcatatttactcttcattagtgctattttcctgtatgtcattgtgagcaagctgtgattaataaagaattggagttctgtgaactaataaaggtttggtctgtt

SEQ ID NO: 410061 - DNA, 1953 bp, Homo sapiens
  misc_feature (19)..(20): n is a, c, g, or t
gctcaaggatccttaattnnttaatcccccccccctcttctctctcgctctctccgctgctgtagccggaccctttgccttcgccactgctcagcgtctgcacatccctacaatggctaaaacagcaatggcctacaaggaaaaaatgaaggagctgtccatgctgtcactgatctgctcttgcttttacccggaacctcgcaacatcaacatctatacttacgatgatatggaagtgaagcaaatcaacaaacgtgcctctggccaggcttttgagctgatcttgaagccaccatctcctatctcagaagccccacgaactttagcttctccaaagaagaaagacctgtccctggaggagatccagaagaaactggaggctgcagaggaaagaagaaagtctcaggaggcccaggtgctgaaacaattggcagagaagagggaacacgagcgagaagtccttcagaaggctttggaggagaacaacaacttcagcaagatggcggaggaaaagctgatcctgaaaatggaacaaattaaggaaaaccgtgaggctaatctagctgctattattgaacgtctgcaggaaaaggagaggcatgctgcggaggtgcgcaggaacaaggaactccaggttgaactgtctggctgaagcaagggagggtctggcacgccccaccaatagtaaatccccctgcctatattataatggatcatgcgatatcaggatggggaatgtatgacatggtttaaaaagaactcattataaaaaaaaaaaaacaaaaaaaatcaaaaattaaaaaaaatcaatgcggtctctttgcagaatgttttgcttgatgtttaaaaaataccttggatcttattttgtaaatacttacatttttgttaaaaaatacaagtattgcattatgcaagttatttcataatcttacatgtcctgtaacaggcttttgatgttgtgtctttccactcaaatgaatttgctaggtctgttctttttgaagctccccatgtctaactccattccaaaagaaaaatgaggtcagtagacagtctatggtgctagaaacccaccattgcctaatgacctagaaggctttgttgtctctgagcttgactaagaccatacctagatcacaggtattatgactccacatgaaccttcacatttgttcgctcataatctacttactgcctaaaaactacaaaaccaggctaagaaataccaccagtcatagcatttacttctgcttctcctggattatgtgctacaaatgtgctttggctttagaaagggatggatgagaagacagacctgagaccaatctgggtagaagcaaaaagttgaaccttttaaagtgctgaacacaaatccaaattcgaatggttcaagcagccgtgaaatcgctcttcataaagtgggcttaattctctagtttaagttcttttgatggaatgaattaattaatgtgtcaggtggcttatttgtggatgccatgattgatgatgttcattttaagctcttacctatagtacaagtacatgatgctactgaatatttttccacttggaaactgtgagctggttgttgcattaaaacacacatacaaacaaaatcaaaaacactgcggactttcactcaagctggtctttcttccccagtgtaaggcaatcctgcctactaacaacaccaacaacaaaacactccatctgtgaagctgacgcagttaagggggctaggcagggcatttgtgccaactaagaatcaccagatacccaccataagtacctatcgcagttttgaagtcgtttctccccaactcccaactcctgaaggttgctgcctgcatatttactcttcattagtgctattttcctgtatgtcattgtgagcaagctgtgattaataaagaattggagttctgtgaactaataaaggtttggtctgtt

SEQ ID NO: 410062 - DNA, 2044 bp, Homo sapiens
tactccagcaccattggccgatcaatatttaatgcttggagattctgactctgcgggagtcatgtcaggggaccttgggagccaatctgcttgagcttctgagtgataattattcatgggctcctgcctcttgctctttctctagcacggtcccactctgcagactcagtgccttattcagtcttctctctcgctctctccgctgctgtagccggaccctttgccttcgccactgctcagcgtctgcacatccctacaatggctaaaacagcaatggcctacaaggaaaaaatgaaggagctgtccatgctgtcactgatctgctcttgcttttacccggaacctcgcaacatcaacatctatacttacgatgatatggaagtgaagcaaatcaacaaacgtgcctctggccaggcttttgagctgatcttgaagccaccatctcctatctcagaagccccacgaactttagcttctccaaagaagaaagacctgtccctggaggagatccagaagaaactggaggctgcagaggaaagaagaaagtctcaggaggcccaggtgctgaaacaattggcagagaagagggaacacgagcgagaagtccttcagaaggctttggaggagaacaacaacttcagcaagatggcggaggaaaagctgatcctgaaaatggaacaaattaaggaaaaccgtgaggctaatctagctgctattattgaacgtctgcaggaaaaggagaggcatgctgcggaggtgcgcaggaacaaggaactccaggttgaactgtctggctgaagcaagggagggtctggcacgccccaccaatagtaaatccccctgcctatattataatggatcatgcgatatcaggatggggaatgtatgacatggtttaaaaagaactcattataaaaaaaaaaaaacaaaaaaaatcaaaaattaaaaaaaatcaatgcggtctctttgcagaatgttttgcttgatgtttaaaaaataccttggatcttattttgtaaatacttacatttttgttaaaaaatacaagtattgcattatgcaagttatttcataatcttacatgtcctgtaacaggcttttgatgttgtgtctttccactcaaatgaatttgctaggtctgttctttttgaagctccccatgtctaactccattccaaaagaaaaatgaggtcagtagacagtctatggtgctagaaacccaccattgcctaatgacctagaaggctttgttgtctctgagcttgactaagaccatacctagatcacaggtattatgactccacatgaaccttcacatttgttcgctcataatctacttactgcctaaaaactacaaaaccaggctaagaaataccaccagtcatagcatttacttctgcttctcctggattatgtgctacaaatgtgctttggctttagaaagggatggatgagaagacagacctgagaccaatctgggtagaagcaaaaagttgaaccttttaaagtgctgaacacaaatccaaattcgaatggttcaagcagccgtgaaatcgctcttcataaagtgggcttaattctctagtttaagttcttttgatggaatgaattaattaatgtgtcaggtggcttatttgtggatgccatgattgatgatgttcattttaagctcttacctatagtacaagtacatgatgctactgaatatttttccacttggaaactgtgagctggttgttgcattaaaacacacatacaaacagcaatcctgcctactaacaacaccaacaacaaaacactccatctgtgaagctgacgcagttaagggggctaggcagggcatttgtgccaactaagaatcaccagatacccaccataagtacctatcgcagttttgaagtcgtttctccccaactcccaactcctgaaggttgctgcctgcatatttactcttcattagtgctattttcctgtatgtcattgtgagcaagctgtgattaataaagaattggagttctgtgaactaataaaggtttggtctgtt

SEQ ID NO: 410063 - DNA, 1296 bp, Homo sapiens
tactccagcaccattggccgatcaatatttaatgcttggagattctgactctgcgggagtcatgtcaggggaccttgggagccaatctgcttgagcttctgagtgataattattcatgggctcctgcctcttgctctttctctagcacggtcccactctgcagactcagtgccttattcagtcttctctctcgctctctccgctgctgtagccggaccctttgccttcgccactgctcagcgtctgcacatccctacaatggctaaaacagcaatggcctacaaggaaaaaatgaaggagctgtccatgctgtcactgatctgctcttgcttttacccggaacctcgcaacatcaacatctatacttacgatgatatggaagtgaagcaaatcaacaaacgtgcctctggccaggcttttgagctgatcttgaagccaccatctcctatctcagaagccccacgaactttagcttctccaaagaagaaagacctgtccctggaggagatccagaagaaactggaggctgcagaggaaagaagaaagtctcaggaggcccaggtgctgaaacaattggcagagaagagggaacacgagcgagaagtccttcagaaggctttggaggagaacaacaacttcagcaagatggcggaggaaaagctgatcctgaaaatggaacaaattaaggaaaaccgtgaggctaatctagctgctattattgaacgtctgcaggaaaaggagaggcatgctgcggaggtgcgcaggaacaaggaactccaggttgaactgtctggctgaagcaagggagggtctggcacgccccaccaatagtaaatccccctgcctatattataatggatcatgcgatatcaggatggggaatgtatgacatggtttaaaaagaactcattataaaaaaaaaaaaacaaaaaaaatcaaaaattaaaaaaaatcaatgcggtctctttgcagaatgttttgcttgatgtttaaaaaataccttggatcttattttgtaaatacttacatttttgttaaaaaatacaagtattgcattatgcaagttatttcataatcttacatgtcctgtaacaggcttttgatgttgtgtctttccactcaaatgaatttgctaggtctgttctttttgaatcgtttctccccaactcccaactcctgaaggttgctgcctgcatatttactcttcattagtgctattttcctgtatgtcattgtgagcaagctgtgattaataaagaattggagttctgtgaactaataaaggtttggtctgtt

SEQ ID NO: 410064 - DNA, 2050 bp, Homo sapiens
tactccagcaccattggccgatcaatatttaatgcttggagattctgactctgcgggagtcatgtcaggggaccttgggagccaatctgcttgagcttctgagtgataattattcatgggctcctgcctcttgctctttctctagcacggtcccactctgcagactcagtgccttattcagtcttctctctcgctctctccgctgctgtagccggaccctttgccttcgccactgctcagcgtctgcacatccctacaatggctaaaacagcaatggcctacaaggaaaaaatgaaggagctgtccatgctgtcactgatctgctcttgcttttacccggaacctcgcaacatcaacatctatacttacgatgatatggaagtgaagcaaatcaacaaacgtgcctctggccaggcttttgagctgatcttgaagccaccatctcctatctcagaagccccacgaactttagcttctccaaagaagaaagacctgtccctggaggagatccagaagaaactggaggctgcagaggaaagaagaaagtctcaggaggcccaggtgctgaaacaattggcagagaagagggaacacgagcgagaagtccttcagaaggctttggaggagaacaacaacttcagcaagatggcggaggaaaagctgatcctgaaaatggaacaaattaaggaaaaccgtgaggctaatctagctgctattattgaacgtctgcaggaaaagtgtctggctgaagcaagggagggtctggcacgccccaccaatagtaaatccccctgcctatattataatggatcatgcgatatcaggatggggaatgtatgacatggtttaaaaagaactcattataaaaaaaaaaaaacaaaaaaaatcaaaaattaaaaaaaatcaatgcggtctctttgcagaatgttttgcttgatgtttaaaaaataccttggatcttattttgtaaatacttacatttttgttaaaaaatacaagtattgcattatgcaagttatttcataatcttacatgtcctgtaacaggcttttgatgttgtgtctttccactcaaatgaatttgctaggtctgttctttttgaagctccccatgtctaactccattccaaaagaaaaatgaggtcagtagacagtctatggtgctagaaacccaccattgcctaatgacctagaaggctttgttgtctctgagcttgactaagaccatacctagatcacaggtattatgactccacatgaaccttcacatttgttcgctcataatctacttactgcctaaaaactacaaaaccaggctaagaaataccaccagtcatagcatttacttctgcttctcctggattatgtgctacaaatgtgctttggctttagaaagggatggatgagaagacagacctgagaccaatctgggtagaagcaaaaagttgaaccttttaaagtgctgaacacaaatccaaattcgaatggttcaagcagccgtgaaatcgctcttcataaagtgggcttaattctctagtttaagttcttttgatggaatgaattaattaatgtgtcaggtggcttatttgtggatgccatgattgatgatgttcattttaagctcttacctatagtacaagtacatgatgctactgaatatttttccacttggaaactgtgagctggttgttgcattaaaacacacatacaaacaaaatcaaaaacactgcggactttcactcaagctggtctttcttccccagtgtaaggcaatcctgcctactaacaacaccaacaacaaaacactccatctgtgaagctgacgcagttaagggggctaggcagggcatttgtgccaactaagaatcaccagatacccaccataagtacctatcgcagttttgaagtcgtttctccccaactcccaactcctgaaggttgctgcctgcatatttactcttcattagtgctattttcctgtatgtcattgtgagcaagctgtgattaataaagaattggagttctgtgaactaataaaggtttggtctgtt

SEQ ID NO: 410065 - DNA, 815 bp, Homo sapiens
ggtcccgcccctctccccaagcgcgggcccggccagcggaagcccctgcgcccgcgccatgtcaaagaaaaaaggactgagtgcagaagaaaagagaactcgcatgatggaaatattttctgaaacaaaagatgtatttcaattaaaagacttggagaagattgctcccaaagagaaaggcattactgctatgtcagtaaaagaagtccttcaaagcttagttgatgatggtatggttgactgtgagaggatcggaacttctaattattattgggcttttccaagtaaagctcttcatgcaaggaaacataagttggaggttctggaatctcagttgtctgagggaagtcaaaagcatgcaagcctacagaaaagcattgagaaagctaaaattggccgatgtgaaacggaagagcgaaccaggctagcaaaagagctttcttcacttcgagaccaaagggaacagctaaaggcagaagtagaaaaatacaaagactgtgatccgcaagttgtggaagaaatacgccaagcaaataaagtagccaaagaagctgctaacagatggactgataacatattcgcaataaaatcttgggccaaaagaaaatttgggtttgaagaaaataaaattgatagaacttttggaattccagaagactttgactacatagactaaaatattccatggtggtgaaggatgtacaagcttgtgaatatgtaaattttaaactattatctaactaagtgtactgaattgtcgtttgcctgtaactgtgtttatcattttattaatgttaaataaagtgtaaaatgca

SEQ ID NO: 410066 - DNA, 467 bp, Homo sapiens
tacaatattatgtcactatttcagcttttttcatagccattttatacataaattttataaaaattttgttcatatgaaaaaatacaaatgtatacatagctaaagatcattttgtgtgtatatatatatatatatatataaatacatttcattttatatatataattttttttcaggccaagcaaataaagtagccaaagaagctgctaacagatggactgataacatattcgcaataaaatcttgggccaaaagaaaatttgggtttgaagaaaataaaattgatagaacttttggaattccagaagactttgactacatagactaaaatattccatggtggtgaaggatgtacaagcttgtgaatatgtaaattttaaactattatctaactaagtgtactgaattgtcgtttgcctgtaactgtgtttatcattttattaatgttaaataaagtgtaaaatgca

SEQ ID NO: 410067 - DNA, 421 bp, Homo sapiens
gaaattccccgggttcgacctactacatactactaaattcgcggccgcgtcgacagataacatattcgcaataaaatcttgggccaaaagaaaatttgggtttgaagaaaataaaattgatagaacttttggaattccagaagactttgactacatagactaaaatattccatggtggtgaaggatgtacaagcttgtgaatatgtaaattttaaactattatctaactaagtgtactgaattgtcgtttgcctgtaactgtgtttatcattttattaatgttaaataaagtgtaaaatgcagatgttcttcaccccttttggtagaacaaaagcaggatgataaccatatccccccagtgctcatcaaagtaggacaataaaaatccatccatctcagtcaaagtcgagcatttacaaat

SEQ ID NO: 410068 - DNA, 934 bp, Homo sapiens
ggtcccgcccctctccccaagcgcgggcccggccagcggaagcccctgcgcccgcgccatgtcaaagaaaaaaggactgagtgcagaagaaaagagaactcgcatgatggaaatattttctgaaacaaaagatgtatttcaattaaaagacttggagaagattgctcccaaagagaaaggcattactgctatgtcagtaaaagaagtccttcaaagcttagttgatgatggtatggttgactgtgagaggatcggaacttctaattattattgggcttttccaagtaaagctcttcatgcaaggaaacataagttggaggttctggaatctcagttgtctgagggaagtcaaaagcatgcaagcctacagaaaagcattgagaaagctaaaattggccgatgtgaaacggaagagcgaaccaggctagcaaaagagctttcttcacttcgagaccaaagggaacagctaaaggcagaagtagaaaaatacaaagactgtgatccgcaagttgtggaagaaatacgccaagcaaataaagtagccaaagaagctgctaacagatggactgataacatattcgcaataaaatcttgggccaaaagaaaatttgggtttgaagaaaataaaattgatagaacttttggaattccagaagactttgactacatagactaaaatattccatggtggtgaaggatgtacaagcttgtgaatatgtaaattttaaactattatctaactaagtgtactgaattgtcgtttgcctgtaactgtgtttatcattttattaatgttaaataaagtgtaaaatgcagatgttcttcaccccttttggtagaacaaaagcaggatgataaccatatccccccagtgctcatcaaagtaggacaataaaaatccatccatctcagtcaaagtcgagcatttacaaat

SEQ ID NO: 410069 - DNA, 1095 bp, Homo sapiens
ggtcccgcccctctccccaagcgcgggcccggccagcggaagcccctgcgcccgcgccatgtcaaagaaaaaaggactgagtgcagaagaaaagagaactcgcatgatggaaatattttctgaaacaaaagatgtatttcaattaaaagacttggagaagattgctcccaaagagaaaggcattactgctatgtcagtaaaagaagtccttcaaagcttagttgatgatggtatggttgactgtgagaggatcggaacttctaattattattgggcttttccaagtaaagctcttcatgcaaggaaacataagttggaggttctggaatctcaggaccctggctgctgcttccatgaaataattaaagtctcctattatagaaaattctggctgggcgcagtggctcacgcctgtaatcccagcactttgggaggctgaggcgggcagatcacgaggtgactttcccccacccccacatgaagtgcaagatggagttgtctgagggaagtcaaaagcatgcaagcctacagaaaagcattgagaaagctaaaattggccgatgtgaaacggaagagcgaaccaggctagcaaaagagctttcttcacttcgagaccaaagggaacagctaaaggcagaagtagaaaaatacaaagactgtgatccgcaagttgtggaagaaatacgccaagcaaataaagtagccaaagaagctgctaacagatggactgataacatattcgcaataaaatcttgggccaaaagaaaatttgggtttgaagaaaataaaattgatagaacttttggaattccagaagactttgactacatagactaaaatattccatggtggtgaaggatgtacaagcttgtgaatatgtaaattttaaactattatctaactaagtgtactgaattgtcgtttgcctgtaactgtgtttatcattttattaatgttaaataaagtgtaaaatgcagatgttcttcaccccttttggtagaacaaaagcaggatgataaccatatccccccagtgctcatcaaagtaggacaataaaaatccatccatctcagtcaaagtcgagcatttacaaat

SEQ ID NO: 410070 - DNA, 819 bp, Homo sapiens
ggtcccgcccctctccccaagcgcgggcccggccagcggaagcccctgcgcccgcgccatgtcaaagaaaaaaggactgagtgcagaagaaaagagaactcgcatgatggaaatattttctgaaacaaaagatgtatttcaattaaaagacttggagaagattgctcccaaagagaaaggcattactgctatgtcagtaaaagaagtccttcaaagcttagttgatgatggtatggttgactgtgagaggatcggaacttctaattattattgggcttttccaagtaaagctcttcatgcaaggaaacataagttggaggttctggaatctcagttgtctgagggaagtcaaaagcatgcaagcctacagaaaagcattgagaaagctaaaattggccgatgtgaaacggccaagcaaataaagtagccaaagaagctgctaacagatggactgataacatattcgcaataaaatcttgggccaaaagaaaatttgggtttgaagaaaataaaattgatagaacttttggaattccagaagactttgactacatagactaaaatattccatggtggtgaaggatgtacaagcttgtgaatatgtaaattttaaactattatctaactaagtgtactgaattgtcgtttgcctgtaactgtgtttatcattttattaatgttaaataaagtgtaaaatgcagatgttcttcaccccttttggtagaacaaaagcaggatgataaccatatccccccagtgctcatcaaagtaggacaataaaaatccatccatctcagtcaaagtcgagcatttacaaat

SEQ ID NO: 410071 - DNA, 934 bp, Homo sapiens
ggtcccgcccctctccccaagcgcgggcccggccagcggaagcccctgcgcccgcgccatgtcaaagaaaaaaggactgagtgcagaagaaaagagaactcgcatgatggaaatattttctgaaacaaaagatgtatttcaattaaaagacttggagaagattgctcccaaagagaaaggcattactgctatgtcagtaaaagaagtccttcaaagcttagttgatgatggtatggttgactgtgagaggatcggaacttctaattattattgggcttttccaagtaaagctcttcatgcaaggaaacataagttggaggttctggaatctcaggcttggtgttcacgcctgttatcccaggactttgggagactgtggcaggaggatcgcatgagaccaggagtctgagaccagcctgggcaacatagtgagaactcgtctctacaaaaaaaaaaaaaaatttaattagccgggtatgatggtgcatacctgtagtcctagctactcgggaggctggagcaggaggatcacttgagcccaggagttttgaggctacaatgagctatgattgcactagtgcattccagcctgagcaacagtgggagactgtggatcatgaggtcaggagtttgagaccaacctgaccaacatcgtgaaaccctatctctactaaaaatacaaaaattagtcaggcgtggtggcatacccctgtaatcccagctactcaggaggctgaggcaggagaaccacttgaacccgggaggtggaggttgcagtgagctgagatcacaccactgcactccagcttgggcgacagagcaagactccatctcaacaacaacaacaacaaaaaagaaatcaaagtagacctaactatatatgcagatgtggaaatttctctgaaaatagcaaggcataagacactaagtaaag

SEQ ID NO: 410072 - DNA, 867 bp, Homo sapiens
gttccctttgggaataggagcaactttaattcctgaggcaacagtcctggcctctgctgtggaaatgtagaagagacaccattaacctgtccctgtttttctattattcttaagtctggtatttagcagcaagcagcttacagaatttttaaatatgagatctattaacttgttcaaaatagtatttaaatactttttttttttttgatacggagtgtcactcctgttgcccaggctggagtgcaatggtgtgatctcggctcaccacaacctccgcctcccaggttcaaacgattctcctgcctcagcctcccgagtagctgggattacaggtgcccgccaccaaccatgcctggctaatttttgtatttttagtagagatgggtttcaccatattggccaggctggtctcaaactcctgacctcatgatcaccctgcctcggcctcccaaagtgctggaattacaggcatgagccaccgcacctggccttaagtactttttaattagttgccattactcttaaaaatacagaaaactccttattttgatatatctgaaagttaatagaaggaagtaaaagaacaatgaagataattatacttgaaatgttttatgattgtgtttttctcaaaattatttctcaattttctttatagataacataataacatattcgcaataaaatcttgggccaaaagaaaatttgggtttgaagaaaataaaattgatagaacttttggaattccagaagactttgactacatagactaaaatattccatggtggtgaaggatgtacaagcttgtgaatatgtaaattttaaactattatctaactaagtgtactgaattgtcgtttgcctgta

SEQ ID NO: 410073 - DNA, 375 bp, Homo sapiens
ttaaagctgtgaaagacaggcactctgccatgcaattctttgtgatttttcttttttctttttggagttggggtcttgcactgtcacccagactggggtgcagtggtgtggtcatagctcactgcggcctcaaactcaagctcaagcgatcctcttaccttgcctttcaaattgctgggattataagcatgagccactgcatctggcctatgtgacacaattctgttttttgtcttttttttttgggggggggggatggaaaactcatactactacaaagcaggataggagggggcgaaatcaaggaataaagaaaaatagactggttagggggaaactaattatgattggcagaatcgttcaaatagatgggga

SEQ ID NO: 410074 - DNA, 357 bp, Homo sapiens
ttaaagctgtgaaagacaggcactctgccatgcaattctttgtgatttttcttttttctttttggagttggggtcttgcactgtcacccagactggggtgcagtggtgtggtcatagctcactgcggcctcaaactcaagctcaagcgatcctcttaccttgcctttcaaattgctgggattataagcatgagccactgcatctggcctatgtgacacaattctgttttttgtcttttttttagagacggggtttcactgtgttagccaggatggtctcgatctcctgacctcgtgatctgcccgccttggcctcccaaagtgctaggattacaggcgtgagccaccgcgcccagcc

SEQ ID NO: 410075 - DNA, 802 bp, Homo sapiens
tatggaaggaaatgacttcgtctacttctaggttaaaaacagttaaaaaaaaatcagacctttactgataaactataaaagactttttgaaggatgctgaaaaaaatgatgttttcaggtacctgagttgaacaaattacattggcatatactactgacttgttctgtttcagacccatcccatcaaggggctacctgcacacagatctaggtatcttacttaaggtatcataattattgttgcagaaaagctacagccatcttatgaactgtggatgcagttgaaagctagaattctgacttatcatcctcttattagttttgtagatttttgtttggaaattgaaccactgtgattttgcatagaatgtgtttagataccatcactcttgattgaaagctcatactgtcgcttgtgtagagtaggggaaatataaaaacaaaagccaagaattaatatctcaggaatgaatataagaactagctactttaattaggttttaaaaaatgttaatatatttgtgagttctaatccatattagagcatcattaatcctttctgcattcatattgtgtattaagataggtggttgggactttgccaaacttctcgaaattattatactagccaacatatttgttggagaaatgaatcctactgtatatattaaagattcttggctgagcatggtggctcatgtctgtcatctcagcaatttgggaggcaagggcaggaggatagtttgagcccatgagtttgagaccagcctggacaacatagtgagaccccatctcagcaaaa

SEQ ID NO: 410076 - DNA, 512 bp, Homo sapiens
tgagacagcatctcgctctgttcaagttggccttgaactcctggcctcaagtgatcctcccaccttggcctcccaaagtgttggaattacaggtgtgaaccattgcaatggccttattactactttatatttgtggagtgctttaaagttgacaaagtttttagttaatcctcacactattaccttgtggcgttgaagaacagatttcaggagcgtgaaagtgaagacaccaaaaaggaagttcttgcaatatttcaacaaagagatgaagatttggattagattccagttctacctttttggcaccagggagctgttctgtgaaagacaattttccacagggctcggggggtgggcatgaggcagaggatggtttcggaatgaaactgttgcacctcaagatcatcaattagatttccataaggagtgtgcaatctagattcctcacaggtgcagttcaaaataggttttgagttcctgtgagaatctaatgctctccttgatctgacagg

SEQ ID NO: 410077 - DNA, 1113 bp, Homo sapiens
taatgcattattgttcctaattttctttattactatatgctactctccagctattttaatattgaataattgttattttcacaaaagctggatataggaggtaaagggcattagttaacaaaatttggtaaaacattggtagttgaatagtacagacattcatacactatattttccatcttttcaaagataataattgattttattttcagatatatatcgtcaaaataaacagtatagaagatccctccctccagtcacctgtgttcatgccgatctaatattttaatttatccagtaacttttatgcaaatttttaaactcgagatgttgagaactttttctatagtaatgtctggattgcttctgtcaggtggttgaagattacgttggaagatggcaggtccctttgccacagcttcaggttcttcagactgccctttgttgttttacaacagccagtgcatcattcccagatgaatgtgagcatgtacaatatgttttgagtagcctgctgtggagtttcttcgagttgctgctgttctttggaagaggtgagttttatgaagagcccttaaaggatattcttggatcattccaggaatgccagaatcacctccgcagatatggaaatgtgaatctggaactggtgactcgaatcattagagatggtggcccatgggaagatccagtgttgcaagctgtccttaaagctcagccagcatctcaggagatagtgaacaaatatttaagttctgaaaatccactgttctttgaactacgtgccagatacctaattgcttgtgaacgcatacccgaagcaatggctcttattaaatcttgtataaatcacccagaaatcagtaaagacttatacttccatcaagcactcttcacatgtctgtttatgtcacctgtagaagatcagctattccgggagcatttattgaaaactgattgtaagagtggaattgatatcatctgtaatgctgaaaaagaaggcaaaactatgttagccttgcaactctgtgaatcctttcttattccacagctccagaatggggatatgtactgtatctgggagttgattttcatatggagtaaactacagct

SEQ ID NO: 410078 - DNA, 363 bp, Homo sapiens
tctttaatataaactatcgctgtgaaactctttttctttcctatgtatattattatattcagtaaacttatgtgtttaattagatgtaaaattagacgttattcttgatctttggcttcccaatttcattagatgggattagaattgtcccttttgtgtctttgatatattgtggttatctcatccctttcttgactcatcagcaccaaggttagattcattaagttagattcattaagatcattaaatttatatgaaacccacagctttaaagtagaagaaaaccctacaaatcagccaaaacagatgtttagaattgattgttgtgttttaaaactttatttttttgtttatatatattgt

SEQ ID NO: 410079 - DNA, 396 bp, Homo sapiens
ggcctcccaaagtgctgggattacaggtgtgagccactgcgcctggcccccatcacataattttaactcttaagtaggctgggaagttaaagatgaacattgtatttcctagagcagccacttaaaaaataatttatcaagagaatgagaaaacaagccacaacctgggagaagatacttgcaaaagacttatctgatgaaggactttgtatattttacccaaaatatacaaagaactcttaaaacccaacaataagaaaaggagcagttttaggccaggtgtggtggctcacaccggtaatcccaatactttgggaggccaaagtgggaggatcctttgagccgaggagttcaagatcagcttgagcaacatggtaagacccctctccacaaaaa

SEQ ID NO: 410080 - DNA, 554 bp, Homo sapiens
aaaattagtagacaaataatgcttccctggagttctggagcatcatatctcaaagttttttatgttaagcattatatcttagaagattagtaaatgctaaataaggaaaagagtgaggagtttgcagactcttcaaatataggaaacaatggactgagtaaaagtaaaaggattccttcttaaatctttttatatactaatgtgcatcatgaactctcaagagggacatatagtgagcagcactttcaaaaattatttgaccaccagaccactttttaactgaacatcactaccagtatggaacatgttttctgaaacactgtcctcctaagtgtttctaagtgagaaaaaaagaaaaatgatatgcatatagaataatctaccttacatatctgtcataaaatgttgtatataataagatgccatgagaaaaggcacccacgtcgtcatcatagagcttacatgttaggggaaaaactttataaataagctgacagatacaataaataattgtactccatgatatgtgctatgagggaaacaaacagggagtt

SEQ ID NO: 410081 - DNA, 466 bp, Homo sapiens
tgctgccaaagtattcctccagtaaaattcatatagtttgctgcccataaggagcaaaaaatatttatcttgggcttatttgaatgattaggatgagatttaaaacagaacttttcagttccgttatctccagtgccgtttcatgctttagagtgagtcacgtgcagggagtgtgaacgtcagaggtggtttattatccagtctgccttatccttaatctgttcacagatatttatttactaatgctttcgttcttaagagttgtgggatagaggctgggcgcagtgtctcacacctgtaaacccagcactttgggaggctgaggcgggtggatcacctgaggtcaggagttcaaaaaaaagagttgtgagataggaaaatgaagcgcttttcatttactaaatgattgttaactccagtttttcatcaaaataaaattccattgttttaatgtttctgaccaaac

SEQ ID NO: 410082 - DNA, 2883 bp, Homo sapiens
tttgtaacttcacttcagcctcccattgatcgctttctgcaaccattcagactgatctcgggctcctatttcatttacattgtgtgcacaccaagtaaccagtgggaaaactttagagggtacttaaaccccagaaaattctgaaaccgggctcttgagccgctatcctcgggcctgctcccaccctgtggagtgcactttcgttttcaataaatctctgcttttgttgcttcattctttccttgctttgtttgtgtgtttgtccagttctttgttcaacacgccaagaacctggacactcttcactggtaacatattttggcaagccaaccaggagaaaagaatttctgcttggacactgcatagctgctgggaaaatgaacatcagtgttgatttggaaacgaattatgccgagttggttctagatgtgggaagagtcactcttggagagaacagtaggaaaaaaatgaaggattgtaaactgagaaaaaagcagaatgaaagggtctcacgagctatgtgtgctctgctcaattctggagggggagtgatcaaggctgaaattgagaatgaagactatagttatacaaaagatggaataggactagatttggaaaattcttttagtaacattctgttatttgttcctgagtacttagacttcatgcagaatggtaactactttctgatttttgtgaagtcatggagcttgaacacctctggtctgcggattaccaccttgagctccaatttgtacaaaagagatataacatctgcaaaagtcatgaatgccactgctgcactggagttcctcaaagacatgaaaaagactagagggagattgtatttaagaccagaattgctggcaaagaggccctgtgttgatatacaagaagaaaataacatgaaggccttggccggggttttttttgatagaacagaacttgatcggaaagaaaaattgacctttactgaatccacacatgttgaaattaaaaacttctcgacagaaaagttgttacaacgaattaaagagattctccctcaatatgtttctgcatttgcaaatactgatggaggatatttgttcattggtttaaatgaagataaagaaataattggctttaaagcagagatgagtgacctcgatgacttagaaagagaaatcgaaaagtccattaggaagatgcctgtgcatcacttctgtatggagaagaagaagataaattattcatgcaaattccttggggtatatgataaaggaagtctttgtggatatgtctgtgcactcagagtggagcgcttctgctgtgcagtgtttgctaaagagcctgattcctggcatgtgaaagataaccgtgtgatgcagttgaccaggaaggaatggatccagttcatggtggaggctgaaccaaaattttccagttcatatgaagaggtgatctctcaaataaatgcgtcattacctgctccccacagttggcctcttttggaatggcaacggcagagacatcactgtccagggctatcaggaaggataacgtatactccagaaaacctttgcagaaaactgttcttacaacatgaaggacttaagcaattaatatgtgaagaaatggactctgtcagaaagggctcactgatcttctctaggagctggtctgtggatctgggcttgcaagagaaccacaaagtcctctgtgatgctcttctgatttcccaggacagtcctccagtcctatacaccttccacatggtacaggatgaggagtttaaaggctattctacacaaactgccctaaccttaaagcagaagctggcaaaaattggtggttacactaaaaaagtgtgtgtcatgacaaagatcttctacttgagccctgaaggcatgacaagctgccagtatgatttaaggtcgcaagtaatttaccctgaatcctactattttacaagaaggaaatacttgctgaaagccctttttaaagccttaaagagactcaagtctctgagagaccagttttcctttgcagaaaatctataccagataatcggtatagattgctttcagaagaatgataaaaagatgtttaaatcttgtcgaaggctcacctgatggaaaatggactgggctactgagatatttttcattatatatttgataacattctctaattctgtgaaaatatttctttgaaaactttgcaagttaagcaacttaatgtgatgttggataattgggttttgtctattttcacttctccctaaataatcttcacagatattgtttgagggatattaggaaaattaatttgttaactcgtctgtgcacagtattatttactctgtctgtagttcctgaataaattttcttccatgcttgaactgggaaaacaaaaacatacatcacaaaaaaacaaaaaaggggcgggggcacggctcaaagatgtttcccctcgcggggggggcgccccaagttttaacgcgcgttcacccagtcttttctttgtgaccaaggtgggtgccccctaataaggaggagcgccgtattatataacggctaggcgctttgggcccgcgcatcgttttacacaactgttctgcggactcgtggaaacctctgtcactccttgggcacacctttgggcaagggaaccccttatactctcggcgcgggggggcgccccattctgttgggacacactctaccctcaacagagatatcttacaccgcttccaaggggacacctcttctacaccttcttcaaccgtgcatatatccgggttctttccaccctaaccctgctcaaattgccttgtcgctcctacaccaaaattctcggccccccacggcactttcctctctcggaacacttttttttccg

SEQ ID NO: 410083 - DNA, 3000 bp, Homo sapiens
gagcccgcggactgtagcctgggcctcgccaagttcctttgttctttgttttctttaaattaccttttttctttttgtcttagaaaatacacatgggtgaaaaagaaacgagagctccctagagatcactcagagctgttttcgtgggtttttaacttccagttgctcaagggtccacgctggcatctggggtgtgctcgcacctgcgaagaatccagcttctagggagcaccgcgagctgttctttgttcaacacgccaagaacctggacactcttcactggtaacatattttggcaagccaaccaggaggttttcgatgtttgcatgcagccatctctagaatgtcaaatggtctctcttcaactggaatgatgagaagtgaaacaaatatgcgaccatgaggacactgtaacctatggatggtgtgctgagactggaaagccaaaatgatgaaaagaatttctgcttggacactgcatagctgctgggaaaatgaacatcagtgttgatttggaaacgaattatgccgagttggttctagatgtgggaagagtcactcttggagagaacagtaggaaaaaaatgaaggattgtaaactgagaaaaaagcagaatgaaagggtctcacgagctatgtgtgctctgctcaattctggagggggagtgatcaaggctgaaattgagaatgaagactatagttatacaaaagatggaataggactagatttggaaaattcttttagtaacattctgttatttgttcctgagtacttagacttcatgcagaatggtaactactttctgatttttgtgaagtcatggagcttgaacacctctggtctgcggattaccaccttgagctccaatttgtacaaaagagatataacatctgcaaaagtcatgaatgccactgctgcactggagttcctcaaagacatgaaaaagactagagggagattgtatttaagaccagaattgctggcaaagaggccctgtgttgatatacaagaagaaaataacatgaaggccttggccggggttttttttgatagaacagaacttgatcggaaagaaaaattgacctttactgaatccacacatgttgaaattaaaaacttctcgacagaaaagttgttacaacgaattaaagagattctccctcaatatgtttctgcatttgcaaatactgatggaggatatttgttcattggtttaaatgaagataaagaaataattggctttaaagcagagatgagtgacctcgatgacttagaaagagaaatcgaaaagtccattaggaagatgcctgtgcatcacttctgtatggagaagaagaagataaattattcatgcaaattccttggggtatatgataaaggaagtctttgtggatatgtctgtgcactcagagtggagcgcttctgctgtgcagtgtttgctaaagagcctgattcctggcatgtgaaagataaccgtgtgatgcagttgaccaggaaggaatggatccagttcatggtggaggctgaaccaaaattttccagttcatatgaagaggtgatctctcaaataaatgcgtcattacctgctccccacagttggcctcttttggaatggcaacggcagagacatcactgtccagggctatcaggaaggataacgtatactccagaaaacctttgcagaaaactgttcttacaacatgaaggacttaagcaattaatatgtgaagaaatggactctgtcagaaagggctcactgatcttctctaggagctggtctgtggatctgggcttgcaagagaaccacaaagtcctctgtgatgctcttctgatttcccaggacagtcctccagtcctatacaccttccacatggtacaggatgaggagtttaaaggctattctacacaaactgccctaaccttaaagcagaagctggcaaaaattggtggttacactaaaaaagtgtgtgtcatgacaaagatcttctacttgagccctgaaggcatgacaagctgccagtatgatttaaggtcgcaagtaatttaccctgaatcctactattttacaagaaggaaatacttgctgaaagccctttttaaagccttaaagagactcaagtctctgagagaccagttttcctttgcagaaaatctataccagataatcggtatagattgctttcagaagaatgataaaaagatgtttaaatcttgtcgaaggctcacctgatggaaaatggactgggctactgagatatttttcattatatatttgataacattctctaattctgtgaaaatatttctttgaaaactttgcaagttaagcaacttaatgtgatgttggataattgggttttgtctattttcacttctccctaaataatcttcacagatattgtttgagggatattaggaaaattaatttgttaactcgtctgtgcacagtattatttactctgtctgtagttcctgaataaattttcttccatgcttgaactgggaaaacaaaaacatacatcacaaaaaaacaaaaaaggggcgggggcacggctcaaagatgtttcccctcgcggggggggcgccccaagttttaacgcgcgttcacccagtcttttctttgtgaccaaggtgggtgccccctaataaggaggagcgccgtattatataacggctaggcgctttgggcccgcgcatcgttttacacaactgttctgcggactcgtggaaacctctgtcactccttgggcacacctttgggcaagggaaccccttatactctcggcgcgggggggcgccccattctgttgggacacactctaccctcaacagagatatcttacaccgcttccaaggggacacctcttctacaccttcttcaaccgtgcatatatccgggttctttccaccctaaccctgctcaaattgccttgtcgctcctacaccaaaattctcggccccccacggcactttcctctctcggaacacttttttttccg

SEQ ID NO: 410084 - DNA, 2787 bp, Homo sapiens
gagcccgcggactgtagcctgggcctcgccaagttcctttgttctttgttttctttaaattaccttttttctttttgtcttagaaaatacacatgggtgaaaaagaaacgagagctccctagagatcactcagagctgttttcgtgggtttttaacttccagttgctcaagggtccacgctggcatctggggtgtgctcgcacctgcgaagaatccagcttctagggagcaccgcgagctgaaaagaatttctgcttggacactgcatagctgctgggaaaatgaacatcagtgttgatttggaaacgaattatgccgagttggttctagatgtgggaagagtcactcttggagagaacagtaggaaaaaaatgaaggattgtaaactgagaaaaaagcagaatgaaagggtctcacgagctatgtgtgctctgctcaattctggagggggagtgatcaaggctgaaattgagaatgaagactatagttatacaaaagatggaataggactagatttggaaaattcttttagtaacattctgttatttgttcctgagtacttagacttcatgcagaatggtaactactttctgatttttgtgaagtcatggagcttgaacacctctggtctgcggattaccaccttgagctccaatttgtacaaaagagatataacatctgcaaaagtcatgaatgccactgctgcactggagttcctcaaagacatgaaaaagactagagggagattgtatttaagaccagaattgctggcaaagaggccctgtgttgatatacaagaagaaaataacatgaaggccttggccggggttttttttgatagaacagaacttgatcggaaagaaaaattgacctttactgaatccacacatgttgaaattaaaaacttctcgacagaaaagttgttacaacgaattaaagagattctccctcaatatgtttctgcatttgcaaatactgatggaggatatttgttcattggtttaaatgaagataaagaaataattggctttaaagcagagatgagtgacctcgatgacttagaaagagaaatcgaaaagtccattaggaagatgcctgtgcatcacttctgtatggagaagaagaagataaattattcatgcaaattccttggggtatatgataaaggaagtctttgtggatatgtctgtgcactcagagtggagcgcttctgctgtgcagtgtttgctaaagagcctgattcctggcatgtgaaagataaccgtgtgatgcagttgaccaggaaggaatggatccagttcatggtggaggctgaaccaaaattttccagttcatatgaagaggtgatctctcaaataaatgcgtcattacctgctccccacagttggcctcttttggaatggcaacggcagagacatcactgtccagggctatcaggaaggataacgtatactccagaaaacctttgcagaaaactgttcttacaacatgaaggacttaagcaattaatatgtgaagaaatggactctgtcagaaagggctcactgatcttctctaggagctggtctgtggatctgggcttgcaagagaaccacaaagtcctctgtgatgctcttctgatttcccaggacagtcctccagtcctatacaccttccacatggtacaggatgaggagtttaaaggctattctacacaaactgccctaaccttaaagcagaagctggcaaaaattggtggttacactaaaaaagtgtgtgtcatgacaaagatcttctacttgagccctgaaggcatgacaagctgccagtatgatttaaggtcgcaagtaatttaccctgaatcctactattttacaagaaggaaatacttgctgaaagccctttttaaagccttaaagagactcaagtctctgagagaccagttttcctttgcagaaaatctataccagataatcggtatagattgctttcagaagaatgataaaaagatgtttaaatcttgtcgaaggctcacctgatggaaaatggactgggctactgagatatttttcattatatatttgataacattctctaattctgtgaaaatatttctttgaaaactttgcaagttaagcaacttaatgtgatgttggataattgggttttgtctattttcacttctccctaaataatcttcacagatattgtttgagggatattaggaaaattaatttgttaactcgtctgtgcacagtattatttactctgtctgtagttcctgaataaattttcttccatgcttgaactgggaaaacaaaaacatacatcacaaaaaaacaaaaaaggggcgggggcacggctcaaagatgtttcccctcgcggggggggcgccccaagttttaacgcgcgttcacccagtcttttctttgtgaccaaggtgggtgccccctaataaggaggagcgccgtattatataacggctaggcgctttgggcccgcgcatcgttttacacaactgttctgcggactcgtggaaacctctgtcactccttgggcacacctttgggcaagggaaccccttatactctcggcgcgggggggcgccccattctgttgggacacactctaccctcaacagagatatcttacaccgcttccaaggggacacctcttctacaccttcttcaaccgtgcatatatccgggttctttccaccctaaccctgctcaaattgccttgtcgctcctacaccaaaattctcggccccccacggcactttcctctctcggaacacttttttttccg

SEQ ID NO: 410085 - DNA, 549 bp, Homo sapiens
gcctcggagaagtccaggagctaggtcaaggcagagggttgggggccacagacaaggccaaggcggggcatggaacagcaggggtcagatgttaggggaagtacgtcggcacccgggtggggatcttgaatactatgtcaggcacccacaacaagagctttgggtgctttgtgtctagggccgggtacccttgtttctgctgctgatgccgtgtttccagtctggattttagcaaaattaactgacccatccttctatctgatgcctgttttcttctctctcattagggagttctgggtccagcttttagcccacttatctgcctccagctttcagcctacttatctgccttccttaatcttttcccccttctaacctcttttgctggcctgtgctcccagagttcccagagtctgtctacacaactccctgtatgtccttggcctaggaattttttcctgtgtttctctaaccagctccttagaacctggaacttgtttccatggtctatacttcttttctctatttatccatctgtcttctgattga

SEQ ID NO: 410086 - DNA, 444 bp, Homo sapiens
gcctcggagaagtccaggagctaggtcaaggcagagggttgggggccacagacaaggccaaggcggggcatggaacagcaggggtcagatgttaggggaagtacgtcggcacccgggtggggatcttgaatactatgtcaggcacccacaacaagagctttgggtgctttgtgtctagggccgggtacccttgtttctgctgctgatgccgtgtttccagtctggattttagcaaaattaactgacccatccttctatctgatgcctgttttcttctctctcattagggagttctgggtccagcttttagcccacttatctgcctccagctttcagcctacttatctgccttccttaatcttttcccccttctaacctcttttgctggcctgtatcccggggagcacaggccagcaaaagaggttagaagggggaaaagtaagg

SEQ ID NO: 410087 - DNA, 762 bp, Homo sapiens
agtagattccagtgcaggttggcctttgttagagcccactccattagccaatatgccttcctgccgtccttcaggtttgtggcttaatgttttaattttccatatgcaaaagtttgtctaccttatgttagctgtcccagaagacagaatagcagagaacagtaagtgtgtgtgtgtgtgtgtgtgtgtctatgttctctttggatggtgtctgtaaatttgttttcaatgtcttttcaatgacaaagggaatgacagcaggagtgagactgtcttaatgttacactcagctctaggaaaaggaagaggtaagaaatcaaaacaaatctatgaaaagtagagtgagggagaaattactcctcagattcttgcaaatactcttaagtgcatgtaatcaaacatttgaaaagaacctagtactaaaggggtgtcactgttttcatcccctccccttcatgttctctctccttctctttagcaggaccccaacttcagagggtgcagcctctgaaagagactgtgaatctatatataccatttctgggacgaattcatcttctgaggcctcacacactccacatcttccatctgaattgcctcctagatatgaagaaaaagaaaatgctgcagctacattcttgcctctatcttctgagccttccccaccgtaaactatggactctagttcagttttatatgcaatggatcactattttatttaattttttttaaataaaaaatacaatagcattggcaatattc

SEQ ID NO: 410088 - DNA, 502 bp, Homo sapiens
tatataattaattttgcttttgctaatttgcttccatttattacccacctgttgtcaactaaatattgttttgccttaggtgactcggtaataatatttccaccccctccaccaccttactttcctgaatcttcagcttctgcggtcgctgagagtcctggaactaacagtctgcttccgaatgaaaaccccccttcatattacagtattttcaactatgggaccccaacttcagagggtgcagcctctgaaagagactgtgaatctatatataccatttctgggacgaattcatcttctgaggcctcacacactccacatcttccatctgaattgcctcctagatatgaagaaaaagaaaatgctgcagctacattcttgcctctatcttctgagccttccccaccgtaaactatggactctagttcagttttatatgcaatggatcactattttatttaattttttttaaataaaaaatacaatagcattggcaatattc

SEQ ID NO: 410089 - DNA, 1204 bp, Homo sapiens
agcggaggacgcgcggtgggtagggtgcagggcggccggcgcagccgaggccgcgtgcggaggcggacgccgcgcccagccagtgcccacagcagcgcggtcagccaggcgccggacccagcttcagagctgctgaaatcttggagggaagaaaacacatcccaccctgcctccgggaaggggcctctcctggacatgtctcctgcagctgctgctgagccagatggggaccagcaggacagacacgtcagcaaactcatcttctgcttctttgtcttcggcgccgtcttgttgtgtgtgggagtcctgctctccatctttgggttccaggcatgccaatataagcccctcccagactgccccatggtgctcaaggtggcggggcctgcatgtgccgtggttgggcttggggctgtgatcctggcccgctcccgggcgcaacttcagctccgtgcagggctgcagagaggtcagcagatggaccccgaccgagccttcatctgtggagagagccgccagtttgcccagtgccttatctttgggtttctgttcttgacaagcggcatgctcatcagcgtcctgggcatttgggtccctggatgtggctccaactgggcgcaggaaccgctaaacgagacagacactggcgactcagagccccggatgtgtgggttcctttctctgcagatcatggggcccttgattgtgcttgtgggattgtgtttcttcgtggttgcccatgttaagaagagaaacacgctgaatgctggccaggatgcctctgagagagaagagggacagatccagattatggagcctgtccaggtcactgtaggtgactcggtaataatatttccaccccctccaccaccttactttcctgaatcttcagcttctgcggtcgctgagagtcctggaactaacagtctgcttccgaatgaaaaccccccttcatattacagtattttcaactatgggaccccaacttcagagggtgcagcctctgaaagagactgtgaatctatatataccatttctgggacgaattcatcttctgaggcctcacacactccacatcttccatctgaattgcctcctagatatgaagaaaaagatatggactctagttcagttttatatgcaatggatcactattttatttaattttttttaaataaaaaatacaatagcattggcaatattc

SEQ ID NO: 410090 - DNA, 1258 bp, Homo sapiens
agcggaggacgcgcggtgggtagggtgcagggcggccggcgcagccgaggccgcgtgcggaggcggacgccgcgcccagccagtgcccacagcagcgcggtcagccaggcgccggacccagcttcagagctgctgaaatcttggagggaagaaaacacatcccaccctgcctccgggaaggggcctctcctggacatgtctcctgcagctgctgctgagccagatggggaccagcaggacagacacgtcagcaaactcatcttctgcttctttgtcttcggcgccgtcttgttgtgtgtgggagtcctgctctccatctttgggttccaggcatgccaatataagcccctcccagactgccccatggtgctcaaggtggcggggcctgcatgtgccgtggttgggcttggggctgtgatcctggcccgctcccgggcgcaacttcagctccgtgcagggctgcagagaggtcagcagatggaccccgaccgagccttcatctgtggagagagccgccagtttgcccagtgccttatctttgggtttctgttcttgacaagcggcatgctcatcagcgtcctgggcatttgggtccctggatgtggctccaactgggcgcaggaaccgctaaacgagacagacactggcgactcagagccccggatgtgtgggttcctttctctgcagatcatggggcccttgattgtgcttgtgggattgtgtttcttcgtggttgcccatgttaagaagagaaacacgctgaatgctggccaggatgcctctgagagagaagagggacagatccagattatggagcctgtccaggtcactgtaggtgactcggtaataatatttccaccccctccaccaccttactttcctgaatcttcagcttctgcggtcgctgagagtcctggaactaacagtctgcttccgaatgaaaaccccccttcatattacagtattttcaactatgggaccccaacttcagagggtgcagcctctgaaagagactgtgaatctatatataccatttctgggacgaattcatcttctgaggcctcacacactccacatcttccatctgaattgcctcctagatatgaagaaaaagaaaatgctgcagctacattcttgcctctatcttctgagccttccccaccgtaaactatggactctagttcagttttatatgcaatggatcactattttatttaattttttttaaataaaaaatacaatagcattggcaatattc

SEQ ID NO: 410091 - DNA, 397 bp, Homo sapiens
ccctccatactgtgagctccttgagggccttgtctgcacctggggcatccgggaaaccccagtcccagcccaggggatccatcggaggcccctgaatgagtgaccccacaattgcagattcaactctggtttagatggtaaagggatctgggagctgggttgccagtgtggagaccgaattcaaagcaggatccagaaaggtattaattgttattattattacatttaaacagtgtttacaagctcagagaggaatttcccttagcctattttacacatatttttcactatttcataagtgaggaagctgagtaaaaagtaccttaagggcccggtgcggtggctcacgagtgtaatcccagcactttgggaggccaaggcaggcagatcacgaggt

SEQ ID NO: 410092 - DNA, 583 bp, Homo sapiens
atataatactagttgatatcccatacatttgtagacaggattgagttaattctgtgaagcacttagactaatgtgaatattgtatgaactggttattatcttctgttaaaacatttactttatagtgtgatttttctgcttttatgtattgaggctctctaaattgcagtacagatgcattaatgatacccagtaaaggaatcctcatttaccatggtatcttacatacccatccagtgtctttttgtctttttcatctattcattcatttggcaaatattttcagagatgccactgtgtaccaggtagtggtggctcatgcctgtaatctcagcactttgggagaccaaggtggatggatcacgaggtcaggagtttgagaccagcctggccaacatagtgaaatcccatatctactaaaaatacaaaaaattagctgggcgtggtggtgtgtgcctataatcccagctactcgggaggctgaggcaggagaattgcgtgaacctgggaggcggaggttgcagtgagccgagatggcgccattgcactccagcccgggcgacagtgcgagactgtctggaga

SEQ ID NO: 410093 - DNA, 479 bp, Homo sapiens
aatatggcaaagtgtcagccaagtctacttgggagacagaattgctgcctgttaaaagggaaggtgataaatatgtctgatttgttactgtgatcaagtaggcaaaatacttcattaaaccataaatttgtctaaaagcatattggaaaactatttgtcccagacagcttcaccaagggatagtatatttctaacgctgtctctgaccaaatgcttttataagtactgccctttctggaaatttgggaaaatgttgaattctggatctttctgctctaaaagccttaagtcattttagaataggaggcacatgaatatattttgaaagcaacatgctaaccaattagagttttaacatagtcaaaattgtgaagtgatgaaagtttgtcttaggcatcttgtgataaccacctaggattttttagttctacctgggagggattttttcaagaatataggtttttgtttttgtattttct

SEQ ID NO: 410094 - DNA, 838 bp, Homo sapiens
tcaggaagtttacagtcatggtggaaggtgaaggaggaaacaggcataccacatggcacatgagcgacagggaaagagaaggtcccagactcttttaaacaaccagatctcatgtgaactgagtgagaactcactcatcaccaaggggatggcactaaaccattcatgagggatccattccagtgatccaatacctcccgctaggccccacctccaacattggggatcacatttcaacatgagatttagaggggatgcccatcccaactatatcaagtagtttgttggcaagtgatggttctggagctgttggggcttaggaagagtgtgtttactctttgctcaacagtttgttctagtgaaggacttgaagcaggagagtaacaagctcatgttttttttcctatacttgtaaaaattattcagctttccactctttaaatatactaaaatgggcacctaaatgttgtacgataagaattggtttcttttctctaacagcagaagggcttgggatactgaaggaaatgtgacttttctgcctttgtctattgggtaagtggctcatgcctataatcccagcactttgggaggccaaggtgggcagatcacgaggtcaggagtttgagaccagcctgaccaacagggtgaaaccccgtctctactacaaatacagaaaattagccaggcatggtggtgcacacctgtaatcccagctactcaggaggctgaggcaggagaactgcctgaacccggaaggcagaggttgcagtgagccgagatcatgccactgcactccagcctgggcgacagagtgagactctgtctcaaaaaaaga

SEQ ID NO: 410095 - DNA, 519 bp, Homo sapiens
gcctcctgggttcaagcgattctcctgcctcagcctcccgagtagctgggattacaggtgctcgctaccacgtccagctaacttttttgtatttttagtagagacggggtttcaccatgttggccaggatggtctctatctcttgaccttgtgatctgcccggcttggcctcccaaagtgctgggattacaggcgtgaagcacgcctggcctttattttctttatggcttttctcattataagatactgccttgtttatttatttgcttatttattgagacacatggcccccctcacccccaaaaagaatgtaaactgctaacaacagattatttgttttgttcaccactgcatcctcagcacctagaagaaggcatggaacatagaaagtgctgtaattgtcagggtgtgctggcttatgcctgtaatcccagcgctatggtaggccaaggtggaaagattgcttgagtccaggagttggagaccagcctgggcaacatagtgagacccccatctcta

SEQ ID NO: 410096 - DNA, 420 bp, Homo sapiens
catactctgttaaaaacacaacaaaagaacttctcttgtcaataggtaatctttatataatttaaaactgtattccttgctttctgaattcatatattattttcatgattaaagaaattaatctggccgggagtggtggttcacgcctgtaatcctagcactttgggagcctgaggcaggtggatcacgaggtcgggagttgaagaccagcctggccaagatggtgaaaccttatctctactaaaaatacaaaaattatccaggcgtggtggcaggcgcctgtaatcccagctacttgggaggctgcggcaggagaatcgcttgacccagggggcagaggttgcagtgagccaagatctgccactgcactccagcatgggtgacagagtgagactctgactcaaaaaaaaaaagaaaaag

SEQ ID NO: 410097 - DNA, 493 bp, Homo sapiens
caccctcaagaaatctttcattaaaagcggtccttattttgtaggaaattgaataatttatacaatgaactagctgcatctgaggctggacacagtgggtcacacctgtaatcccaaagtactggggttacaggtgtgagccaccgcaccccgcctgaaatagttcttaaattcaaattcaattttgtgtattccaacagtattatctcagcagtttagttttttccagttcacatccatccatctgcctgaggagaccaatgctgtcagctttccttattctcacaggtgtccatctaatcaagaatagttcccaccaggcttctgattggcccaggttaggtcacatgcatatcctcaaatgcatcgccataacaacagggatggaatcctttcagcacttgcttggtcttatgtctactgctgtaggtaggtaggttgtttgtataggaggtgtggcacaatggtaggagaaggagattattccccatac

SEQ ID NO: 410098 - DNA, 493 bp, Homo sapiens
tgaggaggtgtcatgcaacttgctgccccagccctccccttctaaggaactcccacacctgccctgtcttcctgctacagtctctgagaaaagccctttcatctgtcaagaactacagaagtcattctttaagcctgtgagcagaaccagaagggacactctcacagcctgttcaccacggaatccaggaggcaggtcaattttggtggctgtctccacaacatggctttttccccttgaagaccatcaggagaagagcctgtatctccgcatctgtggaaatcgtctttgccatgtaatgtgccataaccacgggagtgacatcgcatcacatcccagggccaccgctaaggaggagggtgaggatcttgaccctcatcttagaattctgccctgcctggcttccacttgtcctcttctaaatctgtcttaactcattcctttggtgcctgtttttgctgcctaaattttggcaataaagggaggaataaaa

SEQ ID NO: 410099 - DNA, 358 bp, Homo sapiens
tgaggaggtgtcatgcaacttgctgccccagccctccccttctaaggaactcccacacctgccctgtcttcctgctacagtctctgagaaaagccctttcatctgtcaagaactacagaagtcattctttaagcagtgctaaataaacaatgaaacagacacaaagttaaagttacctgatccaaaaaggagtgaagcctagaccccagcccactgactcagtctctaagtcccctcactcaaatcttcaatcaacagtggagatggctgtgagctcttctgattccagatgacaatactcctgcctttaattccttgatatgtttaattatgtaagtaaatttaatataaaaatcat

SEQ ID NO: 410100 - DNA, 628 bp, Homo sapiens
cttaatatttttcttttggcagagtggtttgggttccaacgtttttattttcctttcactgctttcagggagcaaaagagaaaaacctacattactatcttaatgcagaaaaatacttgataacatttcacacctattcagggtaaaaattctcagtaaatgaggaatagaaagaatttcccttaatgaaacaaaggttatgtgtgacagccggctgcaatcatcatatttaatggtgaagtgtgttcacactaagatcaggaacaagcattaatgttgattcttatcactcttatttagcattatcctagaataactagctaacctgttaaggtattaaaaaggaataaaaggcataaacgttgaaacagaaaaaaaaattttttattcacagaagatgtgagtatgtacatggaagaatagttaaacaactagatactagtaacacacagtttaggaacttcagaaaataaggtcagtatttttaaaaagcacttgtatttctgtaacctagcagcaaacagttaaaaaatgaaatacatatttatactaccatcaaaaacaacatatttaaacttctaagagtaaatgtaggggaatatctttgtgactttggaataggtaaaga

SEQ ID NO: 410101 - DNA, 318 bp, Homo sapiens
tgaaacagaaaaaaaaattttttattcacagaagatgtgagtatgtacatggaagaatagttaaacaactagatactagtaacacacagtttaggaacttcagaaaataaggtcagtatttttaaaaagcacttgtatttctgtaacctagcagcaaacagttaaaaaatgaaatacatatttatactaccatcaaaaacaacatatttaaacttctaagagtaaatgtaggggaatatctttgtgactttggaataggtaaagatagcacagatgggacatgaaaggtaaactatttatgtaagtatatagaaagaa

SEQ ID NO: 410102 - DNA, 497 bp, Homo sapiens
aatctccattccctccctgccagcctatttttctgccatccctcttctctgtctgctcagttcttgcatctctccttctgtgtttccaggtttctctatatttcttttgcctgtgtagtctctctgtcgttaggccttttatctatgcctgtgtgtctcactgtctagctgcttgtctccctgcctgtcactttcattgtggggcatcagtctctgccttcttctgtctttcagtacttcaaaaaataaaaattaaataaaaaatttaaattccttatgattaatgggtacaggagaatattttttttgttttaatgagaagactattaaggtgagaacaaagaactcaaatattcagctgtgaaatgcaaatgaagaaaaatttttaagggactctcaagccaagaataagattatttaacgcaaaagcaagaaacatatctaaagcaataatttctaaccttttaggatcgtagaaagttagaaactttctccag

SEQ ID NO: 410103 - DNA, 297 bp, Homo sapiens
atacaaaaacaataggaaaaaaccccagtaaaacaaagagttggttctctgaaagatgtgattgaaaaccccttaaccagtgggagaaaaaaaaagagagaaggctgaaataaaagcagaaacataagagtagtcataataaagatgccacaggaataaaaagataagaaactaccatgaaaattacttattagcaaatgggacaacctagaataaatgaacaaattcctagaaccataaaacctgtcaagcgtgaatcaagaagaaatagaaagcctgaacagacgaataataata

SEQ ID NO: 410104 - DNA, 198 bp, Homo sapiens
gatgtttctgtgaaggtatttatggatgagactaatatttaaattggtggactttgagtaaagcacatggccctccgtaatgcgggtaggcctcacccaatcagttgaaggcctgaatagaaccgaagagggaatgccacagcagatggccttcagacttacactgcaccaccggctcttctctgggtctccagcctg

SEQ ID NO: 410105 - DNA, 379 bp, Homo sapiens
atctacacatatttatagtaatttggtcaatattaattttagtatctgtgacacatgcacacacatacagtatattcacacacttccatttttagtaaaatgccacaggattcattccagccatctccatttccatgtttgtgattctgttctctgttagagaatcagaacagaatgagaaatgtggctcccacttatttgctcattttcccttttatgtaacaaattgcttcattacataaaatcgagcttttatgtaaaattttctatgtattttagtacataaaagcccattggtccaggccctcttgagctcagccatgtttttggttgtgactgtctctatttttaaatttattttattttttgatacagtctg

SEQ ID NO: 410106 - DNA, 689 bp, Homo sapiens
gcaagcccaaggctcagaaagttaatttctaactttaaatagctagtaaatggctgacacaggactaaactcagctctgctcaactcagacacctgtttttctatttctcccaagttgattctcaaactgcaggaaatctttgtgttttccccttttaagtaagaagcagaccactattagggtgagtgggtagagggagcataaggtgaagtaagccattcctaaaataattgggatataattggaagcatttgctgaccctttccacctcatggttgtaggatattacaagtatgttttctttaagaatgctcaataagccaacatagataaatttgaattttaaacatagataattaatagagtgattatattaattaatcagaaccagtattataggtctcatctactgaacatttcttttaactttcagctcttttggtgcacttctgttctggataaaatataattgtatgctcagaggacagaaaaattttacaaatgagcttaggcttccctgccagaaaagaaaggatgaaatagaaatgaaaatgaaaattaagtaatccctgaaatgataatatagttaaatgtgaaaatatgcctttgataataccaaactgggatttgcacccaaaacacattaattggattaacctgttttagtttgtcttgtatctgttgccga

SEQ ID NO: 410107 - DNA, 1729 bp, Homo sapiens
  misc_feature (692)..(692): n is a, c, g, or t
  misc_feature (697)..(698): n is a, c, g, or t
  misc_feature (701)..(701): n is a, c, g, or t
  misc_feature (723)..(724): n is a, c, g, or t
  misc_feature (737)..(737): n is a, c, g, or t
  misc_feature (820)..(820): n is a, c, g, or t
  misc_feature (1404)..(1405): n is a, c, g, or t
  misc_feature (1609)..(1609): n is a, c, g, or t
  misc_feature (1640)..(1640): n is a, c, g, or t
  misc_feature (1645)..(1645): n is a, c, g, or t
catgaatgtttatggcagctttatccataattgccaaaacttggaagcgatcaagccatgaaaagacattgctgagaagaagccaatctgaaaaggctacacatcctgtataattccagccgtattctggaaaaggcaaagctgtggagacagtcaaaagatcaggagttgccaggggtttgttgtcagtggttgccaaaggcaaggatgaataaggagaacacaggggattttatgtgataagtatcatacctaaaaatcccctgtgttcatatcatgtataaataaatgtacatagacatatacacatatatatatataaatcatgtgtatgcaatgacatgtatctatcctgtcattctgtattggtcaaaatatcaaaatccacagaatgtacaacacaaagagtgaactctaatgtaaactgtggactttagttaatactaatgtgtcaatattggcttatcagttctaacaaatgtaccacactaatgcaatagtaggaaaaactgtccaatctaaacactgggcaaaggattttaaaagatatttcacaaaggaagatatgaaaatggcaaatcagcatgtgaaaagatggttaatatctttttttttttttttttgagtctctctgttgcctaggctggagtgcaatggcatgattgccgcccgctgcgacctctgcctctcangttcnngcnattctcgtgcctcagccttccnngtagctgggattncaggtgtgcaccactatgcctggataattttttttgtattttcagtagagatggggtttctccattttggccaggctggtctngaacttctggcctcaagtgatccacccgccttggcttcccaaagtgccaggattacaggtgtgacccactgctcccggccaagatacttaacatctttaatcatcaaggaaatgcaaattaaaactacagtgcaataccactgcatacccattagaatgcccaaaattttaaaaactgaccataccaagtgatggcaagtgatggcaagggtgtggaacaatttgaacttttacattgctaatggcatgtaaagtggtatagcaaatttggaacattgttcagcaatttctcataaagttaatcatacatttaccatgtaacccaacagttcaacttttaggtatttaaccaagagaaatgaaagtccacgtccataaagatacttgactacaaatatccatacagttttattcaaaatagccccaaactgggtgggcgcggtggctcacacctgtaatcccaacattttgggaggctgaggcgggcagatcacttgaggtcaggagttcaagaccagtctggccaacatggtgaaactccatctctactaaaaaaaaatacaaaactaggctaacatggtgannccccatctctactaaaactacaaaaaaaaaaaaaacaaatcagccgggcggctactcaggaggctgaggcaggagaatggcctgaacccgggaggcagagctggcagtgagccgagatcgcgccactgcaccccagcctgggcgacagaatgagactctgtctcaaaaaaaaaaaaaagccaggtgtggtggcgggcgcctgtnatcacagcttctagggaggctgaggcacganaatcncttgaacctgggaggtggaggttgcagttagccgagatcgcaccattgcattccagcctgtactacaaagtgagactctgtccc

SEQ ID NO: 410108 - DNA, 4978 bp, Homo sapiens
cacgctcacaccacacgcacaccacaaaacaaagaacaggtaaaaagggcacacatacacttttaccgtttacaccaaaccagaatcaaaatccaaatcagagtatccagaaatccaagccaggtcaaaaccaaaacgaaagtatcaagcaatccaaatcaagtcaaaaacaaaaaccaaagtgccggtacaggcatgccgtgggtgatcaggccacccttccactcaaatggagtgggcaagttccaaagactagtcttaccaagtttcagatgtccggactccaagtgcctgttccttcccagtgttcagccgctgcattgatcctctgtgggggcctgccacacgccactctggcgaggtgttccactggggcaattgcctacccgggagtgctctcaggttctgcgtccctcaagctggccagagtcccctgtagggatgctccacagggcaggcctaagctgcctaaggggctgcctcgactatctgttaatcacctggcttcccagtcagggaaccaagaaatgtagcaggacaagccgcagggctgtattcagcctggagctttggcaagactcacatctccaactaccaagctccccaagtgaggaattcctgtcccttttaagggcttacaactctaagggggtccacatgagaggtttgtgatcgattgagcaagcagggggtacacgactgggggctgcatgcagtggtaatcagaacggaacagaacaggacagggattttcacaatgcttttccatacaatgtctggaatccatagataacataaccggtttggtcaggggtcgatctttaaccaggcccagggttggcacctggctgtctgcctgtggatttcatttctgccttttagtttttacttgtttctttggaggcagaaattgggcataaaacaatatgagaggtggtctcctcccttaacagcacaaacgcttaattaacatttctttttcttttgagacaggttctgtcgcccaggctggagtgcagtggtgcagtcatagctcagtgcagcctggaccacctgggctcaagcagtcctgacacctcagcctctcaaaatttgggattacaggcgcgcgccaccgtgcgggtcaggaggcttccctgagggccccggaggtggagctgggcttttccttccgaagcgcccctgggaatctctctctttacggccttggaacctgggaaactacattacccagaaagctctgcgtcaaatgacagcacggcagagccagtgagagttcacattgaaggcgtttccgtgtgcgcaagtaaggtagaggcgggactcccggcgccctttagtagcgaccatttccattggcgttagggagtccttggagcgctgtgttgggaccgtggtggtgactggatccaggaggtcgagagtcgttcttctctttgcacagacgtgactctgcagctctttaacggcgcccgctgctctcaacccagcttaccccacgtggtcccatggcggcggccgcgctaaggttccccgttcaggtaattgtggcgccttccgtgctctccggtcacctcctagtcacacaagtcctaaagcagcgagggagcggcacctgcttacggctctgcaacccggacccggcgtcgggacactgaggcgctctcgggagggatccctgtttcagacacccgtgggatgcggtggggagagcgacaggtacagggaggggcgcgggcaatggcctggagatggacggatccgggaggatggaacctggggtccacaggcgcctgtagggaacaacctgtgaggcggaactcctcctggaaaagcaaggaggctgggggctgtgaaatcattgcgaggacactagaaataggagaatttccaagaaagaagggactggatcaaagtccaggcttttaaagtttcctaaaggccaaataaataacagagtagagaggggatgacgttggggccctttgagattgaatccttgtagatcatataggtggtagagatgacactttgtgctgagacacgcaggttagacaatagtccaaggtcacctggctccgtggacacaaaagcgttcagggaggcctgagcttaccagatcctatcagggacacagtcctgtaaagtcagcctcttccctcaggcctttatggctgtagaagcatttaaggaacgcatacaagaaagtggagggtggggccgggtgcagtggctcactcctgtaatcccagcactttgggaggcctaggcgggttggtccggaggtagagaccagcctgaccaaccatggagaaaccctgtctctactaaaaatacaaaattagccaggcgtggtggcgcatgcctgtaatcccagctacttgggaaactgaggcagcagactcgcttgaacccgggaggcggaggttgcgtgagccgagatcgcgccattgcactccaccctgggtgacagagcgagactccgtatcaaaaaaaaaaaaaaaaaaaaaaaaaaaagaatgaggtgcgttcagagagggtatctctgctgtgctgaaggtgccacattgggctttccatgacctcggccatactaggggaagtgcctgtcaggagggggtggactcttatatcacagccaccgcacagatacctatttgttcaactaactattgttgttggtggctgtaccccatgaccagtgggcctagtttctcctatgtttgaggaccttgagaggaggatgtgcgagagtagatgtgtgggagagatggattgtgatacctcagcataggggtggtttgtggtttcatctgtcaacatcataacagggcacagtgacttttgaagacgtggctgtgaaatttacccaggaggaatggaatctccttagtgaggctcagagatgcctgtaccgtgatgtgacgctggagaacctggcacttatgtcctccctgggttgttggtgtggagtggaagatgaggcggcaccttctaagcagagtatttatatacaaagagagactcaggtcaggactcctatggcaggtgtgtctcccaagaaggcccacccctgtgagatgtgtggcccgatcttgggagacattttgcatgtggcagatcatcagggaacacatcacaagcagaaactgcacaggtgtgaggcctgggggaataaattgtatgacagtggaaactttcatcagcaccagaatgagcacattggagagaaaccctacagagggagtgttgaggaggcgttgtttgcgaagaggtgtaagttgcatgtgtcaggggagtcatctgtcttcagtgagagtgggaaagactttttgctcaggtcaggattactccagcaagaggccactcacactgggaagtcaaacagcaaaactgagtgtgtgtctctgtttcatgggggaaaaagccattacagctgtggaggatgcatgaaacattttagcaccaaagatatactcagtcagcacgagagactgctccctacagaagaaccttctgtgtggtgtgaatgtgggaaatcctctagcaaatatgacagcttcagtaatcatcaaggagttcacactagagaaaaaccttatacgtgtgggatatgtgggaaattatttaacagtaagtcccacctccttgtacaccagagaattcacactggagagaagccatatgagtgtgaggtttgtcagaaattttttaggcacaagtaccacctcattgcacaccagagagttcacactggagaaaggccatatgaatgcagtgattgtgggaagtcatttacccacagctctacattccgtgttcataagagagttcacactggtcagaagccttatgagtgcagtgaatgtgggaaatcttttgccgaaagctccagtctcactaaacacaggagagttcacactggagaaaagccttacgggtgcagtgaatgtgaaaaaaaatttaggcaaatctcttcacttcgtcatcatcagagagttcacaaaagaaagggcttatgagtgcagtgagtccagtctcattaaatattggagaatacacacctgagtaagatcctgtgattgcagcaaatgtggaaaatgtttacccaaaggtctgctctccttggatattggagagttcacactagagaagagtccttacaagtaaaataaatttgggcagttttgtagccacacctctgtattccttcaggattatagttaacactgaatgaaggccttactagtgtgacaaatacaggatatttatccagaagtctggctgcataactcacaggagagctgtcatgtgggaggattgctacatgggaggatttgcttgagcctgggaggcagaggttgcagtgagccgagattgcaacactgcagtccagtctggaccacagagtgagaccctgtttcaaaaataaaatatataaatgacatccaataaagtatgcatatttgagctgtaggataagtcttgaattttctttttcttttttttgagacagcctcgctctgtcacccaggctggagtacagtggcataatctcggctcactgcaagccctgcctcctgggttcatgccattctcctgcctcagcctccctaatagctgggactacaggcaaccaccaccactcctaccttttttgtatttttagtagagatggggtttcaccctgttagccaggaagttctcaatctcctgacctcgtgatctgcccgccttggcctctcaaagtgttgggattgcaggcgtgagccactgctcctggcttgaattttcttataatcccatgaaaccatcatcagagtcacaataatgaatttatctaatctatcacctttgtattcacctggagcctttataaagtttttctctatgcagacaaccattgatttactctgctgtataatactttccattttctagaattttctgactgatgtaataaagtgtttcctcttat

SEQ ID NO: 410109 - DNA, 3689 bp, Homo sapiens
cacgctcacaccacacgcacaccacaaaacaaagaacaggtaaaaagggcacacatacacttttaccgtttacaccaaaccagaatcaaaatccaaatcagagtatccagaaatccaagccaggtcaaaaccaaaacgaaagtatcaagcaatccaaatcaagtcaaaaacaaaaaccaaagtgccggtacaggcatgccgtgggtgatcaggccacccttccactcaaatggagtgggcaagttccaaagactagtcttaccaagtttcagatgtccggactccaagtgcctgttccttcccagtgttcagccgctgcattgatcctctgtgggggcctgccacacgccactctggcgaggtgttccactggggcaattgcctacccgggagtgctctcaggttctgcgtccctcaagctggccagagtcccctgtagggatgctccacagggcaggcctaagctgcctaaggggctgcctcgactatctgttaatcacctggcttcccagtcagggaaccaagaaatgtagcaggacaagccgcagggctgtattcagcctggagctttggcaagactcacatctccaactaccaagctccccaagtgaggaattcctgtcccttttaagggcttacaactctaagggggtccacatgagaggtttgtgatcgattgagcaagcagggggtacacgactgggggctgcatgcagtggtaatcagaacggaacagaacaggacagggattttcacaatgcttttccatacaatgtctggaatccatagataacataaccggtttggtcaggggtcgatctttaaccaggcccagggttggcacctggctgtctgcctgtggatttcatttctgccttttagtttttacttgtttctttggaggcagaaattgggcataaaacaatatgagaggtggtctcctcccttaacagcacaaacgcttaattaacatttctttttcttttgagacaggttctgtcgcccaggctggagtgcagtggtgcagtcatagctcagtgcagcctggaccacctgggctcaagcagtcctgacacctcagcctctcaaaatttgggattacaggcgcgcgccaccgtgcgggtcaggaggcttccctgagggccccggaggtggagctgggcttttccttccgaagcgcccctgggaatctctctctttacggccttggaacctgggaaactacattacccagaaagctctgcgtcaaatgacagcacggcagagccagtgagagttcacattgaaggcgtttccgtgtgcgcaagtaaggtagaggcgggactcccggcgccctttagtagcgaccatttccattggcgttagggagtccttggagcgctgtgttgggaccgtggtggtgactggatccaggaggtcgagagtcgttcttctctttgcacagacgtgactctgcagctctttaacggcgcccgctgctctcaacccagcttaccccacgtggtcccatggcggcggccgcgctaaggttccccgttcaggggcacagtgacttttgaagacgtggctgtgaaatttacccaggaggaatggaatctccttagtgaggctcagagatgcctgtaccgtgatgtgacgctggagaacctggcacttatgtcctccctgggttgttggtgtggagtggaagatgaggcggcaccttctaagcagagtatttatatacaaagagagactcaggtcaggactcctatggcaggtgtgtctcccaagaaggcccacccctgtgagatgtgtggcccgatcttgggagacattttgcatgtggcagatcatcagggaacacatcacaagcagaaactgcacaggtgtgaggcctgggggaataaattgtatgacagtggaaactttcatcagcaccagaatgagcacattggagagaaaccctacagagggagtgttgaggaggcgttgtttgcgaagaggtgtaagttgcatgtgtcaggggagtcatctgtcttcagtgagagtgggaaagactttttgctcaggtcaggattactccagcaagaggccactcacactgggaagtcaaacagcaaaactgagtgtgtgtctctgtttcatgggggaaaaagccattacagctgtggaggatgcatgaaacattttagcaccaaagatatactcagtcagcacgagagactgctccctacagaagaaccttctgtgtggtgtgaatgtgggaaatcctctagcaaatatgacagcttcagtaatcatcaaggagttcacactagagaaaaaccttatacgtgtgggatatgtgggaaattatttaacagtaagtcccacctccttgtacaccagagaattcacactggagagaagccatatgagtgtgaggtttgtcagaaattttttaggcacaagtaccacctcattgcacaccagagagttcacactggagaaaggccatatgaatgcagtgattgtgggaagtcatttacccacagctctacattccgtgttcataagagagttcacactggtcagaagccttatgagtgcagtgaatgtgggaaatcttttgccgaaagctccagtctcactaaacacaggagagttcacactggagaaaagccttacgggtgcagtgaatgtgaaaaaaaatttaggcaaatctcttcacttcgtcatcatcagagagttcacaaaagaaagggcttatgagtgcagtgagtccagtctcattaaatattggagaatacacacctgagtaagatcctgtgattgcagcaaatgtggaaaatgtttacccaaaggtctgctctccttggatattggagagttcacactagagaagagtccttacaagtaaaataaatttgggcagttttgtagccacacctctgtattccttcaggattatagttaacactgaatgaaggccttactagtgtgacaaatacaggatatttatccagaagtctggctgcataactcacaggagagctgtcatgtgggaggattgctacatgggaggatttgcttgagcctgggaggcagaggttgcagtgagccgagattgcaacactgcagtccagtctggaccacagagtgagaccctgtttcaaaaataaaatatataaatgacatccaataaagtatgcatatttgagctgtaggataagtcttgaattttctttttcttttttttgagacagcctcgctctgtcacccaggctggagtacagtggcataatctcggctcactgcaagccctgcctcctgggttcatgccattctcctgcctcagcctccctaatagctgggactacaggcaaccaccaccactcctaccttttttgtatttttagtagagatggggtttcaccctgttagccaggaagttctcaatctcctgacctcgtgatctgcccgccttggcctctcaaagtgttgggattgcaggcgtgagccactgctcctggcttgaattttcttataatcccatgaaaccatcatcagagtcacaataatgaatttatctaatctatcacctttgtattcacctggagcctttataaagtttttctctatgcagacaaccattgatttactctgctgtataatactttccattttctagaattttctgactgatgtaataaagtgtttcctcttat

SEQ ID NO: 410110 - DNA, 2563 bp, Homo sapiens
aaatcctttaactgatttgtacatgagcttgtagtctgatatttattcccctgaataatcttcacatctctggacctcacatcttaattttattcacatcttcatctgcagtggtttccagtattagcatacaggttttgtgttagcaaatgtgtacactttgttaaactgtcctcaagcagaagctgctgtgttgtgcttgtgttttccttggcctggacaaatccctctctacagcactcgcatgtcatgaggacataaattctgcagatgagtggtttgcagatgcagggattgtagaccctgcctctactccctgtgttacatacatggttgtgtcctttatgttatgaggcctcctacattctgtgaccattatagtccagtaataatacatagcaccatcttccacctgaagccaacatcctgttcctccaagtacttccttggagtaattcctcagtttttcagatacacttgtgggtggtctgtgccttcccaccagagttaacatgcacttcaccagcattttcttgctttcaggttgttggtgtggagtggaagatgaggcggcaccttctaagcagagtatttatatacaaagagagactcaggtcaggactcctatggcaggtgtgtctcccaagaaggcccacccctgtgagatgtgtggcccgatcttgggagacattttgcatgtggcagatcatcagggaacacatcacaagcagaaactgcacaggtgtgaggcctgggggaataaattgtatgacagtggaaactttcatcagcaccagaatgagcacattggagagaaaccctacagagggagtgttgaggaggcgttgtttgcgaagaggtgtaagttgcatgtgtcaggggagtcatctgtcttcagtgagagtgggaaagactttttgctcaggtcaggattactccagcaagaggccactcacactgggaagtcaaacagcaaaactgagtgtgtgtctctgtttcatgggggaaaaagccattacagctgtggaggatgcatgaaacattttagcaccaaagatatactcagtcagcacgagagactgctccctacagaagaaccttctgtgtggtgtgaatgtgggaaatcctctagcaaatatgacagcttcagtaatcatcaaggagttcacactagagaaaaaccttatacgtgtgggatatgtgggaaattatttaacagtaagtcccacctccttgtacaccagagaattcacactggagagaagccatatgagtgtgaggtttgtcagaaattttttaggcacaagtaccacctcattgcacaccagagagttcacactggagaaaggccatatgaatgcagtgattgtgggaagtcatttacccacagctctacattccgtgttcataagagagttcacactggtcagaagccttatgagtgcagtgaatgtgggaaatcttttgccgaaagctccagtctcactaaacacaggagagttcacactggagaaaagccttacgggtgcagtgaatgtgaaaaaaaatttaggcaaatctcttcacttcgtcatcatcagagagttcacaaaagaaagggcttatgagtgcagtgagtccagtctcattaaatattggagaatacacacctgagtaagatcctgtgattgcagcaaatgtggaaaatgtttacccaaaggtctgctctccttggatattggagagttcacactagagaagagtccttacaagtaaaataaatttgggcagttttgtagccacacctctgtattccttcaggattatagttaacactgaatgaaggccttactagtgtgacaaatacaggatatttatccagaagtctggctgcataactcacaggagagctgtcatgtgggaggattgctacatgggaggatttgcttgagcctgggaggcagaggttgcagtgagccgagattgcaacactgcagtccagtctggaccacagagtgagaccctgtttcaaaaataaaatatataaatgacatccaataaagtatgcatatttgagctgtaggataagtcttgaattttctttttcttttttttgagacagcctcgctctgtcacccaggctggagtacagtggcataatctcggctcactgcaagccctgcctcctgggttcatgccattctcctgcctcagcctccctaatagctgggactacaggcaaccaccaccactcctaccttttttgtatttttagtagagatggggtttcaccctgttagccaggaagttctcaatctcctgacctcgtgatctgcccgccttggcctctcaaagtgttgggattgcaggcgtgagccactgctcctggcttgaattttcttataatcccatgaaaccatcatcagagtcacaataatgaatttatctaatctatcacctttgtattcacctggagcctttataaagtttttctctatgcagacaaccattgatttactctgctgtataatactttccattttctagaattttctgactgatgtaataaagtgtttcctcttat

SEQ ID NO: 410111 - DNA, 5402 bp, Homo sapiens
cacgctcacaccacacgcacaccacaaaacaaagaacaggtaaaaagggcacacatacacttttaccgtttacaccaaaccagaatcaaaatccaaatcagagtatccagaaatccaagccaggtcaaaaccaaaacgaaagtatcaagcaatccaaatcaagtcaaaaacaaaaaccaaagtgccggtacaggcatgccgtgggtgatcaggccacccttccactcaaatggagtgggcaagttccaaagactagtcttaccaagtttcagatgtccggactccaagtgcctgttccttcccagtgttcagccgctgcattgatcctctgtgggggcctgccacacgccactctggcgaggtgttccactggggcaattgcctacccgggagtgctctcaggttctgcgtccctcaagctggccagagtcccctgtagggatgctccacagggcaggcctaagctgcctaaggggctgcctcgactatctgttaatcacctggcttcccagtcagggaaccaagaaatgtagcaggacaagccgcagggctgtattcagcctggagctttggcaagactcacatctccaactaccaagctccccaagtgaggaattcctgtcccttttaagggcttacaactctaagggggtccacatgagaggtttgtgatcgattgagcaagcagggggtacacgactgggggctgcatgcagtggtaatcagaacggaacagaacaggacagggattttcacaatgcttttccatacaatgtctggaatccatagataacataaccggtttggtcaggggtcgatctttaaccaggcccagggttggcacctggctgtctgcctgtggatttcatttctgccttttagtttttacttgtttctttggaggcagaaattgggcataaaacaatatgagaggtggtctcctcccttaacagcacaaacgcttaattaacatttctttttcttttgagacaggttctgtcgcccaggctggagtgcagtggtgcagtcatagctcagtgcagcctggaccacctgggctcaagcagtcctgacacctcagcctctcaaaatttgggattacaggcgcgcgccaccgtgcgggtcaggaggcttccctgagggccccggaggtggagctgggcttttccttccgaagcgcccctgggaatctctctctttacggccttggaacctgggaaactacattacccagaaagctctgcgtcaaatgacagcacggcagagccagtgagagttcacattgaaggcgtttccgtgtgcgcaagtaaggtagaggcgggactcccggcgccctttagtagcgaccatttccattggcgttagggagtccttggagcgctgtgttgggaccgtggtggtgactggatccaggaggtcgagagtcgttcttctctttgcacagacgtgactctgcagctctttaacggcgcccgctgctctcaacccagcttaccccacgtggtcccatggcggcggccgcgctaaggttccccgttcaggtaattgtggcgccttccgtgctctccggtcacctcctagtcacacaagtcctaaagcagcgagggagcggcacctgcttacggctctgcaacccggacccggcgtcgggacactgaggcgctctcgggagggatccctgtttcagacacccgtgggatgcggtggggagagcgacaggtacagggaggggcgcgggcaatggcctggagatggacggatccgggaggatggaacctggggtccacaggcgcctgtagggaacaacctgtgaggcggaactcctcctggaaaagcaaggaggctgggggctgtgaaatcattgcgaggacactagaaataggagaatttccaagaaagaagggactggatcaaagtccaggcttttaaagtttcctaaaggccaaataaataacagagtagagaggggatgacgttggggccctttgagattgaatccttgtagatcatataggtggtagagatgacactttgtgctgagacacgcaggttagacaatagtccaaggtcacctggctccgtggacacaaaagcgttcagggaggcctgagcttaccagatcctatcagggacacagtcctgtaaagtcagcctcttccctcaggcctttatggctgtagaagcatttaaggaacgcatacaagaaagtggagggtggggccgggtgcagtggctcactcctgtaatcccagcactttgggaggcctaggcgggttggtccggaggtagagaccagcctgaccaaccatggagaaaccctgtctctactaaaaatacaaaattagccaggcgtggtggcgcatgcctgtaatcccagctacttgggaaactgaggcagcagactcgcttgaacccgggaggcggaggttgcgtgagccgagatcgcgccattgcactccaccctgggtgacagagcgagactccgtatcaaaaaaaaaaaaaaaaaaaaaaaaaaaagaatgaggtgcgttcagagagggtatctctgctgtgctgaaggtgccacattgggctttccatgacctcggccatactaggggaagtgcctgtcaggagggggtggactcttatatcacagccaccgcacagatacctatttgttcaactaactattgttgttggtggctgtaccccatgaccagtgggcctagtttctcctatgtttgaggaccttgagaggaggatgtgcgagagtagatgtgtgggagagatggattgtgatacctcagcataggggtggtttgtggtttcatctgtcaacatcataacagggcacagtgacttttgaagacgtggctgtgaaatttacccaggaggaatggaatctccttagtgaggctcagagatgcctgtaccgtgatgtgacgctggagaacctggcacttatgtcctccctgggttgttggtgtggagtggaagatgaggcggcaccttctaagcagagtatttatatacaaagagagactcaggtcaggactcctatggcaggtgtgtctcccaagaaggcccacccctgtgagatgtgtggcccgatcttgggagacattttgcatgtggcagatcatcagggaacacatcacaagcagaaactgcacaggtgtgaggcctgggggaataaattgtatgacagtggaaactttcatcagcaccagaatgagcacattggagagaaaccctacagagggagtgttgaggaggcgttgtttgcgaagaggtgtaagttgcatgtgtcaggggagtcatctgtcttcagtgagagtgggaaagactttttgctcaggtcaggattactccagcaagaggccactcacactgggaagtcaaacagcaaaactgagtgtgtgtctctgtttcatgggggaaaaagccattacagctgtggaggatgcatgaaacattttagcaccaaagatatactcagtcagcacgagagactgctccctacagaagaaccttctgtgtggtgtgaatgtgggaaatcctctagcaaatatgacagcttcagtaatcatcaaggagttcacactagagaaaaaccttatacgtgtgggatatgtgggaaattatttaacagtaagtcccacctccttgtacaccagagaattcacactggagagaagccatatgagtgtgaggtttgtcagaaattttttaggcacaagtaccacctcattgcacaccagagagttcacactggagaaaggccatatgaatgcagtgattgtgggaagtcatttacccacagctctacattccgtgttcataagagagttcacactggtcagaagccttatgagtgcagtgaatgtgggaaatcttttgccgaaagctccagtctcactaaacacaggagagttcacactggagaaaagccttacgggtgcagtgaatgtgaaaaaaaatttaggcaaatctcttcacttcgtcatcatcagagagttcacaaaagaaagggcttatgagtgcagtgagtccagtctcattaaatattggagaatacacacctgagtaagatcctgtgattgcagcaaatgtggaaaatgtttacccaaaggtctgctctccttggatattggagagttcacactagagaagagtccttacaagtaaaataaatttgggcagttttgtagccacacctctgtattccttcaggattatagttaacactgaatgaaggccttactagtgtgacaaatacaggatatttatccagaagtctggctgcataactcacaggagagctgtcatgtgggaggattgctacatgggaggatttgcttgagcctgggaggcagaggttgcagtgagccgagattgcaacactgcagtccagtctggaccacagagtgagaccctgtttcaaaaataaaatatataaatgacatccaataaagtatgcatatttgagctgtaggataagtcttgaattttctttttcttttttttgagacagcctcgctctgtcacccaggctggagtacagtggcataatctcggctcactgcaagccctgcctcctgggttcatgccattctcctgcctcagcctccctaatagctgggactacaggcaaccaccaccactcctaccttttttgtatttttagtagagatggggtttcaccctgttagccaggaagttctcaatctcctgacctcgtgatctgcccgccttggcctctcaaagtgttgggattgcaggcgtgagccactgctcctggcttgaattttcttataatcccatgaaaccatcatcagagtcacaataatgaatttatctaatctatcacctttgtattcacctggagcctttataaagtttttctctatgcagacaaccattgatttactctgctgtataatactttccattttctagaattttctgactgatgtaataaagtgtttcctcttataatccctgggtgctctcctgcatcatgcttattttgatatcaatgtagacatgagttaatttgttgtatattgctgagaagtatagtctgccatgaaatgtcattatatattcattcatccgtttatggatatttgagttgctgcttgtgtttttttgtgttttttttttgaggtggagtctcactctgtcccccaggctggagtgcagtggggcaatctcaggtcactgcaagctctgccttccgggttcacgccattgtcctgcctcagccagtcctgtggactacaggcgcccgcaaacacgcctggctaattttttgtatttttagtagagacagggtttcactgtgttagccaggatcgtctcgatctcctgaccttgtgatccgcccatctcggcctcccatagtgctagcattacag

SEQ ID NO: 410112 - DNA, 3741 bp, Homo sapiens
cacgctcacaccacacgcacaccacaaaacaaagaacaggtaaaaagggcacacatacacttttaccgtttacaccaaaccagaatcaaaatccaaatcagagtatccagaaatccaagccaggtcaaaaccaaaacgaaagtatcaagcaatccaaatcaagtcaaaaacaaaaaccaaagtgccggtacaggcatgccgtgggtgatcaggccacccttccactcaaatggagtgggcaagttccaaagactagtcttaccaagtttcagatgtccggactccaagtgcctgttccttcccagtgttcagccgctgcattgatcctctgtgggggcctgccacacgccactctggcgaggtgttccactggggcaattgcctacccgggagtgctctcaggttctgcgtccctcaagctggccagagtcccctgtagggatgctccacagggcaggcctaagctgcctaaggggctgcctcgactatctgttaatcacctggcttcccagtcagggaaccaagaaatgtagcaggacaagccgcagggctgtattcagcctggagctttggcaagactcacatctccaactaccaagctccccaagtgaggaattcctgtcccttttaagggcttacaactctaagggggtccacatgagaggtttgtgatcgattgagcaagcagggggtacacgactgggggctgcatgcagtggtaatcagaacggaacagaacaggacagggattttcacaatgcttttccatacaatgtctggaatccatagataacataaccggtttggtcaggggtcgatctttaaccaggcccagggttggcacctggctgtctgcctgtggatttcatttctgccttttagtttttacttgtttctttggaggcagaaattgggcataaaacaatatgagaggtggtctcctcccttaacagcacaaacgcttaattaacatttctttttcttttgagacaggttctgtcgcccaggctggagtgcagtggtgcagtcatagctcagtgcagcctggaccacctgggctcaagcagtcctgacacctcagcctctcaaaatttgggattacaggcgcgcgccaccgtgcgggtcaggaggcttccctgagggccccggaggtggagctgggcttttccttccgaagcgcccctgggaatctctctctttacggccttggaacctgggaaactacattacccagaaagctctgcgtcaaatgacagcacggcagagccagtgagagttcacattgaaggcgtttccgtgtgcgcaagtaaggtagaggcgggactcccggcgccctttagtagcgaccatttccattggcgttagggagtccttggagcgctgtgttgggaccgtggtggtgactggatccaggaggtcgagagtcgttcttctctttgcacagacgtgactctgcagctctttaacggcgcccgctgctctcaacccagcttaccccacgtggtcccatggcggcggccgcgctaaggttccccgttcaggtaattgtggcgccttccgtgctctccggtcacctcctagtcacacaagtcctaaagcagcgagggagcggcacctgcttacggctctgcaacccggacccggcgtcgggacactgaggcgctctcgggagggatccctgtttcagacacccgtgggatgcggtggggagagcgacaggtacagggaggggcgcgggcaatggcctggagatggacggatccgggaggatggaacctggggtccacaggcgcctgtagggaacaacctgtgaggcggaactcctcctggaaaagcaaggaggctgggggctgtgaaatcattgcgaggacactagaaataggagaatttccaagaaagaagggactggatcaaagtccaggcttttaaagtttcctaaaggccaaataaataacagagtagagaggggatgacgttggggccctttgagattgaatccttgtagatcatataggtggtagagatgacactttgtgctgagacacgcaggttagacaatagtccaaggtcacctggctccgtggacacaaaagcgttcagggaggcctgagcttaccagatcctatcagggacacagtcctgtaaagtcagcctcttccctcaggcctttatggctgtagaagcatttaaggaacgcatacaagaaagtggagggtggggccgggtgcagtggctcactcctgtaatcccagcactttgggaggcctaggcgggttggtccggaggtagagaccagcctgaccaaccatggagaaaccctgtctctactaaaaatacaaaattagccaggcgtggtggcgcatgcctgtaatcccagctacttgggaaactgaggcagcagactcgcttgaacccgggaggcggaggttgcgtgagccgagatcgcgccattgcactccaccctgggtgacagagcgagactccgtatcaaaaaaaaaaaaaaaaaaaaaaaaaaaagaatgaggtgcgttcagagagggtatctctgctgtgctgaaggtgccacattgggctttccatgacctcggccatactaggggaagtgcctgtcaggagggggtggactcttatatcacagccaccgcacagatacctatttgttcaactaactattgttgttggtggctgtaccccatgaccagtgggcctagtttctcctatgtttgaggaccttgagaggaggatgtgcgagagtagatgtgtgggagagatggattgtgatacctcagcataggggtggtttgtggtttcatctgtcaacatcataacagggcacagtgacttttgaagacgtggctgtgaaatttacccaggaggaatggaatctccttagtgaggctcagagatgcctgtaccgtgatgtgacgctggagaacctggcacttatgtcctccctgggttgttggtgtggagtggaagatgaggcggcaccttctaagcagatttagtagagatggggtttcaccctgttagccaggaagttctcaatctcctgacctcgtgatctgcccgccttggcctctcaaagtgttgggattgcaggcgtgagccactgctcctggcttgaattttcttataatcccatgaaaccatcatcagagtcacaataatgaatttatctaatctatcacctttgtattcacctggagcctttataaagtttttctctatgcagacaaccattgatttactctgctgtataatactttccattttctagaattttctgactgatgtaataaagtgtttcctcttataatccctgggtgctctcctgcatcatgcttattttgatatcaatgtagacatgagttaatttgttgtatattgctgagaagtatagtctgccatgaaatgtcattatatattcattcatccgtttatggatatttgagttgctgcttgtgtttttttgtgttttttttttgaggtggagtctcactctgtcccccaggctggagtgcagtggggcaatctcaggtcactgcaagctctgccttccgggttcacgccattgtcctgcctcagccagtcctgtggactacaggcgcccgcaaacacgcctggctaattttttgtatttttagtagagacagggtttcactgtgttagccaggatcgtctcgatctcctgaccttgtgatccgcccatctcggcctcccatagtgctagcattacag

SEQ ID NO: 410113 - DNA, 3232 bp, Homo sapiens
cacgctcacaccacacgcacaccacaaaacaaagaacaggtaaaaagggcacacatacacttttaccgtttacaccaaaccagaatcaaaatccaaatcagagtatccagaaatccaagccaggtcaaaaccaaaacgaaagtatcaagcaatccaaatcaagtcaaaaacaaaaaccaaagtgccggtacaggcatgccgtgggtgatcaggccacccttccactcaaatggagtgggcaagttccaaagactagtcttaccaagtttcagatgtccggactccaagtgcctgttccttcccagtgttcagccgctgcattgatcctctgtgggggcctgccacacgccactctggcgaggtgttccactggggcaattgcctacccgggagtgctctcaggttctgcgtccctcaagctggccagagtcccctgtagggatgctccacagggcaggcctaagctgcctaaggggctgcctcgactatctgttaatcacctggcttcccagtcagggaaccaagaaatgtagcaggacaagccgcagggctgtattcagcctggagctttggcaagactcacatctccaactaccaagctccccaagtgaggaattcctgtcccttttaagggcttacaactctaagggggtccacatgagaggtttgtgatcgattgagcaagcagggggtacacgactgggggctgcatgcagtggtaatcagaacggaacagaacaggacagggattttcacaatgcttttccatacaatgtctggaatccatagataacataaccggtttggtcaggggtcgatctttaaccaggcccagggttggcacctggctgtctgcctgtggatttcatttctgccttttagtttttacttgtttctttggaggcagaaattgggcataaaacaatatgagaggtggtctcctcccttaacagcacaaacgcttaattaacatttctttttcttttgagacaggttctgtcgcccaggctggagtgcagtggtgcagtcatagctcagtgcagcctggaccacctgggctcaagcagtcctgacacctcagcctctcaaaatttgggattacaggcgcgcgccaccgtgcgggtcaggaggcttccctgagggccccggaggtggagctgggcttttccttccgaagcgcccctgggaatctctctctttacggccttggaacctgggaaactacattacccagaaagctctgcgtcaaatgacagcacggcagagccagtgagagttcacattgaaggcgtttccgtgtgcgcaagtaaggtagaggcgggactcccggcgccctttagtagcgaccatttccattggcgttagggagtccttggagcgctgtgttgggaccgtggtggtgactggatccaggaggtcgagagtcgttcttctctttgcacagacgtgactctgcagctctttaacggcgcccgctgctctcaacccagcttaccccacgtggtcccatggcggcggccgcgctaaggttccccgttcaggtaattgtggcgccttccgtgctctccggtcacctcctagtcacacaagtcctaaagcagcgagggagcggcacctgcttacggctctgcaacccggacccggcgtcgggacactgaggcgctctcgggagggatccctgtttcagacacccgtgggatgcggtggggagagcgacaggtacagggaggggcgcgggcaatggcctggagatggacggatccgggaggatggaacctggggtccacaggcgcctgtagggaacaacctgtgaggcggaactcctcctggaaaagcaaggaggctgggggctgtgaaatcattgcgaggacactagaaataggagaatttccaagaaagaagggactggatcaaagtccaggcttttaaagtttcctaaaggccaaataaataacagagtagagaggggatgacgttggggccctttgagattgaatccttgtagatcatataggtggtagagatgacactttgtgctgagacacgcaggttagacaatagtccaaggtcacctggctccgtggacacaaaagcgttcagggaggcctgagcttaccagatcctatcagggacacagtcctgtaaagtcagcctcttccctcaggcctttatggctgtagaagcatttaaggaacgcatacaagaaagtggagggtggggccgggtgcagtggctcactcctgtaatcccagcactttgggaggcctaggcgggttggtccggaggtagagaccagcctgaccaaccatggagaaaccctgtctctactaaaaatacaaaattagccaggcgtggtggcgcatgcctgtaatcccagctacttgggaaactgaggcagcagactcgcttgaacccgggaggcggaggttgcgtgagccgagatcgcgccattgcactccaccctgggtgacagagcgagactccgtatcaaaaaaaaaaaaaaaaaaaaaaaaaaaagaatgaggtgcgttcagagagggtatctctgctgtgctgaaggtgccacattgggctttccatgacctcggccatactaggggaagtgcctgtcaggagggggtggactcttatatcacagccaccgcacagatacctatttgttcaactaactattgttgttggtggctgtaccccatgaccagtgggcctagtttctcctatgtttgaggaccttgagaggaggatgtgcgagagtagatgtgtgggagagatggattgtgatacctcagcataggggtggtttgtggtttcatctgtcaacatcataacagggcacagtgacttttgaagacgtggctgtgaaatttacccaggaggaatggaatctccttagtgaggctcagagatgcctgtaccgtgatgtgacgctggagaacctggcacttatgtcctccctgggttgttggtgtggagtggaagatgaggcggcaccttctaagcagatgttgggattgcaggcgtgagccactgctcctggcttgaattttcttataatcccatgaaaccatcatcagagtcacaataatgaatttatctaatctatcacctttgtattcacctggagcctttataaagtttttctctatgcagacaaccattgatttactctgctgtataatactttccattttctagaattttctgactgatgtaataaagtgtttcctcttat

SEQ ID NO: 410114 - DNA, 844 bp, Homo sapiens
  misc_feature (588)..(588): n is a, c, g, or t
agaaatccctattgttgggggggttgaacctcacacaaacctccagtagtaagaaaaatattcagaactccccttttctttcttctcagggaaagaaacagtagctccactcctgccggtccctcccctaggggagagggaagcagaggagaaaacagcagcataggtggctggcaaagacaaaggaaagaccagtagaagagaaagaaaccaaaaacagcaagcgcagagccaaacagccaggcaggtaggccaaaggttaagtccctctccccagccctgcggtttgtgaaaaagagggtgggcaccggctccgggaggagagcagaggaggtgaaaaggcgtaattcttgcaatttgcggcaggcatatctgccaagcctctaggctagtgactgcccggggcccagactgcagccacgcaaatcccactcagcccaagaaactaagtgtaaaaagaaaaggaaaaaaaaaaaagtaagaggggaaatcagggggaaaaaaaagaaaaacagcagcgcggggtcgggggcggggccttgtacgcgtacaaggccccgcaggatggagctgggtcaaggaccaggnagccctgactcccagaggttgccaccggggagaagcagcggtcctccatccagaacctaggggctgaagcaaaggcttgccaggacccttgaagatgcttttggctcacctcatttcaccccacgctctgctggctggcagaggagaaggcagtcgtttcctctctgaagagtatattttccggattgccctctggttagggtgcccatataaatcaggagtaatatatgaccgcgtgtgcatgcccaagtgtgtg

SEQ ID NO: 410115 - DNA, 808 bp, Homo sapiens
atgtcgcgtccggtaacggaggagacaatcatttcattattgctcgatgctcctacttagtgtatactagtttagtagagatggggtttcaccctgttagccaggaagttctcaatctcctgacctcgtgatctgcccgccttggcctctcaaagtgttgggattgcaggcgtgagccactgctcctggcttgaattttcttataatcccatgaaaccatcatcagagtcacaataatgaatttatctaatctatcacctttgtattcacctggagcctttataaagtttttctctatgcagacaaccattgatttactctgctgtataatactttccattttctagaattttctgactgatgtaataaagtgtttcctcttataatccctgggtgctctcctgcatcatgcttattttgatatcaatgtagacatgagttaatttgttgtatattgctgagaagtatagtctgccatgaaatgtcattatatattcattcatccgtttatggatatttgagttgctgcttgtgtttttttgtgttttttttttgaggtggagtctcactctgtcccccaggctggagtgcagtggggcaatctcaggtcactgcaagctctgccttccgggttcacgccattgtcctgcctcagccagtcctgtggactacaggcgcccgcaaacacgcctggctaattttttgtatttttagtagagacagggtttcactgtgttagccaggatcgtctcgatctcctgaccttgtgatccgcccatctcggcctcccatagtgctagcattacag

SEQ ID NO: 410116 - DNA, 3309 bp, Homo sapiens
cacgctcacaccacacgcacaccacaaaacaaagaacaggtaaaaagggcacacatacacttttaccgtttacaccaaaccagaatcaaaatccaaatcagagtatccagaaatccaagccaggtcaaaaccaaaacgaaagtatcaagcaatccaaatcaagtcaaaaacaaaaaccaaagtgccggtacaggcatgccgtgggtgatcaggccacccttccactcaaatggagtgggcaagttccaaagactagtcttaccaagtttcagatgtccggactccaagtgcctgttccttcccagtgttcagccgctgcattgatcctctgtgggggcctgccacacgccactctggcgaggtgttccactggggcaattgcctacccgggagtgctctcaggttctgcgtccctcaagctggccagagtcccctgtagggatgctccacagggcaggcctaagctgcctaaggggctgcctcgactatctgttaatcacctggcttcccagtcagggaaccaagaaatgtagcaggacaagccgcagggctgtattcagcctggagctttggcaagactcacatctccaactaccaagctccccaagtgaggaattcctgtcccttttaagggcttacaactctaagggggtccacatgagaggtttgtgatcgattgagcaagcagggggtacacgactgggggctgcatgcagtggtaatcagaacggaacagaacaggacagggattttcacaatgcttttccatacaatgtctggaatccatagataacataaccggtttggtcaggggtcgatctttaaccaggcccagggttggcacctggctgtctgcctgtggatttcatttctgccttttagtttttacttgtttctttggaggcagaaattgggcataaaacaatatgagaggtggtctcctcccttaacagcacaaacgcttaattaacatttctttttcttttgagacaggttctgtcgcccaggctggagtgcagtggtgcagtcatagctcagtgcagcctggaccacctgggctcaagcagtcctgacacctcagcctctcaaaatttgggattacaggcgcgcgccaccgtgcgggtcaggaggcttccctgagggccccggaggtggagctgggcttttccttccgaagcgcccctgggaatctctctctttacggccttggaacctgggaaactacattacccagaaagctctgcgtcaaatgacagcacggcagagccagtgagagttcacattgaaggcgtttccgtgtgcgcaagtaaggtagaggcgggactcccggcgccctttagtagcgaccatttccattggcgttagggagtccttggagcgctgtgttgggaccgtggtggtgactggatccaggaggtcgagagtcgttcttctctttgcacagacgtgactctgcagctctttaacggcgcccgctgctctcaacccagcttaccccacgtggtcccatggcggcggccgcgctaaggttccccgttcaggtaattgtggcgccttccgtgctctccggtcacctcctagtcacacaagtcctaaagcagcgagggagcggcacctgcttacggctctgcaacccggacccggcgtcgggacactgaggcgctctcgggagggatccctgtttcagacacccgtgggatgcggtggggagagcgacaggtacagggaggggcgcgggcaatggcctggagatggacggatccgggaggatggaacctggggtccacaggcgcctgtagggaacaacctgtgaggcggaactcctcctggaaaagcaaggaggctgggggctgtgaaatcattgcgaggacactagaaataggagaatttccaagaaagaagggactggatcaaagtccaggcttttaaagtttcctaaaggccaaataaataacagagtagagaggggatgacgttggggccctttgagattgaatccttgtagatcatataggtggtagagatgacactttgtgctgagacacgcaggttagacaatagtccaaggtcacctggctccgtggacacaaaagcgttcagggaggcctgagcttaccagatcctatcagggacacagtcctgtaaagtcagcctcttccctcaggcctttatggctgtagaagcatttaaggaacgcatacaagaaagtggagggtggggccgggtgcagtggctcactcctgtaatcccagcactttgggaggcctaggcgggttggtccggaggtagagaccagcctgaccaaccatggagaaaccctgtctctactaaaaatacaaaattagccaggcgtggtggcgcatgcctgtaatcccagctacttgggaaactgaggcagcagactcgcttgaacccgggaggcggaggttgcgtgagccgagatcgcgccattgcactccaccctgggtgacagagcgagactccgtatcaaaaaaaaaaaaaaaaaaaaaaaaaaaagaatgaggtgcgttcagagagggtatctctgctgtgctgaaggtgccacattgggctttccatgacctcggccatactaggggaagtgcctgtcaggagggggtggactcttatatcacagccaccgcacagatacctatttgttcaactaactattgttgttggtggctgtaccccatgaccagtgggcctagtttctcctatgtttgaggaccttgagaggaggatgtgcgagagtagatgtgtgggagagatggattgtgatacctcagcataggggtggtttgtggtttcatctgtcaacatcataacagggcacagtgacttttgaagacgtggctgtgaaatttacccaggaggaatggaatctccttagtgaggctcagagatgcctgtaccgtgatgtgacgctggagaacctggcacttatgtcctccctgggtaagttgcccacactcacccctgtgacctgagctagtctctgtctttccccctctttttctattggcaagactttctcatgtcaggagcatggacacagcttcctacttcagttcttggttggtaggactgaggtatgcatactgccctctccattcttggagcagccccaacacctgctattgagctcccagggaagaattcagagtcagaagtcttacaggcaacttaatgcaggctaccttgtttgtcctgtggatgtttgtgtgatttcatccagatttcaggttcgggatctaattcattctacctgttatttcttcatgcctccctgtgccaggaattgtcttc

SEQ ID NO: 410117 - DNA, 3867 bp, Homo sapiens
cacgctcacaccacacgcacaccacaaaacaaagaacaggtaaaaagggcacacatacacttttaccgtttacaccaaaccagaatcaaaatccaaatcagagtatccagaaatccaagccaggtcaaaaccaaaacgaaagtatcaagcaatccaaatcaagtcaaaaacaaaaaccaaagtgccggtacaggcatgccgtgggtgatcaggccacccttccactcaaatggagtgggcaagttccaaagactagtcttaccaagtttcagatgtccggactccaagtgcctgttccttcccagtgttcagccgctgcattgatcctctgtgggggcctgccacacgccactctggcgaggtgttccactggggcaattgcctacccgggagtgctctcaggttctgcgtccctcaagctggccagagtcccctgtagggatgctccacagggcaggcctaagctgcctaaggggctgcctcgactatctgttaatcacctggcttcccagtcagggaaccaagaaatgtagcaggacaagccgcagggctgtattcagcctggagctttggcaagactcacatctccaactaccaagctccccaagtgaggaattcctgtcccttttaagggcttacaactctaagggggtccacatgagaggtttgtgatcgattgagcaagcagggggtacacgactgggggctgcatgcagtggtaatcagaacggaacagaacaggacagggattttcacaatgcttttccatacaatgtctggaatccatagataacataaccggtttggtcaggggtcgatctttaaccaggcccagggttggcacctggctgtctgcctgtggatttcatttctgccttttagtttttacttgtttctttggaggcagaaattgggcataaaacaatatgagaggtggtctcctcccttaacagcacaaacgcttaattaacatttctttttcttttgagacaggttctgtcgcccaggctggagtgcagtggtgcagtcatagctcagtgcagcctggaccacctgggctcaagcagtcctgacacctcagcctctcaaaatttgggattacaggcgcgcgccaccgtgcgggtcaggaggcttccctgagggccccggaggtggagctgggcttttccttccgaagcgcccctgggaatctctctctttacggccttggaacctgggaaactacattacccagaaagctctgcgtcaaatgacagcacggcagagccagtgagagttcacattgaaggcgtttccgtgtgcgcaagtaaggtagaggcgggactcccggcgccctttagtagcgaccatttccattggcgttagggagtccttggagcgctgtgttgggaccgtggtggtgactggatccaggaggtcgagagtcgttcttctctttgcacagacgtgactctgcagctctttaacggcgcccgctgctctcaacccagcttaccccacgtggtcccatggcggcggccgcgctaaggttccccgttcaggtaattgtggcgccttccgtgctctccggtcacctcctagtcacacaagtcctaaagcagcgagggagcggcacctgcttacggctctgcaacccggacccggcgtcgggacactgaggcgctctcgggagggatccctgtttcagacacccgtgggatgcggtggggagagcgacaggggcacagtgacttttgaagacgtggctgtgaaatttacccaggaggaatggaatctccttagtgaggctcagagatgcctgtaccgtgatgtgacgctggagaacctggcacttatgtcctccctgggttgttggtgtggagtggaagatgaggcggcaccttctaagcagagtatttatatacaaagagagactcaggtcaggactcctatggcaggtgtgtctcccaagaaggcccacccctgtgagatgtgtggcccgatcttgggagacattttgcatgtggcagatcatcagggaacacatcacaagcagaaactgcacaggtgtgaggcctgggggaataaattgtatgacagtggaaactttcatcagcaccagaatgagcacattggagagaaaccctacagagggagtgttgaggaggcgttgtttgcgaagaggtgtaagttgcatgtgtcaggggagtcatctgtcttcagtgagagtgggaaagactttttgctcaggtcaggattactccagcaagaggccactcacactgggaagtcaaacagcaaaactgagtgtgtgtctctgtttcatgggggaaaaagccattacagctgtggaggatgcatgaaacattttagcaccaaagatatactcagtcagcacgagagactgctccctacagaagaaccttctgtgtggtgtgaatgtgggaaatcctctagcaaatatgacagcttcagtaatcatcaaggagttcacactagagaaaaaccttatacgtgtgggatatgtgggaaattatttaacagtaagtcccacctccttgtacaccagagaattcacactggagagaagccatatgagtgtgaggtttgtcagaaattttttaggcacaagtaccacctcattgcacaccagagagttcacactggagaaaggccatatgaatgcagtgattgtgggaagtcatttacccacagctctacattccgtgttcataagagagttcacactggtcagaagccttatgagtgcagtgaatgtgggaaatcttttgccgaaagctccagtctcactaaacacaggagagttcacactggagaaaagccttacgggtgcagtgaatgtgaaaaaaaatttaggcaaatctcttcacttcgtcatcatcagagagttcacaaaagaaagggcttatgagtgcagtgagtccagtctcattaaatattggagaatacacacctgagtaagatcctgtgattgcagcaaatgtggaaaatgtttacccaaaggtctgctctccttggatattggagagttcacactagagaagagtccttacaagtaaaataaatttgggcagttttgtagccacacctctgtattccttcaggattatagttaacactgaatgaaggccttactagtgtgacaaatacaggatatttatccagaagtctggctgcataactcacaggagagctgtcatgtgggaggattgctacatgggaggatttgcttgagcctgggaggcagaggttgcagtgagccgagattgcaacactgcagtccagtctggaccacagagtgagaccctgtttcaaaaataaaatatataaatgacatccaataaagtatgcatatttgagctgtaggataagtcttgaattttctttttcttttttttgagacagcctcgctctgtcacccaggctggagtacagtggcataatctcggctcactgcaagccctgcctcctgggttcatgccattctcctgcctcagcctccctaatagctgggactacaggcaaccaccaccactcctaccttttttgtatttttagtagagatggggtttcaccctgttagccaggaagttctcaatctcctgacctcgtgatctgcccgccttggcctctcaaagtgttgggattgcaggcgtgagccactgctcctggcttgaattttcttataatcccatgaaaccatcatcagagtcacaataatgaatttatctaatctatcacctttgtattcacctggagcctttataaagtttttctctatgcagacaaccattgatttactctgctgtataatactttccattttctagaattttctgactgatgtaataaagtgtttcctcttat

SEQ ID NO: 410118 - DNA, 2346 bp, Homo sapiens
tgcggccgccgccatgggaccacgtggggtaagctgggttgagagcagcgggcgccgttaaagagctgcagagtcacgtctgtgcaaagagaagaacgactctcgacctcctggatccagtcaccaccacggtcccaacacagcgctccaaggactccctaacgccaatggaaatggtcgcgctaaggttccccgttcgggcacagtgacttttgaagacgtggctgtgaaatttacccaggaggaatggaatctccttagtgaggctcagagatgcctgtaccgtgatgtgacgctggagaacctggcacttatgtcctccctgggttgttggtgtggagtggaagatgaggcggcaccttctaagcagagtatttatatacaaagagagactcaggtcaggactcctatggcaggtgtgtctcccaagaaggcccacccctgtgagatgtgtggcccgatcttgggagacattttgcatgtggcagatcatcagggaacacatcacaagcagaaactgcacaggtgtgaggcctgggggaataaattgtatgacagtggaaactttcatcagcaccagaatgagcacattggagagaaaccctacagagggagtgttgaggaggcgttgtttgcgaagaggtgtaagttgcatgtgtcaggggagtcatctgtcttcagtgagagtgggaaagactttttgctcaggtcaggattactccagcaagaggccactcacactgggaagtcaaacagcaaaactgagtgtgtgtctctgtttcatgggggaaaaagccattacagctgtggaggatgcatgaaacattttagcaccaaagatatactcagtcagcacgagagactgctccctacagaagaaccttctgtgtggtgtgaatgtgggaaatcctctagcaaatatgacagcttcagtaatcatcaaggagttcacactagagaaaaaccttatacgtgtgggatatgtgggaaattatttaacagtaagtcccacctccttgtacaccagagaattcacactggagagaagccatatgagtgtgaggtttgtcagaaattttttaggcacaagtaccacctcattgcacaccagagagttcacactggagaaaggccatatgaatgcagtgattgtgggaagtcatttacccacagctctacattccgtgttcataagagagttcacactggtcagaagccttatgagtgcagtgaatgtgggaaatcttttgccgaaagctccagtctcactaaacacaggagagttcacactggagaaaagccttacgggtgcagtgaatgtgaaaaaaaatttaggcaaatctcttcacttcgtcatcatcagagagttcacaaaagaaagggcttatgagtgcagtgagtccagtctcattaaatattggagaatacacacctgagtaagatcctgtgattgcagcaaatgtggaaaatgtttacccaaaggtctgctctccttggatattggagagttcacactagagaagagtccttacaagtaaaataaatttgggcagttttgtagccacacctctgtattccttcaggattatagttaacactgaatgaaggccttactagtgtgacaaatacaggatatttatccagaagtctggctgcataactcacaggagagctgtcatgtgggaggattgctacatgggaggatttgcttgagcctgggaggcagaggttgcagtgagccgagattgcaacactgcagtccagtctggaccacagagtgagaccctgtttcaaaaataaaatatataaatgacatccaataaagtatgcatatttgagctgtaggataagtcttgaattttctttttcttttttttgagacagcctcgctctgtcacccaggctggagtacagtggcataatctcggctcactgcaagccctgcctcctgggttcatgccattctcctgcctcagcctccctaatagctgggactacaggcaaccaccaccactcctaccttttttgtatttttagtagagatggggtttcaccctgttagccaggaagttctcaatctcctgacctcgtgatctgcccgccttggcctctcaaagtgttgggattgcaggcgtgagccactgctcctggcttgaattttcttataatcccatgaaaccatcatcagagtcacaataatgaatttatctaatctatcacctttgtattcacctggagcctttataaagtttttctctatgcagacaaccattgatttactctgctgtataatactttccattttctagaattttctgactgatgtaataaagtgtttcctcttat

SEQ ID NO: 410119 - DNA, 3713 bp, Homo sapiens
  misc_feature (3457)..(3457): n is a, c, g, or t
cacgctcacaccacacgcacaccacaaaacaaagaacaggtaaaaagggcacacatacacttttaccgtttacaccaaaccagaatcaaaatccaaatcagagtatccagaaatccaagccaggtcaaaaccaaaacgaaagtatcaagcaatccaaatcaagtcaaaaacaaaaaccaaagtgccggtacaggcatgccgtgggtgatcaggccacccttccactcaaatggagtgggcaagttccaaagactagtcttaccaagtttcagatgtccggactccaagtgcctgttccttcccagtgttcagccgctgcattgatcctctgtgggggcctgccacacgccactctggcgaggtgttccactggggcaattgcctacccgggagtgctctcaggttctgcgtccctcaagctggccagagtcccctgtagggatgctccacagggcaggcctaagctgcctaaggggctgcctcgactatctgttaatcacctggcttcccagtcagggaaccaagaaatgtagcaggacaagccgcagggctgtattcagcctggagctttggcaagactcacatctccaactaccaagctccccaagtgaggaattcctgtcccttttaagggcttacaactctaagggggtccacatgagaggtttgtgatcgattgagcaagcagggggtacacgactgggggctgcatgcagtggtaatcagaacggaacagaacaggacagggattttcacaatgcttttccatacaatgtctggaatccatagataacataaccggtttggtcaggggtcgatctttaaccaggcccagggttggcacctggctgtctgcctgtggatttcatttctgccttttagtttttacttgtttctttggaggcagaaattgggcataaaacaatatgagaggtggtctcctcccttaacagcacaaacgcttaattaacatttctttttcttttgagacaggttctgtcgcccaggctggagtgcagtggtgcagtcatagctcagtgcagcctggaccacctgggctcaagcagtcctgacacctcagcctctcaaaatttgggattacaggcgcgcgccaccgtgcgggtcaggaggcttccctgagggccccggaggtggagctgggcttttccttccgaagcgcccctgggaatctctctctttacggccttggaacctgggaaactacattacccagaaagctctgcgtcaaatgacagcacggcagagccagtgagagttcacattgaaggcgtttccgtgtgcgcaagtaaggtagaggcgggactcccggcgccctttagtagcgaccatttccattggcgttagggagtccttggagcgctgtgttgggaccgtggtggtgactggatccaggaggtcgagagtcgttcttctctttgcacagacgtgactctgcagctctttaacggcgcccgctgctctcaacccagcttaccccacgtggtcccatggcggcggccgcgctaaggttccccgttcaggtaattgtggcgccttccgtgctctccggtcacctcctagtcacacaagtcctaaagcagcgagggagcggcacctgcttacggctctgcaacccggacccggcgtcgggacactgaggcgctctcgggagggatccctgtttcagacacccgtgggatgcggtggggagagcgacaggtacagggaggggcgcgggcaatggcctggagatggacggatccgggaggatggaacctggggtccacaggcgcctgtagggaacaacctgtgaggcggaactcctcctggaaaagcaaggaggctgggggctgtgaaatcattgcgaggacactagaaataggagaatttccaagaaagaagggactggatcaaagtccaggcttttaaagtttcctaaaggccaaataaataacagagtagagaggggatgacgttggggccctttgagattgaatccttgtagatcatataggtggtagagatgacactttgtgctgagacacgcaggttagacaatagtccaaggtcacctggctccgtggacacaaaagcgttcagggaggcctgagcttaccagatcctatcagggacacagtcctgtaaagtcagcctcttccctcaggcctttatggctgtagaagcatttaaggaacgcatacaagaaagtggagggtggggccgggtgcagtggctcactcctgtaatcccagcactttgggaggcctaggcgggttggtccggaggtagagaccagcctgaccaaccatggagaaaccctgtctctactaaaaatacaaaattagccaggcgtggtggcgcatgcctgtaatcccagctacttgggaaactgaggcagcagactcgcttgaacccgggaggcggaggttgcgtgagccgagatcgcgccattgcactccaccctgggtgacagagcgagactccgtatcaaaaaaaaaaaaaaaaaaaaaaaaaaaagaatgaggtgcgttcagagagggtatctctgctgtgctgaaggtgccacattgggctttccatgacctcggccatactaggggaagtgcctgtcaggagggggtggactcttatatcacagccaccgcacagatacctatttgttcaactaactattgttgttggtggctgtaccccatgaccagtgggcctagtttctcctatgtttgaggaccttgagaggaggatgtgcgagagtagatgtgtgggagagatggattgtgatacctcagcataggggtggtttgtggtttcatctgtcaacatcataacagggcacagtgacttttgaagacgtggctgtgaaatttacccaggaggaatggaatctccttagtgaggctcagagatgcctgtaccgtgatgtgacgctggagaacctggcacttatgtcctccctggggaaagaaacagtagctccactcctgccggtccctcccctaggggagagggaagcagaggagaaaacagcagcataggtggctggcaaagacaaaggaaagaccagtagaagagaaagaaaccaaaaacagcaagcgcagagccaaacagccaggcaggtaggccaaaggttaagtccctctccccagccctgcggtttgtgaaaaagagggtgggcaccggctccgggaggagagcagaggaggtgaaaaggcgtaattcttgcaatttgcggcaggcatatctgccaagcctctaggctagtgactgcccggggcccagactgcagccacgcaaatcccactcagcccaagaaactaagtgtaaaaagaaaaggaaaaaaaaaaaagtaagaggggaaatcagggggaaaaaaaagaaaaacagcagcgcggggtcgggggcggggccttgtacgcgtacaaggccccgcaggatggagctgggtcaaggaccaggnagccctgactcccagaggttgccaccggggagaagcagcggtcctccatccagaacctaggggctgaagcaaaggcttgccaggacccttgaagatgcttttggctcacctcatttcaccccacgctctgctggctggcagaggagaaggcagtcgtttcctctctgaagagtatattttccggattgccctctggttagggtgcccatataaatcaggagtaatatatgaccgcgtgtgcatgcccaagtgtgtg

SEQ ID NO: 410120 - DNA, 2389 bp, Homo sapiens
cacgctcacaccacacgcacaccacaaaacaaagaacaggtaaaaagggcacacatacacttttaccgtttacaccaaaccagaatcaaaatccaaatcagagtatccagaaatccaagccaggtcaaaaccaaaacgaaagtatcaagcaatccaaatcaagtcaaaaacaaaaaccaaagtgccggtacaggcatgccgtgggtgatcaggccacccttccactcaaatggagtgggcaagttccaaagactagtcttaccaagtttcagatgtccggactccaagtgcctgttccttcccagtgttcagccgctgcattgatcctctgtgggggcctgccacacgccactctggcgaggtgttccactggggcaattgcctacccgggagtgctctcaggttctgcgtccctcaagctggccagagtcccctgtagggatgctccacagggcaggcctaagctgcctaaggggctgcctcgactatctgttaatcacctggcttcccagtcagggaaccaagaaatgtagcaggacaagccgcagggctgtattcagcctggagctttggcaagactcacatctccaactaccaagctccccaagtgaggaattcctgtcccttttaagggcttacaactctaagggggtccacatgagaggtttgtgatcgattgagcaagcagggggtacacgactgggggctgcatgcagtggtaatcagaacggaacagaacaggacagggattttcacaatgcttttccatacaatgtctggaatccatagataacataaccggtttggtcaggggtcgatctttaaccaggcccagggttggcacctggctgtctgcctgtggatttcatttctgccttttagtttttacttgtttctttggaggcagaaattgggcataaaacaatatgagaggtggtctcctcccttaacagcacaaacgcttaattaacatttctttttcttttgagacaggttctgtcgcccaggctggagtgcagtggtgcagtcatagctcagtgcagcctggaccacctgggctcaagcagtcctgacacctcagcctctcaaaatttgggattacaggcgcgcgccaccgtgcgggtcaggaggcttccctgagggccccggaggtggagctgggcttttccttccgaagcgcccctgggaatctctctctttacggccttggaacctgggaaactacattacccagaaagctctgcgtcaaatgacagcacggcagagccagtgagagttcacattgaaggcgtttccgtgtgcgcaagtaaggtagaggcgggactcccggcgccctttagtagcgaccatttccattggcgttagggagtccttggagcgctgtgttgggaccgtggtggtgactggatccaggaggtcgagagtcgttcttctctttgcacagacgtgactctgcagctctttaacggcgcccgctgctctcaacccagcttaccccacgtggtcccatggcggcggccgcgctaaggttccccgttcaggggcacagtgacttttgaagacgtggctgtgaaatttacccaggaggaatggaatctccctaatagctgggactacaggcaaccaccaccactcctaccttttttgtatttttagtagagatggggtttcaccctgttagccaggaagttctcaatctcctgacctcgtgatctgcccgccttggcctctcaaagtgttgggattgcaggcgtgagccactgctcctggcttgaattttcttataatcccatgaaaccatcatcagagtcacaataatgaatttatctaatctatcacctttgtattcacctggagcctttataaagtttttctctatgcagacaaccattgatttactctgctgtataatactttccattttctagaattttctgactgatgtaataaagtgtttcctcttataatccctgggtgctctcctgcatcatgcttattttgatatcaatgtagacatgagttaatttgttgtatattgctgagaagtatagtctgccatgaaatgtcattatatattcattcatccgtttatggatatttgagttgctgcttgtgtttttttgtgttttttttttgaggtggagtctcactctgtcccccaggctggagtgcagtggggcaatctcaggtcactgcaagctctgccttccgggttcacgccattgtcctgcctcagccagtcctgtggactacaggcgcccgcaaacacgcctggctaattttttgtatttttagtagagacagggtttcactgtgttagccaggatcgtctcgatctcctgaccttgtgatccgcccatctcggcctcccatagtgctagcattacag

SEQ ID NO: 410121 - DNA, 431 bp, Homo sapiens
gagtaatagtcaaaaggtatcccatgccctaaaaacatcaattgcgtcctgtacagaagggcaacaaagtgaaagtgtgactctcagcagtcatttaataattttattagacagtggtaaatgttctgaaatcatggagaaatctaaaataatttatcctccacttaaaaaaaacctctaaaaagaaaaggaaaagtggccaataagataaaaattgattgtaaaccaacttgtaggacaaatgagccaattcaaatatttagtgtagtctaggtccagggagtgaaagtgaccaaaattcatataacttaccctttcagaggaaacagttttgggtacctttgactttggcatttgtatcagtacctaagacaggggtcaaagctttaagaacaagcatattacgaatggatgtatagactcttttggaa

SEQ ID NO: 410122 - DNA, 270 bp, Homo sapiens
cagcgggggagttggttacagctgcagaatcccggccccaccccgcctccagagcacgagcctgcgctagaaggatatcaccaggggatgggggggaatgcgaggggggcggggaggtggtcacggatgcagaggctgtcctggctgctgaggcaaaaagcccgtcccaagccctgcatgggctcctactgcacttcaggatttgggggaatgcagaatcgtggtctttgagttttcattaattcaataaagatttctcaaaagcctaaa

SEQ ID NO: 410123 - DNA, 837 bp, Homo sapiens
ccatatactaatatatgggatagaaacctaagaatagtatcattaaattgcatgatatattcatatttatcagttttaagaaaaggccaaactattttccaaagcggtgatactattttatatttccatcagcattgtaaagggccctcatttagccacatcttcatggacatattttatcactggtcatttttattatagttattctagtgtgtgttaagtggcttctcattgtggttttaatttgcatttcactaatgactaatgattctgataatcttttcatctgtttatgcccattcacatattttctttggtgaaatgtgtactcaaatcttttgcctgttatcttatttattaacaaattattaattataaattgataaattatagttgtcttatttattgggtacaaagtgatgttatgatttatgaattcaatgtggaataattagatcatggtaattcacacaccaatcacctaaaatcattatttttttgtcttgagaatggttgaaatgtattcttttggcaatttcaaaatgtataatacattttttactatattcaccatgctgtgcagtatatcttaaagaaaccttattctcctgtccagttgaggctttgtactgtttgaccatgatatccttatccctttaccatccccaggctctggtaaccactgttctactctctgcttatttgagtttgattgttttagattccacaaataagtgaaacatgtaatatttgcagcaacaaagatggaattggagaacattaggctaagtgaaataagcctgccacagaaagacaaatgtcgacgcggccgcgaat

SEQ ID NO: 410124 - DNA, 976 bp, Homo sapiens
tgcggccgctaggtggaaggggacttcggttccgcacgtcgtcatgttgttggatggcaccagtatgtgacgttcctaggaacttagctctgaggaaaaaacaaagcaaaccggggaagtacgtagccttgaaccggagtaaccagggacagaaaggaaggaaaagggtttcataccttcacggaacgacgctcacttcgtccgcctgaggaggaaaaataagtttaaacctttctgtgaaaaagaacgtggagccctttctgccgaatggaaacccgctaaaccccgttatggagtctgctacaattaagcatctaaccaggaattgtctatggacacaactctccaggcaattcatgcagaaagtgtgttgacgatttcctgtttcttgcagagcgcttcaccgttaaggctcttagtagctggcgattgtaaagcacattttccgcttcatgaaaatacagtgctcttcttgtgtttgtaaccttggaaagtaagtctgctatgataagtttagggaagtggcggggagctactttcctaacatatctgtgattgttttgatacttctcagtttctcgcgggcatttcctgcgttctctatagggctctcttgcactgaataaggaaaggaggaattctctctgcattgaggctattatcgcacattgtgcggtggatatagtcacgcgctgggtcgtagtagcgtgtcgtttatttcagtccagctcactcttggtagaatccctttattcgttttgttgtttttgatagtctctctctgcttcccaggctagagtgcaatggcgctatctcgactcactgtagcctccgccttgagggctcaagcgatcctctcacctcagcctcccgagtagctgggaccgtagacgcctgctccccatccccgctatattcgttctttaatacagtctctcagcttgttcagctgccacttctgtgcagctcattagcc

SEQ ID NO: 410125 - DNA, 516 bp, Homo sapiens
caagtgaaaggcctgtgggggtcagtgaaggggagccccctgttctgagaccgtgtgggaccccgcgtcctggggttctttctgggtttactcaatggagaagcctggctttggtgatagggcgcctggcggtcagtaattaagagactggaagatattaacgaccgactgtcaaggtttatggtcgttgagggaatgccgtgggaatcagtggttgagaaacggggtaggaaagtgtgtatcagtgaatgaacttggtgtccattccgggtttgcaatttaatgtgatagagaagcttggggctggagaatgttttagtgaaagaggttttagtttgcggtttcagatttaatttggagtcaatgtttgaggaggcctgtacatgtctgtggtttaggggcctgaagaggctggagctttggaggcccaagggccctggagagtggatgggttgaggcttaataattgactgctggttacagttgtgattaaactacatttacctagtgaatcta

SEQ ID NO: 410126 - DNA, 800 bp, Homo sapiens
ccagtgtgcccttgccattgctccatctgcaagactcacccttctatagaagtaaatttgccttgctggagtgttaacttgttgttggagtgctaactcttctttgtggcaccaaaaagttatttccaacacgaagctgcacccttggtggagggaacatctgacgaagttcaatgtttggggaaaacaatatctggaaagattgaagagtcagcaggagaaacacctaggaaaattacaaggcctgtgaaagaaacatctgagaaatttgcatggccacaagaaagacctacaaagaccacatgggaggaaaaagaaacatctgtaaagactgaatgcgtggcaggagtaacatctaataaaactgaagttttggaagaaggaacatctaagatgatcacatgtcctacaaaaaaacagctacaaaagcaagtacacatggacaagaagaaccaagaaagtcctgaagaagaacagagctcaagaatgtataccatcagatgtctccaactttattacaattaaaataagatggtattagcaggacatacaaatagagaaacaaaaaacaaactcatacttacaccatcacctgatttatgacaagggtgaaactgcagtgcagtgaggaaataataatcttctcaataaatggtggtagataatttagatatcaatatgggagaataaaagactttaacccttgtcttgtgtcacaaacaaaagtcaatcgtaggtgggttataaagctcaatctgaaatgttaaaaattttaaaaaaaagcttctgtaacatagaag

SEQ ID NO: 410127 - DNA, 713 bp, Homo sapiens
agttctaatttgtacatgtacaaattagagtacaccatggaatgttatgcagccataaaaaatcatgagttcatgttctttgcagggacatggatgaaactagaagccatcattgtcagcaaactaacacaggaacagaacaccaaacagtgcatgttctcactcataaatgggagttgaacaatgagaacacatggacacatggaggggaacatcacacacagaggcctgtcaggggttggaggggaagaggagggagagcattagacaaatacctcatgtatgtggggcttaaaacttagattacaggttgatagatggagcgaaccaccacagcacatgtatacctatgtaacaaacctgtacattctgcacatgtatcccagaaagagctcaagaatgtataccatcagatgtctccaactttattacaattaaaataagatggtattagcaggacatacaaatagagaaacaaaaaacaaactcatacttacaccatcacctgatttatgacaagggtgaaactgcagtgcagtgaggaaataataatcttctcaataaatggtggtagataatttagatatcaatatgggagaataaaagactttaacccttgtcttgtgtcacaaacaaaagtcaatcgtaggtgggttataaagctcaatctgaaatgttaaaaattttaaaaaaaagcttctgtaacatagaag

SEQ ID NO: 410128 - DNA, 641 bp, Homo sapiens
ccagtgtgcccttgccattgctccatctgcaagactcacccttctatagaagtaaatttgccttgctggagtgttaacttgttgttggagtgctaactcttctttgtggcaccaaaaagttatttccaacacgaagctgcacccttggtggagggaacatctgacgaagttcaatgtttggggaaaacaatatctggaaagattgaagagtcagcaggagaaacacctaggaaaattacaaggcctgtgaaagaaacatctgagaaatttgcatggccacaagaaagacctacaaagaccacatgggaggaaaaagaaacatctgtaaagactgaatgcgtggcaggagtaacatctaataaaactgaagttttggaagaaggaacatctaagatgatcacatgtcctacaaaaaaacagctacaaaagcaagtacacatggaaggatgcattagtctttcacctgttcagtatgatgttggctgaggatttgtctcatatggctgttattattttgagatgccacaatttctgctacagcaatggggatatgggccacactaacttgtccctactaaatccaaccattggaatggacctccctttggaataaagtttgaactcaactctcatgaatgtat

SEQ ID NO: 410129 - DNA, 520 bp, Homo sapiens
agttctaatttgtacatgtacaaattagagtacaccatggaatgttatgcagccataaaaaatcatgagttcatgttctttgcagggacatggatgaaactagaagccatcattgtcagcaaactaacacaggaacagaacaccaaacagtgcatgttctcactcataaatgggagttgaacaatgagaacacatggacacatggaggggaacatcacacacagaggcctgtcaggggttggaggggaagaggagggagagcattagacaaatacctcatgtatgtggggcttaaaacttagattacaggttgatagatggagcgaaccaccacagcacatgtatacctatgtaacaaacctgtacattctgcacatgtatcccagaacttaaagtaaaatttttaaaacagatataaatattgtatacataaaaaagacacacaatgtttatgaatagaaagattttatattgtaaataagtcatttctactcattaaattatggttgaatgcaatcct

SEQ ID NO: 410130 - DNA, 566 bp, Homo sapiens
attcgcggccgcgtcgaccttgacaatcttgtggtttccacaagcaaccctctgtgggtgatttccagaaagacactggagagacaggagaactggtaaggtcatcttcttctacattcagcagagagggtcacggtttcaacagacatcgatgaacaaccaccatctttcccgtgagaagagaaactaccagcattttgcagatgatgaaacagactcaggaagagggggaggtggccaaagtgtttgccacttagaaagtggcaatgtcaggattcaaacacagatcccagggagttccaggcaccacatggcactgaccctagggagggagttccaggaaataccagaggaggagggggagaagttggcaggaacaggaggggtcaatggagccaatactggagtctgggaaagtattagttggcgcaaaagtaattgcagtttttgccattgaaagtaatgtctaaaatagcaattacttttgcaccaacctaatacagtgctcttgagaactaagaggtcacaagcaacctttgaaagaacagcatcaacagagttgagga

SEQ ID NO: 410131 - DNA, 424 bp, Homo sapiens
atcaggagatccaagtcgccactgttttatctccaactgggtttcagggcagggtcaacttgagaaattaggtaccatcccagttttggaacacccgggaatatcatgaagatcaagctacacactttaattcacaccaaattaccaaggtatagcaggaatttgtaacctttgaaaagatagtcctttctctttcacaccccacttagggctgagagggctgccagtgagggtgagctgggaggtctgcaaagacaactaactagtaccgagggagagcgtatgtcaagcctcagctctaacgtactagtcagcagtttccagctgacacaacctgccatttgacaagatcaatagctgtgttttccacaacacagagaactctttaggatacactctacagagattttctgtcttctctgaa

SEQ ID NO: 410132 - DNA, 188 bp, Homo sapiens
gaaatatggggtcattgctagcgggtatgaggtttctttttagggtaatgaaaatgttcagaaattaaagtgtttctaatatatattctcaaatgtatatataatctatacacacatatagtctgtgactactgaattgaatacatttatggcgtgtgaatgtaatttttaaaaagtgactacacttg

SEQ ID NO: 410133 - DNA, 852 bp, Homo sapiens
atcagaggtgcttattgtgtgtcaggcaccagacattgatttttctttttagacattgattttatattaactattagtttccatgttactttaccttgaattgggtcagtagatgagaaattttcctggggagacacactcttcagaaaaggtctaatttagggaggtgttttgaataagattaatttcccaaatttcaacaaaactttgtccaagaacatcatacaaagtgtctaccctacgcttttattccaatcatcaaatcctttagagagattccaaggattatgtttcactgagactgattttatttgctaatgccaattttgggattcaatcaatttaaattagaaatctggaagggcccttcaggattggagactagattggtttctagctagacactcccacctttgcagtttcagggtaaactttctttcccaagaaataaaagcatgtattaagaatgctgcttctgccaagactctgtgtagacccagccaccattgccagatagtctgaaaaagtataaaaaaattagccgcccctcagtgtgtggtcatgaagcagggccaggggcactctttaggtatacagcataaagtatgtcatagatagtaaatactggagtttagaatccatttgtaaagaactgtcagcttgagtgtattaaggcacaaaagcaacttctgaaacacaggcttgatatttgttgctggggctctgaatcattttggagtaccaggacacttagcaataggtgggattattttttcagggaaaataatggtgttccattcttagggtcatagatgactagaaaaagaaaggtccaaggcttagaagaaagat

SEQ ID NO: 410134 - DNA, 362 bp, Homo sapiens
ccccgatcacgaggacgtccatcccgtcgagaaccagtccgtgatgtgggaaggcgtcgaccagaagattatgatattcataacagcagaaagaaaccaaggattgactatccccctgagtttcaccagagaccagggtatttaaaggatccacgataccaggaagtggacagacgattttcaggagttcgccgagatgtgtttttaaatgggtcctacaatgattatgtgagggaatttcataacatgggaccaccaccaccttggcaaggaatgccccttacccaggaatggaacaacctccacaccatccttactatcagcaccatgctccacctcctcaagctcatcccccgtcgacc

SEQ ID NO: 410135 - DNA, 710 bp, Homo sapiens
atcttaagatgttgctttgttggtcaaaatccgattttaaaagttgagactggtgcagtggttttgggaattaacacatggtaaacagctctgttcccagcccccaattctccatgactccgcgtgggggtagctggtgttgtagcgcatgtttgaggacgtggatgtggcaacgggaagcgtgcttcacatggggtgggtccacagagcctagcatggttggctgggtggtgcttcttcagaaaaatctgcgcccactccttaacctcttcatgttttactcatactctgctattgtgggtttaggtttggcaataatgctgctacttacattgagaacctaatagggaaaaaagactgggctttgtagttgcaacgattgctgggaagatgcaacaagtttttctagcttcttattatggtttactgtgatccattctcttaaaactattctttcttataatcctctctctctctccttaacagatgaggagttgatcatgccactgccctgctcacaatccctgagtggcttctgttgtggttagagtaaatacatactcctccccgtggctcagagtcattggtgtctgtcccctgcctgccatgtaaacctcctttctcgttgtgactccatgcacaagggcctcccagtgtttttcaagcttccaactttgtctgtctcaggctctgtacagatgttcttcctt

SEQ ID NO: 410136 - DNA, 1332 bp, Homo sapiens
aaaggttgccattgagcctaaaacgtcagcgatagatggcaactccattagatcggacgcatcatcaagttagctcgagtcacgtaaaaacgcacaaaagacattagatagcaacaacaagtactgtcccgaacctgcacatgtgagccatccgcatagcaatggtccaccgtgcgactgactaaagactgcgatcatgaaaagaaatcgaatcacccacctttcttggtgggtaccctgactgcgccttacggtatcccgtggacatctcttttgaagtggtgggaaggagaactaaatctcatgggctcctgagactgtgtcctagaactttcagaggtcaatgtaccccaactgaaaaactgtttttgaaaatggctttaaaaaaaaacgatcttcaaaataaagacacacacaaaaaagattctattttgcttgaatttgagcagctctatggtcccagattgaaaacactactggaacagagagaacactggtctgaagtcagggagtctttattctcaattctgccaccaagctcagtagtcacctgaaaaaaaaaatcaattcatttctccaggcctcttttctctaagggtgctccactttcccactaaacaacactgtcctaagcattcacaaatcatccttttaataacccattctagaattctgcccacaagtagcataaagctcctagtctacagtttttaagcccacattcctcactctcgaaaatcagaatgtcatttacctgtcttcataattccaacaatttctcactcttcaaaattccataaaaataaaaattaacaatgaattatccctgggttctttcagtgtcctggaacagaatgcttctggatcaaaaatccaaaacccattttgaacaactaaacaatcttttacaatccattcaactttcgcaagctttaatttaatgttactaatgttttttctggcctgttcaaaataaatattcctgcctttcatttattgactttacgagtacttgtcaaggacctactgtgtatgacaacacactaggaatacggatgagctgtaaaaaagatatgtaaatgctgtccttgcttgcaaaaggctgacactagcaataagtgaaagacaataaactagcatataactaagcaggacaatttcaggtagtaaagaatgatataacaataaagctatatttgagagcaatatcatgctccagatactcttctaaatagtaactagtttaatcctcttaacaactctacgaagtatgtacctctttcattaaccccacctttatacatgagaaaatagagaaaaagaacagtcagt

SEQ ID NO: 410137 - DNA, 458 bp, Homo sapiens
aaggggtttgatttttctgccttgcaatatccagtaagaaacctcttgggggaagagaggtaaaaagatcagcacgacactggattgccagtctcacatcatctgcatcaacattaggtttcttagcatggctcgaataaatttttgcatcatccagaattgtagtcacatttcggaaagcaaattccaaaatttgatttataacctttggtttgtagtctgtgattcccatatccttcgagatctgtgccatcaccaaggcatccctaggagcgttcttgggaagtgccatcttgcccaattccatgttatccagccactcgttatccggagagagagcctattggtagtctttaacttagttggtcatttcatggtttttctcctgctgcaagtggttcaagtgctgacccagttgctcgtatcaaaaaaaaaaaagtcgacgcgtcatctctaat

SEQ ID NO: 410138 - DNA, 330 bp, Homo sapiens
tgtaagggaagagatttggctttaaacagaaggaaggacctttgttgcagtccggaaggataaaagcagatgaagataactttttaagtggaggacaggaaactgacataatcatatctgatgaatttaatattctcaataaaacaggagacaagaccttctgcttaaatgaggggatgggattggatagcaaacttaaagagaagagtaaagtcttagaacagcttaaagggagtgagatggaaaggtaaataagaggactgttgaacaaccttgaaagcacacctgcagttgaagactgtacatctgttacatttttctggaaaaccc

SEQ ID NO: 410139 - DNA, 294 bp, Homo sapiens
ggtatcaaagaagaactaaataaatgaagagataatccatgttcatgaagaggagaactcaatattgtcaagatgtcagtgcgtcccagcttgttctaatgcaattccaatcaaaatcccaggaagttattttgtggatatcaacaaagtaatttgaaacttcctatgaaaaaacaaacgactcagaatagcaaacccaatatcgaagggaaagaatagagcaagaggactgaaatcacttgagttcaagacttactatgaagccacagtgatcaagacaatgtggtattggcc

SEQ ID NO: 410140 - DNA, 274 bp, Homo sapiens
acaacaataacaaatagtccaggaacaacaagcccctctccgatttatttataataaaaagcaccctagaaatattttcacaatgagcaaaagcttttatatagcatattatgttaaaaatggtatttttacataactggcagaaagatgaatcaaatgaatcaaattttaaaattttttaagtaaaacataggttttattatttttttaatcctgtatttctcccaggacactggcagatactagtaatctgaaattttacctaatcttcaaa

SEQ ID NO: 410141 - DNA, 477 bp, Homo sapiens
acttgctagttatgttactaacctcactgtgcctcagttttgtcacctattaaatggaaagaaaaatagtacctacctcattgggttaccagaatgaaatgatctttgggggataacagtaaccaccatgagttagtgcttttgagcaccatagtttcattcttaagtttcattcaaaaccctgcaattctaagacatcactgatgattacattttttttggtgtgaaagtcaagtctaattgtttctggagaacattgtgtcccactgtttggttttggatttatcccttgcagactgagaggtttttgttttgtctgtttatcttcttaatgtagtgtttagaaatttaatggagcaatttagtttccatttactgaagtagattatcaaaggaaacaggaacactaaagactaggttagcatcccagagtattgcctcacatatgatgtgatttttcatgttttcctgacaaaa

SEQ ID NO: 410142 - DNA, 229 bp, Homo sapiens
atcagagatgtctctatatatttatatatagagagaaatatgttatagatattggcatatagatataaacaacttatagagatatattggtatagatagctatatctatagatacagatatctagagagagagaaagcacacttttggagaaaatggaaacaatgtaattcgtgtgcaagactttatacagataagaaataggttttttaaattaacctccttagggtc

SEQ ID NO: 410143 - DNA, 225 bp, Homo sapiens
tcatccccaaactctcaaccaaagaggcaaattgcctctcaatactttcagaagcatcttctacacaggttccatcttcttggagacaaatctctcctgggagctgcctgttctccaactcccatctggacaggctgccctctgggcctgcaatgtggctggcatcctaggactggcaggcagcaatatcctgtgcacccctcagcattctctcctgtgtttgag

SEQ ID NO: 410144 - DNA, 370 bp, Homo sapiens
gtcttcaagatccttggccatgtgaccccgtcctgctatcccaatcccattcccattcccatccccagcctccccacctcatccaactccagccacattggatcaccccaggagaggatgtcatgtattagtactctggtgcctttgagtcaaaactcactgttttgccagttcagaggttgagccctttttgaagaatcccctcttcttccacagcccaggtaagttctaccccaggcataatgagctgttatccccctgggatctgagggcattcagaataccaacacaatgctctccagatacctctatgctattcaaatccatgcatctcacacctgctcatcttaaaatctctgtgcctcacatg

SEQ ID NO: 410145 - DNA, 320 bp, Homo sapiens
ctctgcctcctgggttcaagcaattctcatgcttcagccacccaagtagctgggattacaggcatgcgccaccatgcccagctaatttttctatttttagtagagatggggttttgccatgttggccaggctggtcttgaaccaggttggccagaaggcctcaagtgatctgcccgccttggcctcccagagtgctgggattacaggtgtgagccactgtgccctgccagatgtccatacttaatattgtactccttgattctcttaagatgtccaggcagaacctgcttcctgctattgctctgaggcaataggtcagt

SEQ ID NO: 410146 - DNA, 353 bp, Homo sapiens
agtcgactgaaaagctagaaagagaaaaagagaatatggttaaatgcctttgcactatattcagaaggaattggcctaaaacagagcctatatggaaggagaacaaagttgggagactggcactatccaacttcaagacaaagctacagtaatcaaggcagtttggcactggcaaaaaaataaacaaataggcctacgggacagaatagagagctccaaaatagatccacataaatatagtcaactgatctttgacaaactagcaaaggcaaaacaatggagaaaagctagtcttcccaacaaatggtactggaacaactcaacatccacatggcaaatagtgaatgtcgacg

SEQ ID NO: 410147 - DNA, 187 bp, Homo sapiens
tactaaagtggaagctaaaaagtctaaatgattcaacatatattttaaggaacagtgtaaatatgcaaaacggtgccagattgctaactctcttttcatcagaactactgataggaatgctcccaagagggaataaattatacagagactctggtctctttggaggtgactttgaactgttctttgt

SEQ ID NO: 410148 - DNA, 182 bp, Homo sapiens
tcagtgtactgtaagtttgtgactttcaaaaggaatcaaagtgatatgctaatacatataagggtggctgccataagtgcaacagaaaaagcagctcagaaatcagaagagccctttcctttcctatctctgagctatcaaggaagtatcttgttgaaagaactctaaattcttatgagggg

SEQ ID NO: 410149 - DNA, 182 bp, Homo sapiens
gatatagtcatttgtcctttggtgagggagtaaataacacaactagtagggaagcaaagccagatactcaacattcccctgtgaacatagcttcattctctacagagcattggtgatactctgacttgtatttgccaaactaagtggataaacacttagtttctttgtggaaaatttatccc

SEQ ID NO: 410150 - DNA, 278 bp, Homo sapiens
tttcccaggaggacaaagcccccagtgacaagagcagggtcaacaagttccaagcaaagagaacagcaagtgctgaagcctaaggctaatgcacttacagaaaaatccttaatgactaagtgtgttgcctctgtttgcgcagagatcacaaaacgtgtcccgcagaagggagagaaaaagggaccccaggagagggtggcggggcttcaggtcctggagaaaggcagcaagcatggctaacacattccttggtccaccctgcagggtaatactgcacc

SEQ ID NO: 410151 - DNA, 588 bp, Homo sapiens
ctagagtcattcaggttcctcctgagagagacctgaagggttgactccaacccctctccccatttgacagaagagggaaccaagacccagaaagatgtggcggtgacttgctcggggttacggagaggttctcagtgaggctgaaaccttgtatgatgaggagagtggtcccggtgtctcagggtggggctccgaggacatgacacacttagagttctgggccagtgccaggcacaaggaggctctgcgtctccctggccctcgcagccaggactctccatccccgtctccgtgcggcctcaggctacgtccagcatctctgatcccccagctgctccctccctctctttgctcctccagggctggctctggaaccctcctgtcagagaggcaaagagaatggccctggagagcctcgggagtgcccacccctgggctgacaacagcctagcgggggctctggagggttttgtaagttgagacctgctggaaaggtaggcagccgtgtaattctgaacctgccgtggaatctgaggacgatgccctagatccctgtctcccgcctagcacagccttgcaggccctgtc

SEQ ID NO: 410152 - DNA, 440 bp, Homo sapiens
gctgccgcctactactactaaattcgcggccgctcgacggggcgggtttaaggtcatgagaacatggtcaggattagcattctgaaagttactgtagctagagggtaaagagtagatagggacaggccatttagtaggctactgtgagatactaggtaaggaaataaaaggctggattagggaaatgttattggtagctaagatggagattttgatgtacgagagaaaaattagtagacaaaatcaagaaaatgtgatgatggattagatgtctcaaaaacgattctgaggttttctgccttacataaatgaacagacaacagggccattcactgaaaaaggaaacagactagttcaggtggcaaagctcctaagttgttttgggcatgttgaagtgtaggtgactgagagacatctaagagatacaattaggaagtaga

SEQ ID NO: 410153 - DNA, 377 bp, Homo sapiens
caacatcagtcactttggctgagtgtacactgctggtttcattccaaagcctggcatgttgtgttgtgtggatggggtgttcaaggtggagagggcaaagactcaacatctgatacatttacttccatttggggtgcatgagcaaagatcatttcagtctcgggcttcttcgtgggaacttgacttgccgggtagctccccctggggttcagatctctgttcattgtttctcttcaagccctgggaagtgccatgttatctggaaagctttccctaacatgttctgtctgcatttatacttcacccatgtgcccctcaactattcatcatagcccttgtcccaccataatgaaaatgtctctcattatttttctggc

SEQ ID NO: 410154 - DNA, 350 bp, Homo sapiens
gatgagtattttctgcctttttctttcttcttatgcctctaatactttcccttctcaccctcagttggtctcgcttcctatctcactaagagaaaataaaagcagtcagaagagaactcccagtctcccattgcctcacatatcctcccccctgcatctgtgcctgatgttctgcttcttcctgctgtgagtgaaccatccacactcttagggagaccaagccttccatttgtgcgctgcattccattttctttggcctactgaaggacatccatctctgctagatgtttcgtatcagcatataaacatgccacaactgcatttctctcttcccagtctctctctctctc

SEQ ID NO: 410155 - DNA, 388 bp, Homo sapiens
atgcttaaaagtacaggttttaacatctactatctaggttcaaatctcaactccaccacatacaagttgttaaacattggacagttacttaacctctctgtttcctcacaggaaaaccaaggacatccatgtaggaatgacatctgctcattagcttgcaagaattaaaagacttggtaccaatgaggaggaaacaaaaatcaggaggcagttcttattataaagtatccatacagatggtgtagagtatgtttttgttaaatttttatattagcatttaaacaaaaatacattaaatattcttgctgagaacttgggcatcccataaatacatctgtgtacccaaagggctgcaatctgtcatctaggaaacactgcactccacagc

SEQ ID NO: 410156 - DNA, 441 bp, Homo sapiens
gagatttgaggctgatggaggcagatttacattatataagggactttgtaagacagaaaggctttgggttcaaatctcagctcagccaccatttagctgtgcaactgtaggcaagttacttaagctctgggaacctcagtttccacatctgtaaaatgggaaaaataaaatcaactctgtaagatttttgtaggccagacacgttggctcatgcctgtcatcccagcactttgagaggccaatgtgggaggatcgcatacaatttttttttttttaaactgggcatggtggcatgtgactgtagccccagctactagggatactaagggggaataatggcttaagctaggagtttgaggcctgcggcgagctgacggcatcactgcactccaacctgggcgacaatgtgagaccccgtctcaaataaataaataataaaga

SEQ ID NO: 410157 - DNA, 489 bp, Homo sapiens
gagatttgaggctgatggaggcagatttacattatataagggactttgtaagacagaaaggctttgggttcaaatctcagctcagccaccatttagctgtgcaactgtaggcaagttacttaagctctgggaacctcagtttccacatctgtaaaatgggaaaaataaaatcaactctgtaagatttttgtaggccagacacgttggctcatgcctgtcatcccagcactttgagaggccaatgtgggaggatcgcatacaatttttttttttttaaactgggcatggtggcatgtgactgtagccccagctactagggatactaagggggaataatggcttaagctaggagtttgaggcctgcggcgagctgacggcatcactgcactccaacctgggcgacaatgtgagaccccgtctcaaataaataaataataaagattgctgtgtgtgagaatatggggctcagcagacgtcgacagtcgaaat

SEQ ID NO: 410158 - DNA, 293 bp, Homo sapiens
gttcaactaaccgtcgacgaaaatatgaagtaattactttttgtattttaaaaaacacaatattgtacaagctaaatacctctatggcaaaaatctctacatacagaaaaattatataaagaggagtgccagaagaggtgccatgctatgtcagaactctatgaaatcaagcaaaattctatatgacagaaaaatttttctaggtccttgggagttttgttttgccttattgatttttctgctgagattcattttgtatttgtaagcattagcaaaaatttatatatgggggg

SEQ ID NO: 410159 - DNA, 303 bp, Homo sapiens
tctggcctttcactatatattctaatcatatatcctgtatgaacaaccataacacaaatctttcttcacttacccagatacgaaatggtatatactcagaggtccttttaatcaaatgatcatgaagtaaagttttacaaaatatgtgtagtcttctaattgatttcattagtttcattttgggtttttttttttttttttcttttttgagatggagtctcgctctgtcgcccaggctggagtgcaatagcgccatctcggctcactacaacctctgcctcccaggttcaagcgattcttctg

SEQ ID NO: 410160 - DNA, 965 bp, Homo sapiens
gaggaacctggaagatattatgctaggtgaaatcagccaggcacagaaagacaaatacccagtgatctcacttatacatgggatctaaaacagttggactcatagaaggagagattaaaatggtggttacctggggctggggtgtcgaagcgggtggggtaggtgtaggaaatggtaagatgttggttaaaaggctcagagtatcaaacagaaggaattaaattcaaaggaaaaaaaaagggaaaactatcaacaagtcacaagaaaaatagggaaaggatgtgaacaaatggttcaaaatgtgtaaaagtattttaataggtaacccactgatacggttcggcaacaaagtacaaaagaatgcttagtgtaaaatcttctcccatcccagtccctggcaccaagcaacccacaccagaggcctctgacgctgttagcttcttgtatgatctttttgagatgttttatgtaaaaataagcgtatttgtgcctgtgagagtgtgatgggtaatttcccttttttggttacactaatggtagtatactataaaaacaattataattatacacctaggttttgttatacttttaatatattgaggaaatcattccatatttatatttattatagagctacccagtattaaaacctgcctagcattctatgctaatagtgccatattaacatttaatacatgttgtttgctgtattttgccgctacaaattacactacaaataggccaggcgcggtatctcacacgtgtagtcctagcactttgggaggtgcggcgggcagatcttttagctcaggagttcgagaccagcctggaaaacatggtgaaaccccatctctacaaaaaatacaacaacagtaaaaataattagctaagcatgatacacgtgcctgtagtctcagctacttgggaggctgaggtaggaggacagattgagtctgggaggcaga

SEQ ID NO: 410161 - DNA, 393 bp, Homo sapiens
gtaacattgagcactgcctcttggctctgagttactttgtgaaactggaatcaatataagagtttatcgaaagaatgacttctcctacaaagtaagtgttgattttctaatttcttggacagagaaagtcaaatcacaccatgtctggtagaaaatatattgaactaatatattgcaaagttattgctattaagagaaatgcaggtttttaaaattagctctttgtttaggctttttcaaaaaagatagaaaacaacaacaacaaccagccagggacagtgtctcacacctgtaatcccagtgctttgagatgccaaagtgggaggatcgcttgaggccaggagttctagaccagcctggacaacatagcaagaccacatctgtacacaaatt

SEQ ID NO: 410162 - DNA, 560 bp, Homo sapiens
taatcgagctcggcccctttgcttagaagttgtggagaaatggggggctgattctgctcagattcatcaggatgagtagaaggcacccagctctcaccctggcctgacatgtgtgtccctgagcaggttacagtcctctctgagcctctgcttcccatctggaccctgctgggcagggcttctgagctccttagcactagcaggaggggctccaggggccctccctccatggcagccaggacaggactctcaaatgaggacagcagagctcgtggggggctcccacggacccgccgtgggcccaggggaggcagagcctgagccaacagcagtggtgctgtggaccgtggatcctgagggtggcctggggcaagtaccggctgagggtccaggtgggctttgtgtacctttgggtcctggggccctggtgacttggactccaggttagagtcaagtgacaggagaaaggctggtggggccctgtgcttccgacttcatttcgagtgatggcagttcccaggaaggaatccacaacttctaaggttaagggggatcctcta

SEQ ID NO: 410163 - DNA, 1234 bp, Homo sapiens
taatcgagctcggcccctttgcttagaagttgtggagaaatggggggctgattctgctcagattcatcaggatgagtagaaggcacccagctctcaccctggcctgacatgtgtgtccctgagcaggttacagtcctctctgagcctctgcttcccatctggaccctgctgggcagggcttctgagctccttagcactagcaggaggggctccaggggccctccctccatggcagccaggacaggactctcaaatgaggacagcagagctcgtggggggctcccacggacccgccgtgggcccaggggaggcagagcctgagccaacagcagtggtgctgtggaccgtggatcctgagggtggcctggggcaagtaccggctgagggtccaggtgggctttgtgtacctttgggtcctggggccctggtgacttggactccaggttagagtcaagtgacaggagaaaggctggtggggccctgtgcttccgacttcatttcgagtgatggcagttcccaggaaggaatccacagctgacggtggctgacagatcagagaatggaaggcgaggcaggcgggcgtctgcgtgacctcaggtgcttggggcccagcagacccagagaaccatttccactaggccagggtgccggaagtgtccacaggtcttagattccctgttcagatgaaaagatttgtgcctttaatgataaaagtgatctgcatagagtcaaaaattcaagccatgggtataaaatgcaagtaaaatccctgccctcacctatcccaccctactacacagagatgtcctctcgagtttcctagactcactctggaaatttctgtatacacacagaagcttgtgcctctgctcgtgaaggcagagggagggagagctgaagggccagcaccttctcacctgtgggccccctcagtgctcggtcccagagcatgcaggactgtgcctcgtgttcagtttgctggtctgacttcatgctccttgggcaggatatgcatgtgccatgctaggagacatgtggatgtgaagctgggggacaatgtcccctggctatgcctttacaagggaagtaaggaaggtaggaggtgagcctgggagggagggagggaggcgcggagccgccgcaggtgtttcttttactgagtgcagcccatggccgcactcaggttttgcttttcaccttcccatctgtgaaagagtgagcaggaaaaagcaaa

SEQ ID NO: 410164 - DNA, 204 bp, Homo sapiens
tgtgtgtgtgtgtgtgtgtaaaagagagaagttgtggagaaatggggggctgattctgctcagattcatcaggatgagtagaaggcacccagctctcaccctggcctgacatgtgtgtccctgagcaggttacagtcctctctgagcctctgcttcccatctggaccctgctgggcagggcttctgagctccttagcactagca

SEQ ID NO: 410165 - DNA, 445 bp, Homo sapiens
ttttttttttgagatggagtctctcgctctgtcatccaggctggagtgcagtggcacgatctcagctcactgcagcctccgcctcccaggttcaagtgattctcttgcctcagcctcccaagtagctgggactacaggcatgtgccaccaggcctggctaatttttgtatttttaatggagacagagtttcaccatgttggccaggatggtctcaatctcctgacctcgtgatccacctgcctcagcctcccaaagtgctgggatcacaggcgtgagccaccatgccccgccaaaagtgcattttttttttttttttagtaaaaggctattaagtcctatatgacacatccattttggggtgatattttttcctcttttctctgagtcacactccctctttaatatcctgtaacttaaatactgagctatatggctagccactat

SEQ ID NO: 410166 - DNA, 479 bp, Homo sapiens
aaccagccttgtcgattagagggtcagcattttcagccccacttcacctccagggagggaaaaggggctggaaatttgagttcaatcccttatggccaattgtttaatcaatcatgactatgtaatgggatctccacaaaacccctaaacaacaaggctcagagtgcttttgggttggtgaacacatccgcttactgggagggtgggacactctgcctccatgggaacagaagatctcatgctcaggaccctttaaaaccttgctctatatacttcttcatctggctattcatctgtatctgttgcaatatcctttataataagctattctttgtaataaactagtaactgtaaataataaactagttcatctgtgtcctttgtgatatcctttataataaactagtaactgtaaataagtgtttgtgagctgttatagcaaattagcaaggagttagcatcagaattgaattgtagga

SEQ ID NO: 410167 - DNA, 589 bp, Homo sapiens
gggcctctgcatcctgcagtggaaattccacagcatgcccgtgtgcaccatcagcagcctgccccaggtggatgatgtgctcgcgtccctgcagatctcttcgcacaactgtaaagtgatgtactacaccaaagtgataggctccgaggatttcagaggttccatgacgagcctggagtccagccacagtggcttctcccagttgagtgcaccaccaccttctccagccagtctcactccagctccatgatttccagctagtgccgcaccacctgcacctagtgtgcagaggagatggccgcccctcctcggacagccagctccaccctcccgccgagcagagacattgtatggactcctctcacctctagagagcaaatagctctccagatggtaaacatagtcatttcatcccaaaactatcttggcaggtagttttaactctgatcctaccttaactcaacagccatagattttgtatatgttgtgcacaaaatcaaaccagagcacaagggctctcttgaaataaaagtagtttctataccaattaaaagattgacgtggtctcaggaaaaaaaaaaaaaaaaag

SEQ ID NO: 410168 - DNA, 182 bp, Homo sapiens
atcctcactgggtgctcactactgctcactgcatcacccggtgagtggggacctggggtctggggaggggtgtctgtgccccacaggaataacagttgggcatttcccctcagatgaggctggggacagagggagagagacagggaaggttctggttcaggttgcatgaacaggcattgggg

SEQ ID NO: 410169 - DNA, 274 bp, Homo sapiens
actacgtcttaaaaaaaaaagagagagagagagaagaatccagctctcattcattcttcttcccccaagaggggagtggtaaagacagctaacaatgactaagtatgccttgcgtatttttagcatttcacatgtattaattaattccatcctcactgttatctccattttacagataaggaagctcaagcatagacaggtgacgtaattcctccaacattacccaagtagtaaatagcacggctgagattcagtcccagacggtgttcaggcc

SEQ ID NO: 410170 - DNA, 425 bp, Homo sapiens
tactactactactaaattgcggccgcgtcgacacctcccaccaggcccctcctccaacactggtaattacaatttgacatcagatttaggtggagacacagagccaattcttatcaggaacaaacagggtcttcagggtaacagtttccctaacctcctggagaggacatttaaaatttttctgggaggccgaggtgggtggatcatgaggtcaggagtttgagacctgcctggccaatatagtgaaaccccatctctactaaaaatgcaaaaaaaaaatagctgggcatggtggcacgtgcctataatcccagctactcgcgaggctgaggcagaagaatcgcttgaagccaggaggcgaaggctgcagtgagctgagatcgtgccactgcactccagcctgggtgacagagtgagactccatc

SEQ ID NO: 410171 - DNA, 671 bp, Homo sapiens
acagcagtgcacacatacacacacacacaccgataggagatggaggcagtgcacacctgctcacacacagcagtgcacacatacacacacacaccgataggagatggaggcagtgcacacctgctcacacacagcagtgcacacatacacacacacaccgataagagatggaggcagtgcacacctgctcacacacagcggtgcacacatacactcgcacattgataggagatggaggcagtgcacacctgctcacacacagcggtgcacacatacacacacacacaccgataggagatggaggcagtgcacacctgctcacacacagcggtgcacacatacactcacacacacaccgataagagatggaggcagtgtaccacaatatcataggtgtgcctttctggatgctgggataagtgggcacttttatttccaactatatcgtatcttttatttttcgtatttaatgagtctgtattacttttataatcagaaacatgccataagtatatgaaaatgcatctttttttctttatgctgttgaaaaggagagtatcacctgctgttagactcttctccgtcacgtgacgctcacgaaatgaagataacgctgtcttgtccatctgttccgaaaagaaacgcctgtgttaaggcgatgcttgattaaa

SEQ ID NO: 410172 - DNA, 521 bp, Homo sapiens
gtaagtgtgatgcgaggccctcattgcggggtcagggtaacttatggaagcaaacagccttctttattttttaatacatcactgtcacctgcgcttatgccaggggttattagaagaagaggggctctgggtggccatgtgttcatggctatgatgactgaaaaggccacagcatgcaacagagtcctcagatttacccccaaatgcttctcccaccctctattctctcttagcatctctccctgaacctctttcgccaaccccctaccaaacaaggtccagaattgaggtgttctggaattccagccttgctaagctctgggattaaggccagtcatttggaaaggggatgggggaagaggcaaaaacaaaacaaaaaaaaaaaccaaaaaccaaaaaaaacaaaaacaaaacaaaaaaaaccaactgaacattaaccctttgggtccatagcactgagaagacctcaccatttcggccactggcaaatcagcatctcttggccatatccctgaaacctg

SEQ ID NO: 410173 - DNA, 460 bp, Homo sapiens
ctgaaagatgtaggaaatcttaatactgttagtgataaaaaatgatagctctttcaaagtgctgggattacaggcgtgcccggcctgacataatttatattaaccaactcttgagatacaattttgagagccaaacctgggaggatgctaaaaagtcctctggatattatagggattcctaagtttattaccacatcattacaaggtacgtgggagcgacctttggttattagctatcacaacagcagactcaacctatgtaggtaggtttcttttactttgtctttgtgggcagatgatttatgttagctgcactcttgtagaacttgagtaataatgacactaaactcttgtgtcttttaatgttgaaaatatcttcatacaccaaatatttcaagtattttttgtgtgtgtttgttttgagaaagagtctgggcaacagagcaagactccatctcag

SEQ ID NO: 410174 - DNA, 639 bp, Homo sapiens
ctgaaagatgtaggaaatcttaatactgttagtgataaaaaatgatagctctttcaaagtgctgggattacaggcgtgcccggcctgacataatttatattaaccaactcttgagatacaattttgagagccaaacctgggaggatgctaaaaagtcctctggatattatagggattcctaagtttattaccacatcattacaaggtacgtgggagcgacctttggttattagctatcacaacagcagactcaacctatgtaggtaggtttcttttactttgtctttgtgggcagatgatttatgttagctgcactcttgtagaacttgagtaataatgacactaaactcttgtgtcttttaatgttgaaaatatcttcatacaccaaatatttcaagtattttttgtgtgtgtttgttttgagaaagagtctggctctgtcacccaggctggagtgcagtggcacaatcatgagtcactgcagcctcaatctcccaggctcaaattatcatctcacctcagctacttgggaggctgagggaggagaattgcttgaacctgggaggtaaaggttgcagtgtgctgagatcacgccactgcagtccagcctgggtgacagagggagactccatctcaaaa

SEQ ID NO: 410175 - DNA, 491 bp, Homo sapiens
tctacgagagtctgattcatgcccagagaaccactgaagccaatggttattttaggcagggagataaaagccacagagggcccagttggcgaggggagtccggcaggagctgcctaagcagaaggctgtgtttacatacacagacgacttctctgcccagcctggcctagtgtggggagatgggaacattcaggcgtcactgcctggctgccttgtgaagttgcggattaaccagtgatgcagcggctggtctagccgtctggtccctgcagatggatggatgaagagaggactgaaaagacagcagagcagtgccagcttctggaagtgaagtgctggctgggtggagtgggcacctgggctgggaatgtgagtgcaaggaaatgtttgtgatctgacagcagacagcaggtgaaattctgctgggtctggcttggggggttatgaggtcttcataacagtccctgttttaaatggaaaaactgttgaaa

SEQ ID NO: 410176 - DNA, 402 bp, Homo sapiens
gaggagttcgacaaatcccacaaacctttgtactggcacactggggatacagagatcggtaccataacttccctggcctagtgtggggagatgggaacattcaggcgtcactgcctggctgccttgtgaagttgcggattaaccagtgatgcagcggctggtctagccgtctggtccctgcagatggatggatgaagagaggactgaaaagacagcagagcagtgccagcttctggaagtgaagtgctggctgggtggagtgggcacctgggctgggaatgtgagtgcaaggaaatgtttgtgatctgacagcagacagcaggtgaaattctgctgggtctggcttggggggttatgaggtcttcataacagtccctgttttaaatggaaaaactgttgaaa

SEQ ID NO: 410177 - DNA, 328 bp, Homo sapiens
gtagagcaagggttatggagtaggaccttagtttgaaaaccatttctgccacctcctgtcccagggtccccagggaaaaattatttaacctctctgaacatcattttctgcctctgtaagatggtggtggtagaatcaacttcagagggttttgaagatgaaaggtaattatatatataaagcacttagcccagcacctggcaaaatggaagtgctgaatcaacaatgtgtgctaccactattggtgtgcttattgatattaacttaattctcctgacacgggcatggatatacttcaacattttttttttgagaccgaatcttactc

SEQ ID NO: 410178 - DNA, 495 bp, Homo sapiens
catgagtgttgtgcagtgcaaggccggaggaggaggggccggcgcgcgcgtccgtgcgggcgcgggggcgcgcgagagtcggcggcggcgggagcggcgcgaagagggagagcgcgctcgctcgttcgcttgctcgctctgcacgcgcggccggctcggctttctcctgccctacacaatagctggtgactaactgctccgaagtggcattagcatttcacaagcaggctatccagccgctgcggtaccgtggcaagacattattttttccccctctgtcgtttattttgttttccttaaattcagtcctgggttttttgttggaaggattctgatgtgtgatgatagttggtcagtgcttcgtcttgcatttactaaaacacatctttgcagaagtgtaaagcctgtaattccctaaaaccagaagtttagtaggctttttttaattcttatggtatgcctctcgtttaattaaaaattattattggagtacac

SEQ ID NO: 410179 - DNA, 618 bp, Homo sapiens
tggaatgtttccatcatcatagaacattctgttggacagtgctgtttgaaggcttcagagcagtggttttcaacaaaggatgattttgcccccaggctacttgtggcaacatttagagactttttggttgtcacaacccagaggatattactggcacctacaggatagaagccagggatgctactaaatctactatgtcacaggacagcacatcatgatgaagaattacccggtccaaagtgtcaagagaactaagattgagaaatcctgctttagaggcacaatctcattgaatatcctcaataatcttatgaggccaggtgtggctcacgcctgtaatcctaagcacttaaggaggcagaggcaggagggaggatagcttgagctggggaatttaagacctgcctgggcaacatagcaagactctgtttaaaaaaaaaatcttataaggtacatactattcttttttataaatgaggaaacaggcctggtgagcttgaggaacttgaccaaggtcacacagctattaagctgcagagatgagacttaaacctaaagctgtgattttaaacctcttgctctgaaacactaaactgaaggtgactgtgtcagagccac

SEQ ID NO: 410180 - DNA, 1425 bp, Homo sapiens
tgcttccaaccctggacacgaaggcccccaccggccggagaacgaaaccctggggtcgtctgaagaggagggccaggagtccccagggccagacagcgaagccccagagctgctgcggagctgaacaccgaggtccccaagccctccgcaaaggacgtggagatcctggagcaagagagcgaagtcctcgagccatcagtcgagcaggacgcagagagccccgggctgtccacagctgcgggctttgagagtcctgagccaggcagagacgaccctgggccgtccgaagcgcaaagggcggaggtccaggggcagcatccccctccaggccctaagacctcctcctccaggtcaggctcggaagccccccacctgcgttttccgccgtgccccgaggctccccagcgtcccccggaggagcggttcatggagacgcccatcgagcgcgaaatccgccgcagctgcgaacgcgaggagagcctgcgccggagccggggcctgagcccgggccgcgcaggccgtgaactcgtcgagctgcgcgtgcggccggtgctcaacctgccgggtcctggccccgcgctcccgcgcgccctggagcgggcgcgggcgggcgcgcagatgcagcgggacatcgagcgggaggcccaccggcaggcggcgctggcgcgccccgcggtccccgagccgcgcgcccggtcgccgccgcagccgctgggcgaactcaagcgcttcttcgaggccgcggcggggagcggctcctcggcgggggcgggggacggcgcgggcccgcagaggctgccagagcctgggggacggccgcgctcggccgtgcagggcgggtgccgggtgctgggcagcgccccgccgcctttcactccgtcactgctggagcaggaggtgcgcgccgtgcgcgagcgcgagcaggaactgcagcgccagcggcgcagcgtctatggcaccgcggagttcaaggagcctacgccgagcctcaccgcgagcaggggcgacggaaagttggtggtgatctggcccccccgcagaaaggtctcggagaacggcctggagcaggaggagcgcaaaccttgaggtttgaaaaggctgggacccccggccggaagtaacgtacgcgtcagaggaacagggcggggggcgtctagcattaggcctggagaagggtcggctctctgcattggggaagatgaaatcgacttgcctttgtgaaattgaccagccccctctataaaacttacagtcccccattgggaaactgaccaccacccacaactccgccagtgaaactgcccagcccttctctgcctaattgcaaactgaactaccctctcccttgactgttaagagggccggagttaccgcctcgattgccccactccccccacccccaataaagcctcttctttcagggca

SEQ ID NO: 410181 - DNA, 2179 bp, Homo sapiens
tgcttccaaccctggacacgaaggcccccaccggccggagaacgaaaccctggggtcgtctgaagaggagggccaggagtccccagggccagacagcgaagccccagagctgctgcggagctgaacaccgaggtccccaagccctccgcaaaggacgtggagatcctggagcaagagagcgaagtcctcgagccatcagtcgagcaggacgcagagagccccgggctgtccacagctgcgggctttgagagtcctgagccaggcagagacgaccctgggccgtccgaagcgcaaagggcggaggtccaggggcagcatccccctccaggccctaagacctcctcctccaggtcaggctcggaagccccccacctgcgttttccgccgtgccccgaggctccccagcgtcccccggaggagcggttcatggagacgcccatcgagcgcgaaatccgccgcagctgcgaacgcgaggagagcctgcgccggagccggggcctgagcccgggccgcgcaggccgtgaactcgtcgagctgcgcgtgcggccggtgctcaacctgccgggtcctggccccgcgctcccgcgcgccctggagcgggcgcgggcgggcgcgcagatgcagcgggacatcgagcgggaggcccaccggcaggcggcgctggcgcgccccgcggtccccgagccgcgcgcccggtcgccgccgcagccgctgggcgaactcaagcgcttcttcgaggccgcggcggggagcggctcctcggcgggggcgggggacggcgcgggcccgcagaggctgccagagcctgggggacggccgcgctcggccgtgcagggcgggtgccgggtgctgggcagcgccccgccgcctttcactccgtcactgctggagcaggaggtgcgcgccgtgcgcgagcgcgagcaggaactgcagcgccagcggcgcagcgtctatggcaccgcggagttcaaggagcctacgccgagcctcaccggtaagccgcgggcgtagcaacgccgggacccccagggttccagccgcccccaccgattgcccaacttcagtggcccctcctgtggccctccgattctcggggtctctccctccaagctcccagaccccctctcaattttgtctcttgcctaccccttctggagctccattactcgctgtgatccacccctccaccgggagtgatggactctctgatccacaccacccaggctgcgcgggggtgggggcattccagatgtcttcctttttgtcgggttccagggaaccctgactgggttctggcactcctgggtcctccctctgaattttcgggctcctgcttctccattctgggttcacctccctcctccctcgggttcctgggtgcctggagttgaatggaggctttcatggggaggcggagggtgaacgcctgtgtgtgtttaaggggtgcggccggcctttcatcctggctgccgccagctggtgagctgagcgccccttcccccgcagcgagcaggggcgacggaaagttggtggtgatctggcccccccgcagaaaggtctcggagaacggcctggagcaggtgggagcccccttacccgtgtgcctctagcgcttgtcggtccccccacccctccggtgccaggacgcttggtggggaaaagtgcatcctccctggagggccactctggtcagaactcagtctgggacgcatccccggggtgaagaggagacggtggtcttgaggcccaaaccgccaccccgagcctggatgcagtgcgcaggtccctgaggccggccttccttctggtcctctgtccccaggaggagcgcaaaccttgaggtttgaaaaggctgggacccccggccggaagtaacgtacgcgtcagaggaacagggcggggggcgtctagcattaggcctggagaagggtcggctctctgcattggggaagatgaaatcgacttgcctttgtgaaattgaccagccccctctataaaacttacagtcccccattgggaaactgaccaccacccacaactccgccagtgaaactgcccagcccttctctgcctaattgcaaactgaactaccctctcccttgactgttaagagggccggagttaccgcctcgattgccccactccccccacccccaataaagcctcttctttcagggca

SEQ ID NO: 410182 - DNA, 1490 bp, Homo sapiens
tgcttccaaccctggacacgaaggcccccaccggccggagaacgaaaccctggggtcgtctgaagaggagggccaggagtccccagggccagacagcgaagccccagagctgctgcggagctgaacaccgaggtccccaagccctccgcaaaggacgtggagatcctggagcaagagagcgaagtcctcgagccatcagtcgagcaggacgcagagagccccgggctgtccacagctgcgggctttgagagtcctgagccaggcagagacgaccctgggccgtccgaagcgcaaagggcggaggtccaggggcagcatccccctccaggccctaagacctcctcctccaggtcaggctcggaagccccccacctgcgttttccgccgtgccccgaggctccccagcgtcccccggaggagcggttcatggagacgcccatcgagcgcgaaatccgccgcagctgcgaacgcgaggagagcctgcgccggagccggggcctgagcccgggccgcgcaggccgtgaactcgtcgagctgcgcgtgcggccggtgctcaacctgccgggtcctggccccgcgctcccgcgcgccctggagcgggcgcgggcgggcgcgcagatgcagcgggacatcgagcgggaggcccaccggcaggcggcgctggcgcgccccgcggtccccgagccgcgcgcccggtcgccgccgcagccgctgggcgaactcaagcgcttcttcgaggccgcggcggggagcggctcctcggcgggggcgggggacggcgcgggcccgcagaggctgccagagcctgggggacggccgcgctcggccgtgcagggcgggtgccgggtgctgggcagcgccccgccgcctttcactccgtcactgctggagcaggaggtgcgcgccgtgcgcgagcgcgagcaggaactgcagcgccagcggcgcagcgtctatggcaccgcggagttcaaggagcctacgccgagcctcaccggggtgcggccggcctttcatcctggctgccgccagctggtgagctgagcgccccttcccccgcagcgagcaggggcgacggaaagttggtggtgatctggcccccccgcagaaaggtctcggagaacggcctggagcaggaggagcgcaaaccttgaggtttgaaaaggctgggacccccggccggaagtaacgtacgcgtcagaggaacagggcggggggcgtctagcattaggcctggagaagggtcggctctctgcattggggaagatgaaatcgacttgcctttgtgaaattgaccagccccctctataaaacttacagtcccccattgggaaactgaccaccacccacaactccgccagtgaaactgcccagcccttctctgcctaattgcaaactgaactaccctctcccttgactgttaagagggccggagttaccgcctcgattgccccactccccccacccccaataaagcctcttctttcagggca

SEQ ID NO: 410183 - DNA, 441 bp, Homo sapiens
catccctcactcttgtttttgagagcacctcctgacaaacctcaaatctctgcctcagaatccgtttcctagggaacttgacccagaataagtactacggattgcgtaactcagcacagtaaggtagaaggctgcctgccttacttagttgcagatgtggggcatgaatctatagttatttctaacacatttgcaaaggcactgtcctcttggggaaagaaggaacacatagaatgcgatagatacactatactgacctgtaaagactgtttgcctagccaggtagaccaagcataaaacaaagtaaggttaaaccacattaaaaacttcagtcgaggccaggggcagtggtcacgcctgtaatcccagcactttgggaggcgaagatcggtgggtgggagtttgagaccaacatggcaaaaccgcttcctactaaaaata

SEQ ID NO: 410184 - DNA, 665 bp, Homo sapiens
gtgacagagtgagtctctgttcttcccccaaccccccaaaaaaacactaaaagggataattggccaggcacagtggctcacgcctgtaatcccagcactttgggaggccgaggtggatggatcacctgagactgggagtttgagaccagcctgaccaacatggaaaaaacccatctctactaaaaatacaaaaattagccgggcatggtggcacatgcctgtaatcccagctactcaggaggctgaggcaggagaattgcctgactctgggaggtggaggttgctgtgagccaagatcgcaccattgcactctagcctgggcaataacagcaaaactccgtctcaaaaaaaaaaaaaaaaaaaattataactgggcagtggaattgaaaatcattttaaaaaatatccaaaatacctaaggaacttgtataaataaataggaaaaaaaaagagaaaaaaagaagcccacaaaaaagcagatttgtaaatgggcaatggatttgaatagacatttagccatagaaggcatccagttggtgaaaaggcattatggaaaggtgctcagcatcactgattatcaggaaaatgaaaatgaaaaccgccacgagtggtttagaccatagcggcatgcatgaaagttttcagacctccagttgttgggagtg

SEQ ID NO: 410185 - DNA, 771 bp, Homo sapiens
caggcacccgccaccacgcccagctaatttttgtattttttagtaaagatggggtttcaccatgttggccaggctggtcttgaactcctgacctcaagtgatccgcacacctcggccttccaaagtgctgggattacaggcgtgagccactgcgtctggccctctttcttgtaatatatttaacagataattttgtgtgaatgataggtgtgttccccagaatactgatgttttcctcatactcactcactatcactgtaaatgactagtctggagtaccacctcttttttctttttaattagtacaacaggaagctgttagaccagttggagaagtgaaatgtggaggtaatttagcttattaatgacataactcagattagaaaaagaaatccaagtttcctgactctgttggttttttttgcttatgataccagcattttcctaggtatgttctgaagaatacagtttctttagaataatactatttcccaaagatttttaataggtgttagagaaaaaaagagttttgggctcatctaagtgaggaaattctgagttgatagacctggttttccgtcttctctttggcggacgccagtttgttatagatgattatttttttagtttagaaataactggatacagcttaatttacaaaaaaagtttacatcaatatttgagccaagaagtttcagagaaagatttatccttaaagtagtgtgtaattcttcatgatctcaagttttaaaaaatagacttaaggctggg

SEQ ID NO: 410186 - DNA, 372 bp, Homo sapiens
aaaaagtttacatcaatatttgagccaagaagtttcagagaaagatttatccttaaagtagtgtgtaattcttcatgatctcaagttttaaaaaatagacttaaggctgggtgcagtggctcatgcctgtaatcccagcactttgggaggctgaggcaggcggatcacttgaggtcaggagttcgagaccagcttggccaacatggtgaaactctgtgtctactaaaaatacaaaaattagccgggtgtggttgcgcatgcctgtaattccgcctactcgggaggcttgaactcaggaggcggaggctgtggcgagctgaggtcacgccagtgcactccagcctgggtgacagagcgagactccgtctccaa

SEQ ID NO: 410187 - DNA, 390 bp, Homo sapiens
tgaaaacatgaaaaacagcaaaatccaagggtgaactttgacctagattgataaccaaatctagcaaacccacatgtatatataaaatcagagtgaacactagccggggcggtggctcgcccctgtaatcttagcactttgggaggccaaggcaggtggatcacgaggtcaggagatcaagaccatcctggccagcatggtaaaaccatgtctctactaaaatacaaaaaattagccgggcatggtggtgcatgcctgtggtcccagctactcgggcggctgagacaggggaatcgcttgaatctgcagggtggaggttgcagtgagctgagattgtgccactgcactccagcctggcaacagaatgagactctatctcaaaaaaaaaaa

SEQ ID NO: 410188 - DNA, 462 bp, Homo sapiens
gttccaggcctgcttccacctctactaaacgaggaattcagactaaagggtccttgggagccatttcagctctacagctctgttttgctgctgtttccaaagctggaaatcccttttccttggagataggaacagggacagtgacagtgccttaagatctgagagaacaggccgggcacggtgactcacgcctgtaatcccagcactttgggaggccgaggcggctgatcacttgaggccaggagtttgagaccagcctggccaacatggtgaaaccccatctctactaaaaatacaaaaatcagccaggtgtggcggtgtgtgcctgtagtctcagctactggggagactgaggcaggagaattacttgaacccgggaggcccaggttgcagtgagctgagagtgcgccactgcactccagcctgggtgacatagcaagactccctctcaaaaaaggggaa

SEQ ID NO: 410189 - DNA, 2623 bp, Homo sapiens
  misc_feature (1096)..(1096): n is a, c, g, or t
  misc_feature (1500)..(1500): n is a, c, g, or t
  misc_feature (1741)..(1741): n is a, c, g, or t
ccagagcaggggacagtcctgggggctgcaggtcagtgcaatgaaacctagcccactggctcttacccttaaaagaaatactctgtgtcaaatggaaaactatgttcctcattctaatcaccaggataaccacagtcctctttggaatagcattttaaaagttgcaacatggttatgacacacttgcttgtcagtgtcttaaaactacccttcacaaggaagcagagtatcctcgtttccactgaaaatgaaacggagacttctgcctgggaagtgtagtccctggaataggccaggtcctctggcccctcggtcccacatgagctggaaggctcagctcctgccccattcccactcccacccctcccccacggtgccaagcccagcaggacggcttcctgggcaactccaccatgggcacacccctggccctcagggctgttgcctggagaactcattggcctcctgggaggtccccagttgccaggacaaggctatgtgggatggcttctccaacaacaactcgacatctcctctgcaggggtgcccctgacacaacagctggccactgggcctcccggcacccaccctgtctatgcacggggcttgtcattctgatctcagcagtcttctcaaggagcaataatcttggctcagctcttatcgtgctggactgatgaatgggggtgcctggtgaggccccaacctttccacagagtccacacatcacttcaggtgagtgtgggaatcaagtttggagacccacgctggacaggcttatctaaatcgtaagtagctcttgggcaatgcggaactcctttttacagcccaccctgctctcctcccctatatgtaggattcatggttgtagcaagtgtgaggatggacaggctcacacctgtgaccactgtgtcagagaccacatagacacagggctcccggcaagctccaacctgaccacaggctgctgtcccagcccagccttcctgcaggtcagccaaggaagcgtgtaggaaacccagtgaccagagaccctaacatgtggccttagagctgatttagaaactggagagtgaaggcatggagtgaagacacnagcagagtcaggcccgtgaaggtgaggttagggaagtaagattccccaaggagggaaaagtggagctgccgtttctccttcaggggctggcattacctttggtctatctgtgtgtgctctgccatttattgacttgggtgtctttagacacgtcatggtcacttctctgaccttccattttctcagctataaaccaggctattgttgacaataataataatagtaatacatttagcattctttaaagagttaaaggaaataatgcaggaggccaaagtgggcggatcacctgaggccaggagttcaagaccagcctggccaacgtggtgaaacctcgtctatactaaaaatacaaaaattggctgggtgtggtggcacacacctgtgtgtccagaattggtggnttcttggtctcgctgacctcaagaatgaagccgtggaccctcgcagtgagtgttacagttcttaaagatggtgtgtctggagtttgttccttcagatattcagatgtgtctggagtttcttccttctggtgggttcgtggtctcgctgacttcaagagtgaagctgcagacttttgcggtgagtgttacagctcttaaaggtggcgtgtctggagctgctggttccttctggtgggttcgnggtctcactggcttcaggagtgaaggtgcagaccttcgcggtgagtgttacagctcataaaggcggcgcacacccagagagtgagcagcagcaagatttattgcaaacagttaaagaacaaagcttccacagcgtgaaaggggaccctagcaggttgcagctgctggcacaaatagcctgcttctattcccttatctggccccacccacatcctgctgattggtccattttacagagagctgattggtccgttttacagagagctgattggtccgttttgacagagcgcagatcggtgcgtttacaaacctttagctagacacagagtgctgattggtgcgtttacaatcctttagctagacagaaaagttccccaagtccccatcggtaggagaagtccagccggcttctctcactggcactcgccatgggactttgcagcacctagcttgggcactccagccacccagagggagctcatcccctgatcaagcccagcaggcacttgctgagcccacgctcacctagaacccgtgtgtgcgcacagccctggctcctgcccacacctttccctccacacctccccgcaatcagagggaaccagctccggcctcagccagccccagagagggacccccacagcggcagctgcgagctgaagggctccttgagcgtggccagagtggacgccaatgccaaagaggcaccgagagtgagcgagggctgctagcacgttgtcacctctcacctgcactcccagctactcgggaggctcaggcaggagaatcacttgaacctgggaggtagaggttgcagtgagccgagaccataccactgcattccagcctgggtgacagagcgagactgtctcaaaaaaaaaaa

SEQ ID NO: 410190 - DNA, 300 bp, Homo sapiens
tttgatatattagccttggcagattaaaaaaaaaagatttattttggagagtaaaggaggcagaaaatagggccatggaaattgcagggtacactatggctctggggagtgtggcatgtactgggacacacctgtccctcctatattgggacaggactgataaggcttagtacactgtatcttaatttccccatctgcagaataaggggtacacctgctaatctctggccccttctagctctgagttcttagattctgacaacgttgtgtcactgtgccatttttctcaataccattctg

SEQ ID NO: 410191 - DNA, 823 bp, Homo sapiens
gcacgagagacgacgtgctgagctgccagcttagtggaagctctgctctgggtggagagcagcctcgctttggtgacgcacagtgctgggaccctccaggagccccgggattgaaggatggtggcggccgtcctgctggggctgagctggctctgctctcccctgggagctctggtcctggacttcaacaacatcaggagctctgctgacctgcatggggcccggaagggctcacagtgcctgtctgacacggactgcaataccagaaagttctgcctccagccccgcgatgagaagccgttctgtgctacatgtcgtgggttgcggaggaggtgccagcgagatgccatgtgctgccctgggacactctgtgtgaacgatgtttgtactacgatggaagatgcaaccccaatattagaaaggcagcttgatgagcaagatggcacacatgcagaaggaacaactgggcacccagtccaggaaaaccaacccaaaaggaagccaagtattaagaaatcacaaggcaggaagggacaagagggagaaagttgtctgagaacttttgactgtggccctggactttgctgtgctcgtcatttttggacgaaaatttgtaagccagtccttttggagggacaggtctgctccagaagagggcataaagacactgctcaagctccagaaatcttccagcgttgcgactgtggccctggactactgtgtcgaagccaattgaccagcaatcggcagcatgctcgattaagagtatgccaaaaaatagaaaagctataaatatttcaaaataaagaagaatccacattgc

SEQ ID NO: 410192 - DNA, 430 bp, Homo sapiens
gtaaggctgctagggaggggggcgaggtacgggactgctgacagctggggtgttttgtttaggctttagtaagtcattctgattcatgtatgaaatgtcttacctagcaggtaaattgaattggtttcggatttgggagggcatcctggtaggatcagtggccttagtgtgaatgtatgaaataaacacagtggcttttcacatcattcggccatacgtttgtctataaatcacgaaataaacgaacactttggaagctctactatgtgccagctcttttacatgtaatacgtcatgtactcttcctcacaatttgagataggtgaaacattccctaattccagatgaggaaataagactcagagatgttgaagagcttacccaagctcacacagccagcaagcaaacatgggaatgagaatttaaacag

SEQ ID NO: 410193 - DNA, 1272 bp, Homo sapiens
tccaaagatggcatacctgtactatgcagtgcaaggtgctgttcagtgctattaagggaatactgtactattttataaagataaggccatatactctcattaccataatgattattagaagtaccaaaggagtttgagggaggagagacactgattttaactgtgttgatcagagaaagctttgttgaggactttgtatttgagtggaaccctacagattgggcagaatggtggtgagtagactcatggcaggctgtattagctagagtaaggtggaggaggactaggtgtgtccagggaggattgaggggaggttgcacacgtgtacaggagctgagtgcctgctgagtagtttgtattgctatggtagacggtggggacctgttgaaaatttgatggcagtgcagtgagaattttgatatggcagtggtgcagaggaggacttggtgggggggcactgattaaaggaagaattgagagacaggcaggccaattaggggataaaaggactgttatgaaaggtcctgctataaggctatggccatgcaactagggaccaggtttttaaggtgaatgatgggaatcttcaaccaaaaggaagatgacgcattccaggtcagacttactgaattggagaatttggtgggacttggcaatggaactggttagcaggcagctggcagtgtggatctgcagcttgagaaagaggtcagaagtggagataaagacttggaaggcttccacgtggaagtgatagtcgaaggtaagggagaggatgaggtcaccatgggactgtaaagaatagaaaaaagaactgagaatgagaccttggggacgggaagagaaagaggacctgggaaaggataaaaagaacggtggctctgaaggacagtcattcctcatcacagaagatgagggaagaactgttcgatcacaggtgtgggcagcagttcaaatgctgcacaggaagaaaagtatttggttatggcaacattcccgaacctggtgttgggaggtgttccagtgttggtatgggaatcattcgatggcgccagcaccgcccagtaggaacagaatgcaagccacgtgtgttattttaaattttccaggagtcacattaaaaaagtaaacagtccaggcacggtggctcacacctgtaatcccagcactttgggaggccgaggtgagcggatcacaaggtcaggagatcgagaccatcctggccaacatggtgaaaccccgtctctactaaaaatacaaaaattagccggg

SEQ ID NO: 410194 - DNA, 453 bp, Homo sapiens
agaacattctcctggttcctgctctccattcgcagggtgagcgcccactggaagcctcgctgtgcttctgctttctcctgtagtccttggaagcaaggacttcttgttcgttctttaggaacggaagcaaacgttctcgttcagatatgtgcctctccctggtgaaggaagacctcacttcctgggatttttctgtgggatggagcagccagggaccccatctctggtgggggcggggcggaggggggtgcaccatgggcttagagcccctctgggccagtgctgcctagcctgctgcatagcccatttgttttgtagacttgcagtgccaaatttcagctttctgggctccaactatgggcttgagctcagtgctgccctagagggtcctgaatgccttcacttatggaaccttagagttgcagagaccatcagagatgatccactttcctt

SEQ ID NO: 410195 - DNA, 428 bp, Homo sapiens
tgggtgctgtcttatagagaaggcattcgaagcccagagaggtgaagcagttccctcaaggacacacagcaaggaagcggttgccccaggactcagctcaggtttgtgtaaccccaggaccgtgttccttgtcgtgggcagcgagaggccccaggcaacatagcgactccagagcagcagcaccagcacctgacggacagtaagcaagcctggatctgagagagatatcatcttgcaaggatgcctgctttacaaacatccttgaaacaacaatccagaaaaaaaaaggtgttgctgtctttgctcagaagacacacagatacgtgacagaaccatggagaattgcctcccaacgctgttcagccagagccttccacccttgtctgcaggacagtctcaacgttccaccattaaatacttcttctgtc

SEQ ID NO: 410196 - DNA, 393 bp, Homo sapiens
tatatcacgtaatcccctcacaatcttcttcttattcctttatacctgaggaaaccagagctcaaggaggttaagtaaccttgacaagctcacaacgccagtaagatggagatagggcttgaacccaggtttcctgttaagaggtctttgacaatgctgggtcttataaactccatctaagcaatttttggtaatataacccttcaaagttttgcaacttataaaaatcactgaaacctcacctttcgaggcaagaaaatggccaggcacagtggctcatgcctgtaatcgcagcactttgggaggctgaggcaggaggatcaccaggaggatcacttgagcccaggagttcatgaccagcttgagcaacatagtaagaccctttctctccta

SEQ ID NO: 410197 - DNA, 332 bp, Homo sapiens
ccaagcaactttctcacttttattcttgaagactaaatggcatccttaaaatctgatggttttctttgtacctttctggttgagtaaagaataagatagtctttttcttttttggaaaaatcgtatggctagtacaggaaatcaaggagatttttagctaatttagtaaaaaagtcagaggtggaacagaaaatacaccggctgaaaaaggagatgattgatttctaggaaatgggagattgtttggtatatttacagtaatgaagaagagttcttcctggaacaaaagtactgaataaataacaacaagagacaaaaaagaaaaatgcatt

SEQ ID NO: 410198 - DNA, 444 bp, Homo sapiens
atgtggtcgatgccacgcccctggaagtgttcttgctgtctcagcacctggaagaattcctgcctatcttcaagagagagcagattgatctagaagctctgctgctctgctctgatgaggaccttcagagcatacaaatgcagctgggtcccaggaagaaagttctgaatgctatcaacaggaggaagcaggtgcttcaacagcctgggcagctggtcgacaccagcctgtgatggagagttttggcctggagcattggggtgatgctgtggcccgctggcagcactccaggcggcaccccctctttacccaatgccagaccactgggaatggattctagggcatcggaaatgcctacctgagagagagacccaaactttactctgggaggtaggctatgcccatccaaataaatctccatgagaaacttgaggagacttcata

SEQ ID NO: 410199 - DNA, 608 bp, Homo sapiens
atgtggtcgatgccacgcccctggaagtgttcttgctgtctcagcacctggaagaattcctgcctatcttcaagagagagcagattgatctagaagctctgctgctctgctctgatgaggaccttcagagcatacaaatgcagctgggtcccaggaagaaagttctgaatgctatcaacaggaggaagcaggtgcttcaacagcctgggcagctggtcgacaccagcctgtgatggagagttttggcctggagcattggggtgatgctgtggcccgctggcagcactccaggcggcaccccctctttacccaatgccagaccactgggaatggattctagggcatcggaaatgcctacctgagagagagacccaaactttactctgggaggtaggctatgcccatccaaataaatctccatgagaaacttgaggagacttcataacaagaatctggcatttctcttcagttatcttatatgtacatataattgtttttgtggttgttttgttttgttttgttttgttttttggagatgaaggtctcagtctcttacccactgcactctagcccaggcggtaagagagactccatctcaaaaaaaaaaa

SEQ ID NO: 410200 - DNA, 554 bp, Homo sapiens
gggcagctggtcgacaccagcctgtgatggagagttttggcctggagcattggggtgatgctgtggcccgctggcagcactccaggcggcaccccctctttacccaatgccagaccactgggaatggattctagggcatcggaaatgcctacctgagagagagacccaaactttactctgggaggtaggctatgcccatccaaataaatctccatgagaaacttgaggagacttcataacaagaatctggcatttctcttcagttatcttatatgtacatataattgtttttgtggttgttttgttttgttttgttttgttttttggagatgaaggtctcagtctcttacccaggctagggtgcagtggtatgatcatagttcactgtattctcaacctcctgggctcaaatgatctcctcccacctcagcctcccaagtagctgagactacaggttcacaccccccacacctggcttattttgtatgttttagtagaggtggggtcttgccacattgcccaggctggtctcaaactcctggcctcaagcaatc

SEQ ID NO: 410201 - DNA, 1133 bp, Homo sapiens
aagtgtattggtagtgaacccagcataagtgaacacataccttctctggaggaactctccttaaaccaaggctcaaagattcccctcagatagagtcctaatgacttcattctaatataaatggacctatgtggaaacaagctaccctgagacagtcagcaaatacaacaaattacctaaactctcaaagagattacagatattagaattaccaggtgtagactaaaataagaggagatagaaaatatgatgtgggatgaagagaatcaaagttggccaagtaggtttggaaccaaagggatttgtaaatgatacatatatggtaatttaaaatttacagtgtaacatattgattaagcagattagatacagtgaaagggatgacaaaatgaaagatacacctaaagagacctagatgaaaaatagagaagaaagggtaagagatctggaggaatagaatgcaaaggtcttacgtgttgaatcagcatcccatagaaaggtacgaggatggaggatgcccagtatgcaaaggtggctgaggacttctacaaattggtgagtcctcagatagaagaagccaatgaatactaaactagagcaataaaaggtaatcctagtactagacacaatgcagtaaaactagaatattgattgatgggggcaggaggagaggaagcagttacagagaaaagacagattacccagaaagaactggctgacagatggcttatattttaacagcaaaagcagaagccagaagatagcgcaatgatagcctcaaagcgatgagaaaaaaagtcatcaatttagaattctgtactcaggaataccatcattcaagaatgaatgtaggctgggcacagtggctcatgtctgtaatcccagcactttgggaggccgaggcaggcaggtcactcgaggtcaggagtttgaggccagcctgggcaacacggtgaaaccctgtctctactaaaaatacaaaaattagccaggcatgatggcaggcgcctctaatccctgctacttgggaggctgaggcaggagaattgcttgaacccaggaggcggaggttgcagtgagctcagattgggccactgaactccagcctgggtgacagagtgagactctgtctc

SEQ ID NO: 410202 - DNA, 390 bp, Homo sapiens
ttgacaacattaacgataataaaagcatctcctgccttcaatgtgctcttcctctttagtttgaaagaaacacgagaagggaaccctggaaaggcattgggaagcctgagtcctgccctccatattgtcaaataggacttgtggcacttttgtaaagctacttaatcttttggaatcttagtgtccttacctgcacaatggacatggtagtgcctgactcatggtgttacaaagattaaagattattatttaaattagggttcagcaaggtagctggaagaaagcaataatttggtcttttttgctatcctgttaaaaataatggccacacagagcaatgaatggggtaatacagatacttaccaatgcttctggaactgagaaagtgta

SEQ ID NO: 410203 - DNA, 299 bp, Homo sapiens
ttttgaattctctttgttttcagaacatgctcaaaaaaagagttaaacttgagaccacaggtatggacaggtctaggtattcagtctgtttggctgttctgcagggtgctataaatgctaccctggtatcagtgtattctgataccaggttagtccaagtggccaatgatgggaagtgaagaactatgtgaaagaactggaatttcaggtttgggtagtgagtaattgtggccctgccttcagagtcctggaacttttcacctggttgtcagcaaaaaggcaaacacatagaaaagtca

SEQ ID NO: 410204 - DNA, 314 bp, Homo sapiens
ttttttttttaatgtgctgaacattatttagaacaacctcggaaattgctggtgtcttttattaaatatacttgctttaaggtttacgctcacatacaattatgttctttggatagaatgttacttatattccattagttaaacacagcactcatttgaaatccactttaaaactgcgtaacaacaactcccaatattcaaacacttccatgtgctagtaacctggtttctagtctttgattagcaaacatctgatgaacaaaagcaaccatggatccttttaaaacaattttgtattttatttgccataatat

SEQ ID NO: 410205 - DNA, 173 bp, Homo sapiens
tattcacctttatgtctttgtgcacagtaatctctaggttagagaatgttgacggacatgttgataattcatgacctagcttgaaagtaaacttaaagtttacatacagctggtcaatattgtgccagtggacaggagtgtcatcgatatatttaaagtgcaaatgttcatac

SEQ ID NO: 410206 - DNA, 423 bp, Homo sapiens
catgttggtggtgggctacgttcccagggccagaactcctcacctgaggtcatgagttctacaccagcctagcctggggtcagattgcttgagtttgagagagcctgggcaacgtggtcagaccctgtctcaaatttaaaaaaataaaaataaaaaacattcaacatatatgtttggagcacctactatgtgccaggcctcaaggtcatgagaaacaaaggtggatgaatgattcgaagacccgcctctggcctccccagcactgacagggtgggcttatgaaagggcttctagactgctcaccggcctgcacgtgggacacggaacctcctctgggacatggagcctactctgagggcagagattgagcatggtttacagcaggtgtgccaccctccaagccagaacagggcctaatgaaaa

SEQ ID NO: 410207 - DNA, 516 bp, Homo sapiens
tgttggaattacaggcgtgagccactgtgcctggccagtaaattctttaatatgctttttttagtttatcatttcagtttacattgttgttgattccactgttctgaaccgttgagtttgatttcattattatgtgttttatttccaagtgtgcttctctactatttttttccttttttttctgtatagtttctcttcttgtcatctgctgtttctgtagcagtttctcttgctttgtcaatgtaatatccttttaaatcccctgttaactctcaccgaggttgttgattagaatttttaaaaaagttttctgtgctttcttgccttgacttaactctttttgaggactgcttggtctcctttacagctcctgattgtcgtttataacacctagtcattttccattgtctttgcctacttacaatgaaagtctagactagtttaaattggtaatttgtattctttaatgattgttagcccccgagtgagcctcactttcatagctttccttccctc

SEQ ID NO: 410208 - DNA, 279 bp, Homo sapiens
cctcagtgcccccatacggtaggtgacattatccttgtgtgatagcttaggacacagaggagacttggctataggccaggcaaggagtcaagccaaggtctggggacccccaggtccctgcattcttggatactttgcatctttggagaaagtcattggttggccctggcactcttgaactcaggctccaaggctcagctctggggttaccttactggtgtatgtactggcttttctctagatttgttctctgcccaccaattcctgctctatgcctgg

SEQ ID NO: 410209 - DNA, 334 bp, Homo sapiens
gctcctttttttgtttttttttaaatctacgtaatcctgttttgctgagaagctttattaataacttctgagcattccctcactaatccccacagagcatctatatgtaagatctatattgcatgacactgtttaaagcaaggcaaactgaggcacaggcagaagagggagggaatcaatcccagacctccagataacaagctcagaatgttgctccccaggcctgcttgcccttctcctggtccaggaagtaccaagcaaggtggatttcttcaggaagccactgggcagcataatctagtagactgcctgggctcaaagcctgactaagccc

SEQ ID NO: 410210 - DNA, 293 bp, Homo sapiens
acccgatcccagccaggcaaagtgactgacgcaaggtcacccagcagacagttggtggagcagggagagctgtgagcattgcattgctgtgagcatagcattgtaggttcttttctgacacttcagcatcccagaagggtaggccgcagccatgataataggaacagtttgtgatcctctctgtctgccaggagctaaggctctgtgtaaaccacctcacttaatcctctcggcagccctcatgaattggtttgtaattagtatcctcacttttcatgaagaaaatccaagac

SEQ ID NO: 410211 - DNA, 175 bp, Homo sapiens
gaaataaatatggcttcctggtttttttttgtttgtttattttgttttttgacagctaaaaaacctgttcagatatctcaaggtgtgagggttgctggaaaggccaagtttcttcccttctctacctcatatggggcttaattttaaaatatcttacccttcttacctttatgcc

SEQ ID NO: 410212 - DNA, 337 bp, Homo sapiens
ctatgggtaacaagtcattatgcataaccatagatgtatattgctgtactgttcaatgtttgtattttcatattctatttcagattcctagtgtgccaataaattatgttcctaaagtgctttgcaaattgtactttagttttcttatcaaaatcagtgtagaaatcgtcaacatttttttctgtttagaaagtgtgttattagttcctacttgaagaacccattctccttcctatatattaatgataagaataatggagttcccccgcccccttttttccttccttaatccatcataacagcaaggagtgatgaggaagtcctcagtgttagtaga

SEQ ID NO: 410213 - DNA, 803 bp, Homo sapiens
tatttaaaaatgcagatttcaggccacaacccaacctaattaatctgtatctcaaaagggaaggcctacagagctgtattttttaaagggtcccctgtaacccttacatgcaaccattatttggggccaatttcaagtagctttgaaaaaatatagaccaaacaactttttaaaatttctcatcaagtccaagtaagactcccatcctgctccaattatctcctataaatgctaagggtattccaaagtttatgcttcctacaaaaactatttcagctgcagagatgtgaggggtaaaaagagagatgtgaagaaatcacagaggactctaggtagcacacctgtcttattgctctcctacaattcaaatagaaaagcagagagaatctttcatcatagttcaatacagaaagaacgtgccaaaacaagatcagggcacactgcagttatgtggggaaaagagggaggcaactaggttgcagcacacaaaggcatttttcctacagaactgacacaaaggaaaaggagtaatatcaataaagtgggggaaaaggaaaatgggatttcttcttcttcttttttgagacagagttttgctcttgtcgcccaggctggagtgcaatggtgcgatctctgctcactgcaaccctccacctcccaggttcaagtgattctcctgcctcagcctcctgagtagctgggaatacaggatgaagtgctgactctcaagcttcgtgcttcctgcatctggaaattggaagtctgcctgccagttttaagaacctattaatgtgatgaacgga

SEQ ID NO: 410214 - DNA, 415 bp, Homo sapiens
tgttggagaaaggccacactaaggatacggaggtcattgcagtaatccccaggagaattacaagggttttaaagacagttgcagtgggacgggaggagaaaagatttgatagctctaaggaggtagaatacaccataccacagcattaatcagtaagaaatatgtagaagtaaactctgtctcttgaggtttccagccgatgactatcttttgaagaaatgtccagcatattctttttttttaactgcacaagttgctttgcagaccataattggaatcccagtttatcagggggaagttgtcacatgtactgagggtatcgaaatctgaatggttaaataatcatatgataagactcaaattttcttgtaatccaggaaatgcacattgaaactataattagatcattgtatgt

SEQ ID NO: 410215 - DNA, 455 bp, Homo sapiens
aatctggatgttgcctactggcccacaaagcccaaaacatttactatatagctccctaagaaaaagtttttcaattcctcgtctatacattcagtgcaatcccaaacaaaatccctccacctcccaggttcaaacagttctcctgtctcagcctcccgagtggctgggactgcaggcacgtgccaccatgcccggctaattttttgtatttttagtagagacggggtttccccgtattggtcggttgttcttgaactcctgaccttaggtgatccacccacctcagcctcccaaagtgctgggattacaggcatgagccatcacacccagcccaccatggtttttagtataaattaacaagctagcactgtatacctatgtaacaaacctgcatgttctgcacatatatccatttttttagaagaaataaaagcaaaaattaaaaaaaaagaaat

SEQ ID NO: 410216 - DNA, 719 bp, Homo sapiens
tgactttgtccctttgcaccactgtgattgcaccactgcactctagcccaggcaacgtcgcaagtttgtgatatgcattccttagttggtgttgaacaagagtgactgatggcacgtgtcatgtcatacctatacacggcttggaaatagcttaaattattttttaaggttcaaaggttacaaagtcaggcatacagctgagtttttattattttcttttaaacacttgcttagcccttgaaaacttcctgggtgccatcatttgccctgggttaagagctcccagagcagagtgaatgtgctgaggccaccatggcctccacagctcaggggtgctccagccgtatgtgtcctggctagtccaggaggatggacatggtgaaggtgaggggagaggacactgtgacagcctctgatctgctcaagtacccatgacactgaattaatttcctttcattaatgatagtatatatcatcgtatatattctcaaagaattcacacataggcaatctcatttaatactcaaaatgttctcatttaagactcaaggctaggcacagtggctcatgcccataatgctaagacttttagaggccaaggctggaggattacttgagctcaggagtttgagaccagcctgggcaacagagtaagacctcgtctctacacaaaattttaaaagttagccgggtgtggtggtgtgcatctgtagttccag

SEQ ID NO: 410217 - DNA, 344 bp, Homo sapiens
aaggacaaaaaacagaaaatggtgccagagaccagtagttgagtgcacagatttttaaattcattttaattaggttttaagctgcttttgttttgggacttttaaaacaaaatccaaattaggcctactattcaatgtccacctgcaagaaaggaaaactttcaggccaggtgtggtggttcatgcctgtaatctcagcactttgggaggctaaggcgggtggatcacttgaggttaggagtttgagaccagcctggccaacatggcaaaatcccgtctctactaaaaatacaaaaattagccaggcatggtggcgcacgcctgtaatcccagctactcaggag

SEQ ID NO: 410218 - DNA, 306 bp, Homo sapiens
ttcactttcccatggcctgggtcccggcgacattgcctctgctcctgggaagtcccctgaataatcttgctcaaggatggtagctttgaagaggttcactaggggctttgattataagaacctgaagtacatggggattgcattttggatgctgatccggggaaccgggtgacaccacagacaccttgctgtggggcttgccgcagtaaacatcactgtcccaattccaggtagaaatgagtacatacctgtcaagggcatgtatttgtgatgaagttggcatatccgcaaaagggtccgtgctag

SEQ ID NO: 410219 - DNA, 250 bp, Homo sapiens
ctagccccaatcttactgaatttgctgcttattgtctaggggcccttgcagcttcaaagctgtcaggttcctaaatagcagttttgcatttttgtaaaggagattggtaacagaactgatataaccaaaaacagggctctgctgaatgcacagttaactaaccttttcataccatgaagagtattttttactagaggttgatctttgagttgactttctgctgtgcaaagtttactccttctgctccaaa

SEQ ID NO: 410220 - DNA, 262 bp, Homo sapiens
cctctagtctaggccgaaggggagacctagccctgcccttcccaacactaagtttgatggggtgataaggcagagtgctgtgggggaaacaggcagagtgtcaggctgtgcctcgctaggagtgtgcagatcagtggttcagaagcctctatagagcacagctcaccccgctacagtgctggccaccaatgggagaggtggaagggttggcctcagagagcttgctgcccaactaactggaaaaacaaggctgataggtgtg

SEQ ID NO: 410221 - DNA, 373 bp, Homo sapiens
actgacaagggagcttagaacatttaaagtccgtttactgtctcctgacttgggtacaattatcccccgaggccatttctcttattattttagtcatcattcattccattcctcccacatatttacctttctttgtctttgtttctggtagtttcttttagaggtttacttgggacaatctctttttgttgacagccaatgactttatgttgccttgttcatgaaatgcgtttttactcttcttagacgtcttggctgtgggccgtggctcacccctgtaatcccagtgctttgggaggctgaggtgggaggatcccttgagcccaggagttcaagatcagtctgggtaacatagtgagaacttgtctgtacc

SEQ ID NO: 410222 - DNA, 440 bp, Homo sapiens
tgtctgccagcacgcccagctaattatgtgttttcagtagagatggggtttcaccgtgttggccagggtggtctcaaactcctgacctcaagtgatccaccggcctcaggctcccaaagtgctgagattacaggcatgagcccctgcgcccagccacaagagccatcttgaacatagaataaatgtctctgtaagacgttgttagctagtcacattttctgatgtagcattagacttccagagtgacaacttagtagctattctctgtgtcacttactcttggaagttccttaaattaatttttgtttttctttttgagatgaagtcacactctgttacccaggctggaatgcattggtgccatcatggcttactgcagcctcgacctcccaggctcaagcaatccttctgccttggcctcccaaagtgctgggacaaca

SEQ ID NO: 410223 - DNA, 422 bp, Homo sapiens
gctcttgtttaaccagacaaggtgtcaggccttagcattggactcctgactgatctcttctgattcaacggttgagccagattcctcaagtgctctgttcactttgtgtccctttcacattttaggagactccaactatttttggtaggaaaacaaatatcctccaggctgccagcgagttttccaagacacatcctgattcattatacagctaccaagatacaaagccctaaaaatagggaacttgcttaaatctttcatttggcatcaggatgctaagttcatgttaactgcagtcagtattttagactgatttcatttgatttcctgggtattatgctctttggctgcggagggcaacttcttgtttatcttcatctctgcttggcttcagattaaggctttgtgctaaaaaaaaaaaa

SEQ ID NO: 410224 - DNA, 206 bp, Homo sapiens
tttaaagagctatctaaaaaatataaagaccaataggtttccaattaagtacagatggtaaataatagttgatattcagatgtgtaaaaattacacaaaaagcaatacttattttaaacttcccaaatgtgatcttcatagtttaagaacacactgtctctactgaacatacaaaaattagccagtcatggtggtgggtgcctgta

SEQ ID NO: 410225 - DNA, 387 bp, Homo sapiens
ttctgaatgaagacttaaaagatcttatccatgtttatttgtaaactataccagtattgaaactgatttagttccgttattccacaacccaatagataaaacacgtttgcaaatttgtacaaaagaccaaaaaagtactgcctaagataatataacactaactaataaatatacaagatagtaaaattagactttcaagtatgtatgaatgattgccctaagctgcaatatagcagagtattttttcccctgtaaagagttgttattttaaggaaataattcttgtattttaagaaaaacacacattctgaccagatgggaaactatacagtgtgtaactcaggtgtcctttttccttcagggcaggacctgttcttagctataagt

SEQ ID NO: 410226 - DNA, 548 bp, Homo sapiens
gtgaggttactattgaatgtaaaacaaggtactggacatcaagcatggtgctgttttctatccagcctgtccaaactgtcatctcagcaaagaagtaaggctgaaacctggggttattggaaagtaattctaatctgctttgaccattgacctgggaatgtcctgaaagatttatgtgattttgtggaatgtttcatttacattcagtggaagtagctcttcttcccaaccgtgaatttgggaaataaggtaacagtttgtctactagttgtccttcctctataagtatttctggaatagtgctgaaaagcttaacaaaaatctagttgttaaaaaatgtgattatgttgaaaataccaactttttagaattatttatgacatcatccatatatgatttaaatcgtgaatattacgacatttgtaatgctttaccagttacagagtgctttcatttactgttacataatttgaaatcagctcttggagatgaaatgattctctaagtcattgtggtgtctggaaaaaaaaaaaaaaaaaggccggcac

SEQ ID NO: 410227 - DNA, 604 bp, Homo sapiens
cccctagaaggggccggaggggcagagccccgtcagcctcccgaccctctgcaggaaatgtctgtgggaagaattcggagagcagggctgtcgcgtcccgagggtgggtcacgtggctgttgtcattccgcaaacactgttttgtacaaagctctgacccaggcccctcccgcgccgcctcacaccatcgtgtgcgcctcagattctcctcgtggctggagctcagcgccttcttctttagggatagggccagcttcctcaggggtcctggagtttcggggcagggcaggggcagccggctggtgtgtcctcttaatggctcgtgggcgtcggaaatcctcagaaatgcccaccagccctggtaccacagggagaggcgtctccgggggtttagaaatggagtctcagggctgggctcacacctgtcctccccgcactttgggaggccgaggcaggcagatcacatgaggtcaggagtttgagaccagcctggccaacatggtgaaaccccgtctctactaaaaatacaaaaattagccaggcatggtggcatgtgcctgtagtcctagctacttgggaggctgaggcaggagaatcgcttgaa

SEQ ID NO: 410228 - DNA, 463 bp, Homo sapiens
gcttctctgatttttttttccaacagttgttctgaatctttagcatgtccagtaattttttaataactttttattattgtagtaaaaacataaaattaatgatcttaaccatatttaagtgtacaatagtgtcaatattcaaacatattattcaaaaaataatcaaaatataaaagcattttagtgcgatagtatttattggagtatgtatagcagctactccagccacagttttctttctctgtaacactcaatgattcctgaagtagaaagattcccagtacatatgtttaaatgaatgctatttttaaagatacctaatccagatggtatggctagggcctattttatagcctgtttaaaaaaataaaataaaataaaattgggtggtttgtatgtggtagaagtgaattccagcaaaaggagaattcattcatttagacctttttttttgtttgagacg

SEQ ID NO: 410229 - DNA, 461 bp, Homo sapiens
ggcagggaggcggagcttgcagtaagctgagatggtgccactgcactccagcctgggcaacaaagcgagactctgtctcaaaaaaaaaattgtgaaggcttctctgatttttttttccaacagttgttctgaatctttagcatgtccagtaattttttaataactttttattattgtagtaaaaacataaaattaatgatcttaaccatatttaagtgtacaatagtgtcaatattcaaacatattattcaaaaaataatcaaaatataaaagcattttagtgcgatagtatttattggagtatgtatagcagctactccagccacagttttctttctctgtaacactcaatgattcctgaagtagaaagattcccagtacatatgtttaaatgaatgctatttttaaagatacctaatccagatggtatggctagggcctattttatagcctgtttaaaa

SEQ ID NO: 410230 - DNA, 480 bp, Homo sapiens
  misc_feature (44)..(44): n is a, c, g, or t
attcgcggccgcgtcgacgttagcccagtttatcctttcttgtnatgagctaacaaactgctacaaactgaaggaccttttcaaaaaagcaaactgaaggaccttttcaaaaaagcaagctcaatggaaaattccctgattggtaaattttccagatacaaaatttccaagcatctcaagaccatagttctcctaagtcactacttctgggatatgggaagtttccttcatgtactgtaagctgctgacatcatgcacataaatgtaaaccaaaacatgtatttcatcaaagtaactaacatgatgatgagaaacaggatattttgaaacatatttataagcaaaacatataggtcagattaagccattgaagcatctcctcagattttttagattactctgaataagaaatattttcaaaaatgatggaaatatctgtagttttacatgtgtggctgctattgaaatctctattaaccc

SEQ ID NO: 410231 - DNA, 785 bp, Homo sapiens
cccatgtctactaaaaatacaaaaatggtggtgggcccctgtaatcccagctacttgggacgctgaggcaggagaatcgcttgaacctgggaggcagaagttgcagtgagccgagatcgcaccactgcactccagcctgggagatagagcaagactccatctaaaaaaaaaaaaaaaaattaaaacaatacattagcaaaacgaggaaaaccatatgggcacgtcattcgatgtagaaaaacatttgccaacacttctacctctattcacagcaaaaactctgcacaaaccaggaatggaaggaaacatcttcagccttatgagacgcatccgggaaacagtgcagctcccatcatactcatcagtgaaagagtgagtgcttcccctcggcatgttctatacagcactggatgggagtctgcccaggcaggaggcggctgtcagagaaaatcagaactgccttgatgggcagacgacagggccatcgatgtcataaaggttgtaaggcctctacaaaacagtactagagctaaagagtaagagagttcagagaggtcacaggactcaagctcattcttgttctcggcacgggccagctccccgggaatgtcctaatttcaggcatctctcctccctggtggcagcgccgccccattccccagcccttatgttctcattccaggatgatcttgtcctccacgctcctcgctccaacctacaaggtgggccgtgcatccctgtgggtcgagaagaacccagctgttctctcttcaaaacagacatct

SEQ ID NO: 410232 - DNA, 1527 bp, Homo sapiens
gggctggaaagctcattcttcttcttcctcccagcagctctgcctggaagtcccccaatccctgtgctcctgcccccagatcgtgggcttgggggacagcaagaaagctgcaaaggactcagctggggcggctccacaaggaccccacaggcttgaggtgttgccaggattctatcccagggggttttctgggtcccccagagccctctcaagcacggggaggcagaagggtcctcgcccatttcaggaatctgcagcctggaagccacagccatggcaggcccccgatacccagtttcagtgcaaggggcagccctggtgcagatcaagaggctccaaacgtttgccttctctgtgcgctggtcagacggcagcgacaccttcgtgcgcaggagttgggacgaattcaggcagctcaagaccctcaaggagaccttcccggtggaggcgggcctgctgcggagatctgaccgcgttctcccaaagcttctcgatgcaccactgttgggacgcgtggggcgcacgagccgcggcctggcgcgcctgcagctgttggaaacctattctcggaggctgctggcgactgcagagcgcgtggcacggagcccgacgatcactggcttcttcgcaccgcaacccctggacctggagcccgcgctgccacccggcagccgggtgatcctgcccaccccagaggagcagcctctttctcgcgctgcgggccgcctctccatccacagtctggaggctcagagcctgcgctgcctgcagcccttctgtacccaggacacgcgggataggccttttcaggcgcaggcccaggagagcctggacgtgctgctgcggcacccctcaggctggtggctggtggagaacgaagaccggcagaccgcctggtttccagcgccctacctggaggaggcggccccgggccaaggccgggagggaggcccgtccctagggagcagcggtccccagttctgtgcttcccgcgcctacgagagcagccgcgcagatgagctgtccgtgcccgcgggggcgcgcgtgcgcgtgttggaaacgtcagaccgcggctggtggctatgcaggtacggcgaccgggcgggcctactccccgcggtgctgctgcggccggaagggctgggcgctctcctgagcgggacggggttccgtggaggagacgacccggcgggtgaggcccggggcttccctgaaccctcccaggccaccgcccctccccccaccgtgcccacccgaccttcgccgggcgccatccagagccgctgctgcaccgtcacacgcagggccctggagcggcgcccacggcgccagggccgccctcgagggtgcgtggactctgtgccgcaccccacgacggagcagtgagcgcgaggatcccgatgaggggatggaccgcgccatcccagggctggggaggagcggggagggcggatctccctggccagcagggatgggagggggccatttgctgttcctctgagtaaagcttgttctgcatgaccccca

SEQ ID NO: 410233 - DNA, 658 bp, Homo sapiens
ccccccgtcagcagactcaagcaaggagaatgtggagaagggtgcgggcgggcctcgtcctctgtggccccgcggtgactccaaacacccactcccaccaggtccccagttctgtgcttcccgcgcctacgagagcagccgcgcagatgagctgtccgtgcccgcgggggcgcgcgtgcgcgtgttggaaacgtcagaccgcggctggtggctatgcaggtacggcgaccgggcgggcctactccccgcggtgctgctgcggccggaagggctgggcgctctcctgagcgggacggggttccgtggaggagacgacccggcgggtgaggcccggggcttccctgaaccctcccaggccaccgcccctccccccaccgtgcccacccgaccttcgccgggcgccatccagagccgctgctgcaccgtcacacgcagggccctggagcggcgcccacggcgccagggccgccctcgagggtgcgtggactctgtgccgcaccccacgacggagcagtgagcgcgaggatcccgatgaggggatggaccgcgccatcccagggctggggaggagcggggagggcggatctccctggccagcagggatgggagggggccatttgctgttcctctgagtaaagcttgttctgcatgaccccca

SEQ ID NO: 410234 - DNA, 555 bp, Homo sapiens
gggctggaaagctcattcttcttcttcctcccagcagctctgcctggaagtcccccaatccctgtgctcctgcccccagatcgtgggcttgggggacagcaagaaagctgcaaaggactcagctggggcggctccacaaggaccccacaggcttgaggtgttgccaggattctatcccagggggttttctgggtcccccagagccctctcaagcacggggaggcagaagggtcctcgcccatttcaggaatctgcagcctggaagccacagccatggcaggcccccgatacccagtttcagtgcaaggggcagccctggtgcagatcaagaggctccaaacgtttgccttctctgtgcgctggtcagacggcagcgacaccttcgtgcgcaggagttgggacgaattcaggcagctcaagaccctcaaggagaccttcccggtggaggcgggcctgctgcggagatctgaccgcgttctcccaaagcttctcggtcaggccagcctgggtacgggagcggggaaggcggtggcttgcctgggggcgccagggacc

SEQ ID NO: 410235 - DNA, 478 bp, Homo sapiens
gatttgagtccctgcccgcttcttgcgcacaggctggtggctggtggagaacgaagaccggcagaccgcctggtttccagcgccctacctggaggaggcggccccgggccaaggccgggagggaggcccgtccctagggagcagcggtatgcgcctaaccccacccctcacgccaccactgcggcttgaccgtgtggcaagactgggccagaagcaccgcgggcagggcgggccaggagcccgtgcttggtctccgcacctagaggaagccccgaaccggtcttagagcggccccccgtcagcagactcaagcaaggagaatgtggagaagggtgcgggcgggcctcgtcctctgtggccccgcggtgactccaaacacccactcccaccaggtccccagttctgtgcttcccgcgcctacgagagcagccgcgcagatgagctgtccgtgcccgcgggggcgcgcgtgcgcgtgttg

SEQ ID NO: 410236 - DNA, 622 bp, Homo sapiens
gcggctgcctcccactggactgcctcccatcagtgactcccactggaggcccttcgtccctgctgaagctcccagcccctgccatccgggtgagggaccccgccctctcaagggtgcacagtgggctctggaagaccaatgccctggttcccgccctcagaagaccctcaaggagaccttcccggtggaggcgggcctgctgcggagatctgaccgcgttctcccaaagcttctcggtcaggccagcctgggtacgggagcggggaaggcggtggcttgcctgggggcgccagggaccagtgaagcccaaagcggcgtatcacagtacgtttttgtggtgccttaagatgcaccactgttgggacgcgtggggcgcacgagccgcggcctggcgcgcctgcagctgttggaaacctattctcggaggctgctggcgactgcagagcgcgtggcacggagcccgacgatcactggcttcttcgcaccgcaacccctggacctggagcccgcgctgccacccggcaggtgcctgactcgccccaaactcccagcatgcagcggcgtttggagctgggagaggtccagggtgggggggaacagccagcgaataggggcagagagt

SEQ ID NO: 410237 - DNA, 3929 bp, Homo sapiens
  misc_feature (2517)..(2517): n is a, c, g, or t
  misc_feature (3291)..(3291): n is a, c, g, or t
  misc_feature (3504)..(3504): n is a, c, g, or t
gaggccaccatgcaggatgtccaaggcccccgtcccggaagccccggggatgctgaagaccggcgggagctgggcttgcacaggggcgaggtcaactttggagggtctgggaagaagcgaggcaagtttgtacgggtgccgagcggagtggccccgtctgtgctctttgacctgctgcttgctgagtggcacctgccggcccccaacctggtggtgtccctggtgggtgaggagcagcctttcgccatgaagtcctggctgcgggatgtgctgcgcaaggggctggtgaaggcggctcagagcacaggagcctggatcctgaccagtgccctccgcgtgggcctggccaggcatgtcgggcaggccgtgcgcgaccactcgctggccagcacgtccaccaaggtccgtgtggttgctgtcggcatggcctcgctgggccgcgtcctgcaccgccgcattctggaggaggcccaggaggattttcctgtccactaccctgaggatgacggcggcagccagggccccctctgttcactggacagcaacctctcccacttcatcctggtggagccaggccccccggggaagggcgatgggctgacggagctgcggctgaggctggagaagcacatctcggagcagagggcgggctacgggggcactggcagcatcgagatccctgtcctctgcttgctggtcaatggtgatcccaacaccttggagaggatctccagggccgtggagcaggctgccccgtggctgatcctggtaggctcggggggcatcgccgatgtgcttgctgccctagtgaaccagccccacctcctggtgcccaaggtggccgagaagcagtttaaggagaagttccccagcaagcatttctcttgggaggacatcgtgcgctggaccaagctgctgcagaacatcacctcacaccagcacctgctcaccgtgtatgacttcgagcaggagggctccgaggagctggacacggtcatcctgaaggcgctggtgaaagcctgcaagagccacagccaggagcctcaggactatctggatgagctcaagctggccgtggcctgggaccgcgtggacatcgccaagagtgagatcttcaatggggacgtggagtggaagtcctgtgacctggaggaggtgatggtggacgccctggtcagcaacaagcccgagtttgtgcgcctctttgtggacaacggcgcagacgtggccgacttcctgacgtatgggcggctgcaggagctctaccgctccgtgtcacgcaagagcctgctcttcgacctgctgcagcggaagcaggaggaggcccggctgacgctggccggcctgggcacccagcaggcccgggagccacccgcggggccaccggccttctccctgcacgaggtctcccgcgtactcaaggacttcctgcaggacgcctgccgaggcttctaccaggacggccggccaggggaccgcaggagggcggagaagggcccggccaagcggcccacgggccagaagtggctgctggacctgaaccagaagagcgagaacccctggcgggacctgttcctgtgggccgtgctgcagaaccgccacgagatggccacctacttctgggccatgggccaggaaggtgtggcagccgcactggccgcctgcaaaatcctcaaagagatgtcgcacctggagacggaggccgaggcggcccgagccacgcgcgaggcgaaatacgagcggctggcccttgacctcttctccgagtgctacagcaacagtgaggcccgcgccttcgccctgctggtgcgccggaaccgctgctggagcaagaccacctgcctgcacctggccaccgaggctgacgccaaggccttctttgcccacgacggcgttcaggccttcctgaccaggatctggtggggggacatggccgcaggcacgcccatcctgcggctgctaggagccttcctctgccccgccctcgtctataccaacctcatcaccttcagtgaggaagctcccctgaggacaggcctggaggacctgcaggacctggacagcctggacacggagaagagcccgctgtatggcctgcagagccgggtggaggagctggtggaggcgccgagggctcagggtgaccgaggcccacgtgctgtcttcctgctcacacgctggcggaaattctggggcgctcccgtgactgtgttcctggggaacgtggtcatgtacttcgccttcctcttcctgttcacctacgtcctgctggtggacttcaggccgcccccccagggcccctcagggcccgaggtcaccctctacttctgggtctttacgctggtgctggaggaaatccggcagggcttcttcacagacgaggacacacacctggtgaagaagttcacactgtatgtgggggacaactggaacaagtgtgacatggtggccatcttcctgttcatcgtgggtgtcacctgcaggatgctgccgtcggcgtttgaggctggccgcacngtcctcgccatggacttcatggtgttcacgctgcggctgatccatatctttgccatacacaagcagctgggccccaagatcatcgtggtagagcgcatgatgaaggacgtcttcttcttcctcttctttctgagcgtgtggctcgtggcctacggtgtcaccacccaggcgctgctgcacccccatgacggccgcctggagtggatcttccgccgggtgctctaccggccctacctgcagatcttcggccagatcccactggacgagattgatgaagcccgtgtgaactgctccacccacccactgctgctggaggactcaccatcctgccccagcctctatgccaactggctggtcatcctcctgctggtcaccttcctgttggtcaccaatgtgctgctcatgaacctgctcatcgccatgttcagctacacgttccaggtggtgcagggcaacgcagacatgttctggaagttccagcgctacaacctgattgtggagtaccacgagcgccccgccctggccccgcccttcatcctgctcagccacctgagcctgacgctccgccgggtcttcaagaaggaggctgagcacaagcgggagcacctggagagagacctgccagaccccctggaccagaaggtcgtcacctgggagacagtccagaaggagaacttcctgagcaagatggagaagcggaggagggacagcgagggggaggtgctgcggaaaaccgcccacagagtggacttcattgccaagtacctcgggggnctgagagagcaagaaaagcgcatcaagtgtctggagtcacagatcaactactgctcggtgctcgtgtcctccgtggctgacgtgctggcccagggtggcggcccccggagctctcagcactgtggcgagggaagccagctggtggctgctgaccacagaggtggtttagatggctgggaacaacccggggctggccagcctccctcggacacntgagctgcttggcctgccacgtgtggggccacctctcctcagctggccaccctgcacgttgtgcactgacctttgccgacctccagcggaaccccccagggggcaccagccccccagcagacaatggccctcctggtgcctcaccacagaccctcacccaaaggaaccgctccttgtccctcctggcctccccggaggcacagcagtgtcatggggctgtctcccctgacaggcacaactccccgggcagaaaacgtgccccaccgcatccctacctggaaactgaccagcctgcactgtggaaaagctggccctgtggcgtgacgggggagcacccccatccagactgcgaagctgctctggggtctgcacccacccctgccctgacttgtgttgcctgacaagagactcatctttttttgaaa

SEQ ID NO: 410238 - DNA, 3199 bp, Homo sapiens
  misc_feature (2517)..(2517): n is a, c, g, or t
gaggccaccatgcaggatgtccaaggcccccgtcccggaagccccggggatgctgaagaccggcgggagctgggcttgcacaggggcgaggtcaactttggagggtctgggaagaagcgaggcaagtttgtacgggtgccgagcggagtggccccgtctgtgctctttgacctgctgcttgctgagtggcacctgccggcccccaacctggtggtgtccctggtgggtgaggagcagcctttcgccatgaagtcctggctgcgggatgtgctgcgcaaggggctggtgaaggcggctcagagcacaggagcctggatcctgaccagtgccctccgcgtgggcctggccaggcatgtcgggcaggccgtgcgcgaccactcgctggccagcacgtccaccaaggtccgtgtggttgctgtcggcatggcctcgctgggccgcgtcctgcaccgccgcattctggaggaggcccaggaggattttcctgtccactaccctgaggatgacggcggcagccagggccccctctgttcactggacagcaacctctcccacttcatcctggtggagccaggccccccggggaagggcgatgggctgacggagctgcggctgaggctggagaagcacatctcggagcagagggcgggctacgggggcactggcagcatcgagatccctgtcctctgcttgctggtcaatggtgatcccaacaccttggagaggatctccagggccgtggagcaggctgccccgtggctgatcctggtaggctcggggggcatcgccgatgtgcttgctgccctagtgaaccagccccacctcctggtgcccaaggtggccgagaagcagtttaaggagaagttccccagcaagcatttctcttgggaggacatcgtgcgctggaccaagctgctgcagaacatcacctcacaccagcacctgctcaccgtgtatgacttcgagcaggagggctccgaggagctggacacggtcatcctgaaggcgctggtgaaagcctgcaagagccacagccaggagcctcaggactatctggatgagctcaagctggccgtggcctgggaccgcgtggacatcgccaagagtgagatcttcaatggggacgtggagtggaagtcctgtgacctggaggaggtgatggtggacgccctggtcagcaacaagcccgagtttgtgcgcctctttgtggacaacggcgcagacgtggccgacttcctgacgtatgggcggctgcaggagctctaccgctccgtgtcacgcaagagcctgctcttcgacctgctgcagcggaagcaggaggaggcccggctgacgctggccggcctgggcacccagcaggcccgggagccacccgcggggccaccggccttctccctgcacgaggtctcccgcgtactcaaggacttcctgcaggacgcctgccgaggcttctaccaggacggccggccaggggaccgcaggagggcggagaagggcccggccaagcggcccacgggccagaagtggctgctggacctgaaccagaagagcgagaacccctggcgggacctgttcctgtgggccgtgctgcagaaccgccacgagatggccacctacttctgggccatgggccaggaaggtgtggcagccgcactggccgcctgcaaaatcctcaaagagatgtcgcacctggagacggaggccgaggcggcccgagccacgcgcgaggcgaaatacgagcggctggcccttgacctcttctccgagtgctacagcaacagtgaggcccgcgccttcgccctgctggtgcgccggaaccgctgctggagcaagaccacctgcctgcacctggccaccgaggctgacgccaaggccttctttgcccacgacggcgttcaggccttcctgaccaggatctggtggggggacatggccgcaggcacgcccatcctgcggctgctaggagccttcctctgccccgccctcgtctataccaacctcatcaccttcagtgaggaagctcccctgaggacaggcctggaggacctgcaggacctggacagcctggacacggagaagagcccgctgtatggcctgcagagccgggtggaggagctggtggaggcgccgagggctcagggtgaccgaggcccacgtgctgtcttcctgctcacacgctggcggaaattctggggcgctcccgtgactgtgttcctggggaacgtggtcatgtacttcgccttcctcttcctgttcacctacgtcctgctggtggacttcaggccgcccccccagggcccctcagggcccgaggtcaccctctacttctgggtctttacgctggtgctggaggaaatccggcagggcttcttcacagacgaggacacacacctggtgaagaagttcacactgtatgtgggggacaactggaacaagtgtgacatggtggccatcttcctgttcatcgtgggtgtcacctgcaggatgctgccgtcggcgtttgaggctggccgcacngtcctcgccatggacttcatggtgttcacgctgcggctgatccatatctttgccatacacaagcagctgggccccaagatcatcgtggtagagcgcatgatgaaggacgtcttcttcttcctcttctttctgagcgtgtggctcgtggcctacggtgtcaccacccaggcgctgctgcacccccatgacggccgcctggagtggatcttccgccgggtgctctaccggccctacctgcagatcttcggccagatcccactggacgagattgatgaagcccgtgtgaactgctccacccacccactgctgctggaggactcaccatcctgccccagcctctatgccaactggctggtcatcctccagccccccagcagacaatggccctcctggtgcctcaccacagaccctcacccaaaggaaccgctccttgtccctcctggcctccccggaggcacagcagtgtcatggggctgtctcccctgacaggcacaactccccgggcagaaaacgtgccccaccgcatccctacctggaaactgaccagcctgcactgtggaaaagctggccctgtggcgtgacgggggagcacccccatccagactgcgaagctgctctggggtctgcacccacccctgccctgacttgtgttgcctgacaagagactcatctttttttgaaa

SEQ ID NO: 410239 - DNA, 774 bp, Homo sapiens
cagccctttgagtttggtgttgttcccatttatcaggtacagaaagtgaggaacagaatgtttgcggctagacagatttggcactggttcagggtcacccacagtaagcaggggaactggaatctgagcctgcatctctccagctccaaagcctgggtgcacagcctccacgccaccctgctttctgcttgtcaggaagcatagctggcccaggcaggtgctgccactgaaatgaccactttgaaacaaccctgcaggcaaatccttgtgaaagaatttgagagaagcctttccctgcctgtcctccctaagcctggaaggccaatccctccatgcaaatgggctgggctctgagcttcagccctttcagggttaaacagtaacctttccactgcttgtggttgagcaaatgctagcaaggaacaagcccagccttgagcaaacaagacactgggccctggcccccctccttccaccagccacccggtctggggacttagagattttctttcgtcttgaagttcccaatctgatttcttagctttagggcaattgctctacaaagttggatgggaaaatacccagttattatgaaaaaggaaagaaggtttgacttgaggttgttttctttctctgagggtgagaatcaaagagcttttcagaaaaggaacttatgatcagtatagtcaccatctgtaaattttcaagtggggaaactgaggcccagcatcatttctggttcaggctatccacagagctagtgacgctcctcat

SEQ ID NO: 410240 - DNA, 291 bp, Homo sapiens
ctctgtgtgtgtgtgtgatctgctttatttgattatgtaagataaccctggaaggtcacttaagaaactgataggccaggcgtggtggctcatgcctgtaatcccagcactttgcgaagctgaggcaggaggatcacctgaggtcaggagttcaagaccagcctggccaacatggcaaaaccccacctctactaaaaatacaaaacttagcggggtgtggtggctcatgcctgtaatcccagctacttgggaggcggaggtgggagaatcgcttgaacctgggaggcggag

SEQ ID NO: 410241 - DNA, 344 bp, Homo sapiens
attgtggtagcgtcgacaaataaaatattattcattgataaacagaaatagctatcaagccacaaaaagaaatggatgaatcttaagtgcatattgctaagtgaaaggctacatactctatggttccaattatatgatattctggaaaagtgactgtagtaatagtaaaactattagtggttgctggcagaggaagcagggttgagtaggtgaagtacagagaattttttagggtggtgatgctattttgtatgatattgtaattatggatatatgatactatgtatttgttaaaacccatagaactttatagtacacagagtgaaccttaatgtatgcaaatg

SEQ ID NO: 410242 - DNA, 269 bp, Homo sapiens
ctggttcttgagcatttctagctgcggcagattcatctctgtgatagtcttggaagttttatttataaaagcctaaaactggaaaaaatcaaatatctatctatagatgacagataaacagattatggcatacccatacaatgaaatgctactcagcaattaaaaaaagaaccattatagatatgtgcagcaatgtgggtgaatttcaaattatgctgaatgagagaagcagctggaccaggaaatggagttcttgtccaccgtcgacg

SEQ ID NO: 410243 - DNA, 619 bp, Homo sapiens
tgggatttggcagatgcttctcatccttagtcttggcttgtgtgtgttttgaggaggaggaccacagagcttaagaatcattctcagcactctgtatcaggcacgcattctctcaagatgacttgccgctattgaagttgactttgatcacctggctgaggtagtgtctgtccgtgttctccactgtaaagttactctctcctctcttttcacactgtactctttggaagagagtcactatgcacagcccacacttaggatgtgggaagtccgctccacctccttgacgatggaatagctatataatttacctggggccgggcacggtggctcacacctgtcatcccagcacttgaatgggaggccgaggagggtgatcacttgaggtcaggagtttgagaccaacctggtcaacatggtgaaaccccgcctctactaaaaatacaaaaaattagccgagtgtggcagcgcatgcctgtgatcccagctactcgggaggctgaggcacaagaatcgcttgaacctgggaggtggaggttgcagtaagccaagattacatcactgcactccaacctgggcaacagagcaagaccctgtgtaaaaaaaaaaaattaaataa

SEQ ID NO: 410244 - DNA, 4935 bp, Homo sapiens
tccaaacccggcaatgttggtggctcttgcattcctctggatgagcgaatctagttggggggttcccgaaggggaaggcgcctgggctttcaatacatcctcctgaatcatactgcgtttcaggttccttagaaaaatttggatgtgtaaaaagaactcttaacggcgatgcaggtcttccacagctaaggaaccaacataaagagaaatgcagacgatataaccagtaatgaccatggtgaagataaagatattcatgaacagaacagtaagaagcctgttatggtctatatccatgggggatcttacatggagggaaccggtaacatgattgatggcagcattttggccagctatgggaacgtcatcgttatcaccattaactaccgtctgggaatactagggtttttaagtaccggtgaccaggcagcaaaaggcaactatgggctcctggatcagattcaagcactgaggtggattgaggagaatgtcggagcctttggcggggaccccaagagagtgactatctttggctcgggggctggggcctcctgtgtcagcctgttgaccctgtcccactactcagaaggtctcttccagaaggccatcattcagagcggcactgccctgtccagctgggcagtgaactaccagccggccaagtacactcggatattggcagacaaggtcggctgcaacatgctggacaccacggacatggtagaatgtctgaagaacaagaactacaaggagctcatccagcagaccatcaccccggccacctaccacatagcctttgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccatcagtgggtggcccccgccgtggccaccgccgacctgcacgcgcagtacggctcccccacctacttctatgccttctatcatcactgccaaagcgaaatgaagcccagctgggcagattcggcccatggcgatgaagtcccctatgtcttcggcatccccatgatcggtcccacagagctcttcagttgtaatttctccaagaacgacgtcatgctcagtgccgtggtgatgacctactggacgaacttcgccaaaactggtgatccaaaccaaccagttcctcaggataccaagttcattcatacaaaacccaatcgctttgaagaagtggcctggtccaagtataatcccaaagaccagctctatctgcatattggcttgaaacccagagtgagagatcactaccgggcaacgaaagtggctttctggttggaattggttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcccgaggacacaactgtcctcattgaaaccaaacgagattattccaccgaattaagtgtcaccattgccgtcggggcgtcgctcctcttcctcaacatcttagcctttgcggcgctgtactacaaaaaggacaagaggcgccatgagactcacaggcaccccagtccccagagaaacaccacaaatgatatcactcacatccagaacgaagagatcatgtctctgcagatgaagcagctggaacacgatcacgagtgtgagtcgctgcaggcacacgacacgctgaggctcacctgccctccagactacaccctcacgctgcgccggtcgccggatgacatcccatttatgacgccaaacaccatcaccatgattccaaacacattgatggggatgcagcctttacacacttttaaaaccttcagtggaggacaaaacagtacaaatttaccccacggacattccaccactagagtatagcttttccctatttcccctcctatccctctgcccctactgctcagcaatgtaaaagagacaaataaggagaaagaaaatctccaaaccaggaatgtttttgtgccactgactttagataaaaatgcaaaagggcagtcatcctgtcccagcagacccttctcattggcattttccagtattgtgagatcaatttctgaccatatgaaatgtgaaaagtatatgtttctgttacaatactgctttaagatttaaaccatgccaacagatgtttcgtgtgactaggacatcaccatttcaaggaactgtgtgtttccaacatcatggtagcagcacacacttccaaagctcagccagggacacttaatattttttaattacaatggaaatttaaacatttttatgtgggctacacaatggatggctcttcttaagtgaagaaagactctataggcttttacacagcacatgaagcagtaatccagaaagaaggaaatgcagaattttattatcaaagtaagcgaattgactgtgcagaaaaattgtagggttctgtggaaggaggtattctgccagcctgaactatatttaagaaactttgtaaaaaataaaaatgtatatagctgtgagctcaaacaaaaactgcagacaaacaaaaaagagaaaagcttttatttgtgttttcagtttgaaagaacttttagcaaggttgtgctttcaaacacatattagtcctaccaccttagttcctctacagcaaaagaggcttttcttcttaattacatgtaaacaaagacatgggattttctgacgtaagattttcatttgtaggaatatgtgatgtcaaatggaagactcagaagttttgtgtggcctatttctccctgtcaggttgcacagatgcatgtagagcattcttaggagaccattgttttagaaaactttgatttgtacatgttagttttcatgaaattgcaacacagagataggtcctaaaagtggaatgtatttaaaacttgttgaattagacacacacacacagacacacacaaagaatcagcagagaaaacaaaatacaagtcctgttctgtagttcttgccctttgaatatatttgggaagagttgcttcctatttcaggaccctgccaaaaaagaagaaagcttgcctttggtggggctatgccccttggagtaaatacagctctgtgttccctagcagctgccggaggatttggctgatgaagtacctgctcagcttagctaatcagattaaaggaagacatgtatgtcttttgtttaagcacctagtcccttatgtatcagtaaacaggtttttaaaaatcttttatgtcatttataggataaaacatatgcttgtctgaaaatatcaccttttgtggatttatctgatcaccaaataataaatattaagaagaatgggggaaaaaggatagaatattaaaactgctttgcataggtttttggggaaattaggatatcttcactgacaagacactgaatggaatttattcacccattttaaattggttacttggggatcagagatttgtctctccaacagcttgtggttttcttattactcattttcaggaaagtttgtagtattacaaggcagaaggaaacacagtagcaatggttgctctatattttgtctttcaaagattactgcattaccaagaaacagtagccaaagatgtttgaagatcatgtcccttagctgcattgtgggttattctagaaatccaatgttaaatgcctctactaaagtggggattccccataaaaattgtccagctacctgactcttttgcaataacaactttgattactgaatccatacactcaaactatagtgatatatcagtgtttgggagtgacctctagaaaaaagaaaactgtttttagaaatacataaaatcacttccaaatcctgttgcttatgttgggttaaatttgaaagcaattctctatatataaatatgtgaaatattatgatctgaacttagcacacatgaagcaacatttctttgctacacagaggtgtcttggaaagatttcattcccaattcatttttcatagatctataatcaggcaatttctgcaagcaatgtatgaccccacctgagcaaccacaaataggctctccatgaaactgcaaaggaactgatgtgtggcatccatgctggttttgtctgtctataatatgaattcaagtatctgttcatatttccaattgtctcctgctagcaatatgtgccacaacatgacagtcttgtgacatcttaaggaaaagaagagttcctgttaaatgaatagctttagcttttacaggggattatgattaaaagtgatttagtacatcttacatgatatctcatttctacgtgaaaagaagttatagaatcttcatagagttccatgagaaaaatatacttgctatttatagaaaacgagaaaaaagaaaaaaatgagaaacaagtaagaaaaaatcctttcctaggcttttccttgatcttcagaggcacacagggtttaatggttccttaggttattattttgaggttttgttctttcttttgccttaagtaatgacagaagatatatatggccagacacatatgtataaacttttcagcagcattttaataataaaatatcacactattttctaatgctttgtacaaac

SEQ ID NO: 410245 - DNA, 718 bp, Homo sapiens
gttaaactccaatgttcttctgtggataactgctcttgccatcaagttcaccctcattgacagccaagcacagtatccagttgtcaacacaaattatggtaaaatccagggcctaagaacaccattacccagtgagatcttgggtccagtggagcagtacttaggggtcccctatgcctcacccccaactggagagaggcggtttcagccaccagaatccccatcctcctggactggcatccgaaatgctactcagttttctgctgtgtgcccccagcacctggatgaaagattcttattgcatgacatgctgcccatctggtttaccaccagtttggatactttgatgacctatgttcaagatcaaaatgaagactgcctttacttaaacatctatgtgcccatggaagatggaaccaacataaagagaaatgcagacgatataaccagtaatgaccatggtgaagataaagatattcatgaacagaacagtaagaagcctgttatggtctatatccatgggggatcttacatggagggaaccggtaacatgattgatggcagcattttggccagctatgggaacgtcatcgttatcaccattaactaccgtctgggaatactaggtatgcaagaggcacgtttgtgtgggagctcaaaaatgtttaattattttaaatctcctttcactaatttaataaattttttttgagttcag

SEQ ID NO: 410246 - DNA, 532 bp, Homo sapiens
gaaccttatttgacccagcagcttccggtttctaaaaccctactcatgcagtgccaggaggaaaataaccaattggcatcacttaatgtttagtgatagaaaaagaaaagcatgcctttgttcattttctactcttctcatttcctgcctcaccattcatcaaatgaaacagtacattttcattttctctatatgacttgtagcatttttgggaatagatgatgcgcttaacatattgctgttcatttatgtgaaaagatatttctgctattgtccaaagagagtgtccatttgcaaaatatctagtgtatgaagacaagttttattttcatttttcccttgtctttatattttaaatgtagttataaaatgagagaacatgggttcacaaagaaacatgaaattcataattaataaatgtgattttctatttgttttaggtatgcaagaggcacgtttgtgtgggagctcaaaaatgtttaattattttaaatctcctttcactaatttaataaattttttttgagttcag

SEQ ID NO: 410247 - DNA, 184 bp, Homo sapiens
ttttaggttcacagtaaaatctagaaaaaggtgcagagagttcccatatatccctgtatacccacagcctttcccactgtcatgctctatgggttttgacaaatgtataatgacatgtattcaccactgtagtattatacaaagtagtttcactgccctaaacatcctttgtttcacctttcca

SEQ ID NO: 410248 - DNA, 578 bp, Homo sapiens
tcattttagtgcagtgacatgctgtgcaccaaaataaattctaggtggatttcaaagagttaaacatttttaaatggaaacaaaactagaagataaaagagaatagtcttcaaatttgtttgggagaaagatttctaactgtcagactacattgtacttttgcagatgatcatgaatatcacatgaagtgagagatgtacaaatacatccccagttacttgtcttcctgtactgacagagaacatttcctttgtcttttataagggaagaaaagactacaattcctttaggatattgcccctaatgcatgctgttctgcctcacagacatttaaaaatctgggctttgtgcagaagcatccagattttcaggaaaacagtgagaacagtagggatagatggatgccaaattacaggtcagaataagactctgctggtacaactataaaccttaacgatggctggtcactgtggctcatgcctataatcccggcaccttgggaagtggaggtgggagattgcttgagtttaggagtttgagatcaccttgggcaacatagggagatctcatctctatgg

SEQ ID NO: 410249 - DNA, 452 bp, Homo sapiens
gacaactggaatccatatgcataagaatgaagttgaaccctaaccctgcaccatatgcaaaatgttaccaccaaatggattaaagacttaaatgtaaactaaagcagtcaaactcttagaagaaatcatgggcacaagtagttgtgactttggattagactgtgatttcttggatgtgacaccaaaagcacaagtggtaaaaagaaagttgataaattgtatttaatcagaatttaaaaattttgtggtttagacaataccaacaagaatggaggccaggtgcagtggctcatacctgtaatcccagcactttgggaggctgaggtgggtagatcacctgaggtcaggagttcgagaccagcctggccaacatggtgaaaccccatctctactaaaaaacaaaaattagccaggcgtggtgctgggcgcctgtaatcccagctacttgggag

SEQ ID NO: 410250 - DNA, 629 bp, Homo sapiens
caggataaagggagcataacaaatcttggctcttaaagcttctgcaagaagtgatgctttggttaaaagaagccacagatccatgcttacctccaaaggggacaaggaagtgcaatccaacaatggacctggaatatttgtgaacaatactagagacaatcacaccaagcctatacattaacctaaaagtaatcaggatcattgaaatccctagtccagagtattcagctgaagagagaaatagtcaaccagaatataaatatgaggaaatctcacaatctgaggagagaaaacatgaaagaccaacttagagacaggatcaagcaaccagggccacctatgtctgagaggaattctggaagataaggctagaaaaaaattggggaaagacaatagtggatgagagaatagatgagaatttttctagaattgaagacaaacctgagacttaagattgaaaaataacacaaaattccaagcaagaaacatacacacacacacacacacacacacacacacacacacacacacacacacaggcccactttggagaaactgcaaaacatcaaagatcaaaagaaaattttaaaagcagctggagagaaataacaggttacttacaaagaaaa

SEQ ID NO: 410251 - DNA, 689 bp, Homo sapiens
aagcaattctcctgcctcagcctcctgagtagctgggaccacaggaggcacacggcatcacgcccggctaatttttgtaattttagtagagacagagtttttcaccgtattggtcaggctggtcttgaactcctgacctcaggtgatccacccacctcagccttccaaagtgctgggattacagactcgagccaccgtgcctggcaaccctaggggttttggccttagcagcagcagtgatagaagctgtatcagctgagatgagcaagttgggagtaggcataatacagtcactgggaatataaggagggttgttttcaccatgctcagaccctgagatgcttgtccacataggttgggatatctgggaaggaattgatattggagacatccagtatatgatagctaatgtgtggactaaggtgcgttagccatgggtcccattttggagggcacacttcataataaggtagtaaatcttttagggaaccagaaaggactgattggaggctgaggactagatgttttgcctgggtccctggcggacattattggcattcataacctgtgttatgcattcacacaggagagggaggtaagtgacaatgaatgtagggtgtatcagagggcatagcttgtcgtggggcagacttccatggagataatagagatgagatgcaggcagaagt

SEQ ID NO: 410252 - DNA, 608 bp, Homo sapiens
aagcaattctcctgcctcagcctcctgagtagctgggaccacaggaggcacacggcatcacgcccggctaatttttgtaattttagtagagacagagtttttcaccgtattggtcaggctggtcttgaactcctgacctcaggtgatccacccacctcagccttccaaagtgctgggattacagactcgagccaccgtgcctggcaaccctaggggttttggccttagcagcagcagtgatagaagctgtatcagctgagatgagcaagttgggagtaggcataatacagtcactgggaatataaggagggttgttttcaccatgctcagaccctgagatgcttgtccacataggttgggatatctgggaaggaattgatattggagacatccagtatatgatagctaatgtgtggactaaggtgcgttagccatgggtcccattttggagggcacacttcataataaggtagtaaatcttttagggaaccagaaaggactgattggaggctgaggactagatgttttgcctgggtccctggcggacatcattgtcacttacctccctctcctgtgtgaatgcataacacaggttatgaatgccaata

SEQ ID NO: 410253 - DNA, 504 bp, Homo sapiens
agacagagagctcaggccatggccccactatgaacaaagtggtcttaggacacagaaaaagagtgattggtctggcttgggagggctagaaaggcattatggatgagggaaaatttgaatcaggccttgacagatgagtagggtttcaggagctttgggaagtgatggttaaatgtgggagtgctaggtagaggcaataaagacgtagaggtggccaagctcagtgtctcacacctataattgcagcactttgggaggccgaggtggtcggatcacctaaggtcaggagttcgagaccagcctgaccaacatggagaaaccctgtctctactaaaaatacaaaattagctgggtgtggtggtgcatgcctgtaagcccagctactcgggaggatgaagcaggagaattgcttgaacctggaaggtggagtttgcagtgagccaagattgtgccattgcactccagcctgggcaacaagagtgaaactccatcttaaaaaaaaaa

SEQ ID NO: 410254 - DNA, 533 bp, Homo sapiens
agagatttctaagcatgacacagcattggtggctcaaagatgggggccgtggaaaatgtgagaagaaatgaattcaaccaacagtgagccccagggtgtttttcctgaatgtgccatttgattccatcatggagcggctgactctgagaagaattgatccagtcactggggaaaggtaccacctcatgtacaagccacctcccaccatggagatccaggctcgcctcctgcagaacccaaaggatgctgaagagcaggtcaagctgaaaatggacctgttctacaggaactcagctgacttggagcagttgtatgggtcggccatcaccctcaatggggaccaggacccatacacagtcttcgaatacatcgagagtgggatcattaatcccctgcccaagaaaatcccctgatgggttcagagccaggagcgctgccccagggaaagagttaatcccctgcccccagccccccagcctcggcacagctcccctaaaaagccaataaagcctgctggatacaaactcatacga

SEQ ID NO: 410255 - DNA, 476 bp, Homo sapiens
gagctcatccagcccttctttgaaaaggagatggcagggtgtttttcctgaatgtgccatttgattccatcatggagcggctgactctgagaagaattgatccagtcactggggaaaggtaccacctcatgtacaagccacctcccaccatggagatccaggctcgcctcctgcagaacccaaaggatgctgaagagcaggtcaagctgaaaatggacctgttctacaggaactcagctgacttggagcagttgtatgggtcggccatcaccctcaatggggaccaggacccatacacagtcttcgaatacatcgagagtgggatcattaatcccctgcccaagaaaatcccctgatgggttcagagccaggagcgctgccccagggaaagagttaatcccctgcccccagccccccagcctcggcacagctcccctaaaaagccaataaagcctgctggatacaaactcatacga

SEQ ID NO: 410256 - DNA, 503 bp, Homo sapiens
atgtcacagcatcataaaatacaggaaataaaaaccattattaatatggtttatttccttatagggtgtttttcctgaatgtgccatttgattccatcatggagcggctgactctgagaagaattgatccagtcactggggaaaggtaccacctcatgtacaagccacctcccaccatggagatccaggctcgcctcctgcagaacccaaaggatgctgaagagcaggtcaagctgaaaatggacctgttctacaggaactcagctgacttggagcagttgtatgggtcggccatcaccctcaatggggaccaggacccatacacagtcttcgaatacatcgagagtgggatcattaatcccctgcccaagaaaatcccctgatgggttcagagccaggagcgctgccccagggaaagagttaatcccctgcccccagccccccagcctcggcacagctcccctaaaaagccaataaagcctgctggatacaaactcatacga

SEQ ID NO: 410257 - DNA, 464 bp, Homo sapiens
accgcctgggctacaatcccaacagggtgtttttcctgaatgtgccatttgattccatcatggagcggctgactctgagaagaattgatccagtcactggggaaaggtaccacctcatgtacaagccacctcccaccatggagatccaggctcgcctcctgcagaacccaaaggatgctgaagagcaggtcaagctgaaaatggacctgttctacaggaactcagctgacttggagcagttgtatgggtcggccatcaccctcaatggggaccaggacccatacacagtcttcgaatacatcgagagtgggatcattaatcccctgcccaagaaaatcccctgatgggttcagagccaggagcgctgccccagggaaagagttaatcccctgcccccagccccccagcctcggcacagctcccctaaaaagccaataaagcctgctggatacaaactcatacga

SEQ ID NO: 410258 - DNA, 411 bp, Homo sapiens
tgcatccagaaaggctgggtgctacacggcgtcccgcgggacctcgaccaggcacacctgctgaaccgcctgggctacaatcccaacaggtgagctgccccagccaagccagcagccctggccaagcccctgggcaccccctctccagggctcagctgaaggggtccaggttacacaagccttcacgtgttcctgaagtggaatgtctcctggtcatccccattcccacccatcccatctgcccggtggactaggagtcaggcttgggttcaaatcctggctttcaccctccttgatggaccctcatctgtaaaacagtaataaataccagtcttgccttccttggggaattgttatacaaatcaatggatgttttcttctactatttttacagtttcatttttatattta

SEQ ID NO: 410259 - DNA, 399 bp, Homo sapiens
  misc_feature (383)..(384): n is a, c, g, or t
acaaaagcgtctgccaacccctgtgttaggtaatgaaaaaaaaaaacaattcatctttgaatttataacagtagctaatctttgaacagcactttagagtttacaaagtctgaccatgttatgttgtaataggtattattatcttcacttaactgatgaagaaattgccgacttttcttcttcttttaaattatactttaagttctagggtacaagtgcacaacgtgcaggtttgttacatatgtatacatgtgtcatgttggtgtgctgcacccattaactcgtcattcacattaggtattcctcctaatgctatctgtccccactgcccccaccccatgacaggccccggtgtgtgatgttccccacgtcgacgcggccgnnaatttagtagtagta

SEQ ID NO: 410260 - DNA, 439 bp, Homo sapiens
atgaagtttttacattaatttttggggtagaaaatacactgacaggattcaacgttgaaaaaaatgaaaagatgtactacagagtgtcttagtcccaccccagctcacagctacttagttctcctccctcaagcaaccatgttattagtttcttaggtatctttccattgaaagaaaatacatattcatatatatatataattttaacagctttttgagataaaattaacatgcatacaattcatccatttaaagtgtaattcaagccaggcgcggtggctcacatctgtaattccaacactttgagattacaggcaggaggatcgcttgagcccaagagtttgggaccaatctgagcaatatagcaagaccccatctctacaaagaataaagaaaaattagactagcttggtggcatgtgcctgtggtcccagctact

SEQ ID NO: 410261 - DNA, 216 bp, Homo sapiens
gtgtgagccaccgcgcccagcttcaacatgcattttaaccatgagaaaatcaaggaaaacccaatttatctgacttcaaatttcttgccctttcaatgaagctccctctagattacacttttttgcagaggtaagaaatggtttcagagaatggattcccctgaagtcacaggagacaaagttttaccaggctgggtaggagggaagggggtggaa

SEQ ID NO: 410262 - DNA, 509 bp, Homo sapiens
gtccagacccccagtccctcctccttcaggcccaggagtccagacccccagcccctcctccctcagacccaggagtccagaccccagcccctcctccctcagactcaggagtccaggcccccagcccctcctccctcagacccaggagtccagaccccagcccctccttctccccggccagagggagagcttggtctctggacctgccttaggaaggagagggagggcaggaaggaaaagaaaggacttggaggtggcaggagtccgagccctgctccttgtgggcgctcacactgcccccggagcctgctgggagtggggccagccgtggacagctgaggttggggtcaatgcctcctgggcacccttgcctcgccccagaccggcccgtccagtccccatcacacctcggcggcctttatttattctgttcccccagctcggccacttctctgaaggagggctgggttctgggcctgtatcgaataaacacaaacctggatggcgca

SEQ ID NO: 410263 - DNA, 2261 bp, Homo sapiens
gcggggttagacgctgtcagcctgtccagaccgttcctctgttttcgcttgttcctactaacagcgagcttccgccaatacttgttctcgttcttggttccgagcgtcccgggagccgggaagggaaggattgtctgcagggattggagcaaatatccagtggggggaaagccgggacttccgcgtcttgccggaagtgacgtgacaatcgcggccaccgccaggtggaacggcaggtgggttcaggtaccagcctggccgggacccggctgtgggaccaacgcttccggtgagcgacagaggcagctccccagggcctggagacccgtggggcggactctgggatctgagcctatcgccctggcctggagcccccctttgtacctattccccattcccctaccgagctgggcagttagccagcccactccaactctcggaaccatgtttgcagacttggattatgacatcgaagaggataaactcggaatcccgactgtgcctgggaaggtgaccctgcagaaggatgctcagaacctgatcgggatcagcattggaggaggggcccagtactgtccctgcctctatatcgtccaggtatttgacaacaccccagcagccttggacggcacagtggcagctggcgatgagatcaccggtgtcaatggcaggtcaatcaaagggaaaactaaggtggaggtggcgaagatgattcaggaggtgaagggggaggtgaccatccactacaacaagctgcaggcggaccccaagcagggcatgtccctggacattgtgttgaagaaagtcaagcaccggctggtggagaacatgagttcagggaccgcagatgctctgggcctgagccgggccatcctgtgcaatgatgggcttgtcaagaggctagaggagctggagcggaccgctgagctatacaaagggatgacggaacacaccaagaacctcctacgggccttttatgagctgtcgcagactcaccgggcctttggggacgtgttctccgtgatcggggtgcgggagccccagccagctgcgagcgaggcttttgtgaagttcgccgatgcccaccgcagcatcgagaagttcggcattcggcttctgaaaaccatcaagccgatgctgacggatctgaacacgtacctcaacaaagccatcccggacactcgcctcaccatcaagaagtacctggacgtgaagtttgagtacctgtcgtactgcctgaaggtgaaggagatggatgacgaggaatacagctgcattgccctaggcgagcccctttaccgggtgagcaccggcaactatgagtaccgcctgatcctgcgctgccgccaggaggcgcgcgcccgcttctcccagatgcgcaaggatgtgctggagaagatggagctgctggaccagaagcacgtccaggacatcgtgttccagctgcagcgcctcgtgtccaccatgtccaagtactacaacgactgctacgcagtgctgcgggatgccgacgtcttccccatcgaggtagacctggcgcacaccacattggcctatggcctcaaccaggaggagttcacagatggggaggaggaggaggaggaggaagacacggcagctggggagccgtccagggatacacgaggggctgctgggcccttggacaagggtggaagctggtgtgactcctgagtgccccgcggctgtggtgccgggggcagggtgcgtgggaggacggagcctgggagcggggcggggccgccgcgcaagggggcgacgcataaaggcctgctggcttggggcgcctgcctccctgctcctctgtcctcgcacagcgaacctgggctcctgcccaggacaggcaccagggtcatggcctgggacctggacactggcccctccaccctccctcccctcccggctccccggccagagggagagcttggtctctggacctgccttaggaaggagagggagggcaggaaggaaaagaaaggacttggaggtggcaggagtccgagccctgctccttgtgggcgctcacactgcccccggagcctgctgggagtggggccagccgtggacagctgaggttggggtcaatgcctcctgggcacccttgcctcgccccagaccggcccgtccagtccccatcacacctcggcggcctttatttattctgttcccccagctcggccacttctctgaaggagggctgggttctgggcctgtatcgaataaacacaaacctggatggcgca

SEQ ID NO: 410264 - DNA, 2163 bp, Homo sapiens
gcggggttagacgctgtcagcctgtccagaccgttcctctgttttcgcttgttcctactaacagcgagcttccgccaatacttgttctcgttcttggttccgagcgtcccgggagccgggaagggaaggattgtctgcagggattggagcaaatatccagtggggggaaagccgggacttccgcgtcttgccggaagtgacgtgacaatcgcggccaccgccaggtggaacggcaggtgggttcaggtaccagcctggccgggacccggctgtgggaccaacgcttccgttccccattcccctaccgagctgggcagttagccagcccactccaactctcggaaccatgtttgcagacttggattatgacatcgaagaggataaactcggaatcccgactgtgcctgggaaggtgaccctgcagaaggatgctcagaacctgatcgggatcagcattggaggaggggcccagtactgtccctgcctctatatcgtccaggtatttgacaacaccccagcagccttggacggcacagtggcagctggcgatgagatcaccggtgtcaatggcaggtcaatcaaagggaaaactaaggtggaggtggcgaagatgattcaggaggtgaagggggaggtgaccatccactacaacaagctgcaggcggaccccaagcagggcatgtccctggacattgtgttgaagaaagtcaagcaccggctggtggagaacatgagttcagggaccgcagatgctctgggcctgagccgggccatcctgtgcaatgatgggcttgtcaagaggctagaggagctggagcggaccgctgagctatacaaagggatgacggaacacaccaagaacctcctacgggccttttatgagctgtcgcagactcaccgggcctttggggacgtgttctccgtgatcggggtgcgggagccccagccagctgcgagcgaggcttttgtgaagttcgccgatgcccaccgcagcatcgagaagttcggcattcggcttctgaaaaccatcaagccgatgctgacggatctgaacacgtacctcaacaaagccatcccggacactcgcctcaccatcaagaagtacctggacgtgaagtttgagtacctgtcgtactgcctgaaggtgaaggagatggatgacgaggaatacagctgcattgccctaggcgagcccctttaccgggtgagcaccggcaactatgagtaccgcctgatcctgcgctgccgccaggaggcgcgcgcccgcttctcccagatgcgcaaggatgtgctggagaagatggagctgctggaccagaagcacgtccaggacatcgtgttccagctgcagcgcctcgtgtccaccatgtccaagtactacaacgactgctacgcagtgctgcgggatgccgacgtcttccccatcgaggtagacctggcgcacaccacattggcctatggcctcaaccaggaggagttcacagatggggaggaggaggaggaggaggaagacacggcagctggggagccgtccagggatacacgaggggctgctgggcccttggacaagggtggaagctggtgtgactcctgagtgccccgcggctgtggtgccgggggcagggtgcgtgggaggacggagcctgggagcggggcggggccgccgcgcaagggggcgacgcataaaggcctgctggcttggggcgcctgcctccctgctcctctgtcctcgcacagcgaacctgggctcctgcccaggacaggcaccagggtcatggcctgggacctggacactggcccctccaccctccctcccctcccggctccccggccagagggagagcttggtctctggacctgccttaggaaggagagggagggcaggaaggaaaagaaaggacttggaggtggcaggagtccgagccctgctccttgtgggcgctcacactgcccccggagcctgctgggagtggggccagccgtggacagctgaggttggggtcaatgcctcctgggcacccttgcctcgccccagaccggcccgtccagtccccatcacacctcggcggcctttatttattctgttcccccagctcggccacttctctgaaggagggctgggttctgggcctgtatcgaataaacacaaacctggatggcgca

SEQ ID NO: 410265 - DNA, 2110 bp, Homo sapiens
gcggggttagacgctgtcagcctgtccagaccgttcctctgttttcgcttgttcctactaacagcgagcttccgccaatacttgttctcgttcttggttccgagcgtcccgggagccgggaagggaaggattgtctgcagggattggagcaaatatccagtggggggaaagccgggacttccgcgtcttgccggaagtgacgtgacaatcgcggccaccgccaggtggaacggcagttccccattcccctaccgagctgggcagttagccagcccactccaactctcggaaccatgtttgcagacttggattatgacatcgaagaggataaactcggaatcccgactgtgcctgggaaggtgaccctgcagaaggatgctcagaacctgatcgggatcagcattggaggaggggcccagtactgtccctgcctctatatcgtccaggtatttgacaacaccccagcagccttggacggcacagtggcagctggcgatgagatcaccggtgtcaatggcaggtcaatcaaagggaaaactaaggtggaggtggcgaagatgattcaggaggtgaagggggaggtgaccatccactacaacaagctgcaggcggaccccaagcagggcatgtccctggacattgtgttgaagaaagtcaagcaccggctggtggagaacatgagttcagggaccgcagatgctctgggcctgagccgggccatcctgtgcaatgatgggcttgtcaagaggctagaggagctggagcggaccgctgagctatacaaagggatgacggaacacaccaagaacctcctacgggccttttatgagctgtcgcagactcaccgggcctttggggacgtgttctccgtgatcggggtgcgggagccccagccagctgcgagcgaggcttttgtgaagttcgccgatgcccaccgcagcatcgagaagttcggcattcggcttctgaaaaccatcaagccgatgctgacggatctgaacacgtacctcaacaaagccatcccggacactcgcctcaccatcaagaagtacctggacgtgaagtttgagtacctgtcgtactgcctgaaggtgaaggagatggatgacgaggaatacagctgcattgccctaggcgagcccctttaccgggtgagcaccggcaactatgagtaccgcctgatcctgcgctgccgccaggaggcgcgcgcccgcttctcccagatgcgcaaggatgtgctggagaagatggagctgctggaccagaagcacgtccaggacatcgtgttccagctgcagcgcctcgtgtccaccatgtccaagtactacaacgactgctacgcagtgctgcgggatgccgacgtcttccccatcgaggtagacctggcgcacaccacattggcctatggcctcaaccaggaggagttcacagatggggaggaggaggaggaggaggaagacacggcagctggggagccgtccagggatacacgaggggctgctgggcccttggacaagggtggaagctggtgtgactcctgagtgccccgcggctgtggtgccgggggcagggtgcgtgggaggacggagcctgggagcggggcggggccgccgcgcaagggggcgacgcataaaggcctgctggcttggggcgcctgcctccctgctcctctgtcctcgcacagcgaacctgggctcctgcccaggacaggcaccagggtcatggcctgggacctggacactggcccctccaccctccctcccctcccggctccccggccagagggagagcttggtctctggacctgccttaggaaggagagggagggcaggaaggaaaagaaaggacttggaggtggcaggagtccgagccctgctccttgtgggcgctcacactgcccccggagcctgctgggagtggggccagccgtggacagctgaggttggggtcaatgcctcctgggcacccttgcctcgccccagaccggcccgtccagtccccatcacacctcggcggcctttatttattctgttcccccagctcggccacttctctgaaggagggctgggttctgggcctgtatcgaataaacacaaacctggatggcgca

SEQ ID NO: 410266 - DNA, 1456 bp, Homo sapiens
gcggggttagacgctgtcagcctgtccagaccgttcctctgttttcgcttgttcctactaacagcgagcttccgccaatacttgttctcgttcttggttccgagcgtcccgggagccgggaagggaaggattgtctgcagggattggagcaaatatccagtggggggaaagccgggacttccgcgtcttgccggaagtgacgtgacaatcgcggccaccgccaggtggaacggcaggtgggttcaggtaccagcctggccgggacccggctgtgggaccaacgcttccggtgagcgacagaggcagctccccagggcctggagacccgtggggcggactctgggatctgagcctatcgccctggcctggagcccccctttgtacctattccccattcccctaccgagctgggcagttagccagcccactccaactctcggaaccatgtttgcagacttggattatgacatcgaagaggataaactcggaatcccgactgtgcctgggaaggtgaccctgcagaaggatgctcagaacctgatcgggatcagcattggaggaggggcccagtactgtccctgcctctatatcgtccaggtatttgacaacaccccagcagccttggacggcacagtggcagctggcgatgagatcaccggtgtcaatggcaggtcaatcaaagggaaaactaaggtggaggtggcgaagatgattcaggaggtgaagggggaggtgaccatccactacaacaagctgcaggcggaccccaagcagggcatgtccctggacattgtgttgaagaaagtcaagcaccggctggtggagaacatgagttcagggaccgcagatgctctgggcctgagccgggccatcctgtgcaatgatgggcttgtcaagaggctagaggagctggagcggaccgctgagctatacaaagggatgacggaacacaccaagaacctcctacgggccttttatgagctgtcgcagactcaccgggcctttggggacgtgttctccgtgatcggggtgcgggagccccagccagctgcgagcgaggcttttgtgaagttcgccgatgcccaccgcagcatcgagaagttcggcattcggcttctgaaaaccatcaagccgatgctgacggatctgaacacgtacctcaacaaagccatcccggacactcgcctcaccatcaagaagtacctggacgtgaagtttgagtacctgtcgtactgcctgaaggtgaaggagatggatgacgaggaatacagctgcattgtgagtgttggagggggtggggggcttgtacttccccccacctggtctgccagggatagcaggtggctcaggccaacccgggagagaccggggggacttggctggactctcgttcctggagatttagggccatcttcccagtcccgctcgctgggcctcggggtgctgggcacccggc

SEQ ID NO: 410267 - DNA, 1836 bp, Homo sapiens
ggtcaggtacgaggcctgggtttggttgagactggattatgacatcgatgaggataaactcggaatcccgactgtgcctgggaaggtgaccctgcagaaggatgctcagaacctgatcgggatcagcattggaggaggggcccagtactgtccctgcctctatatcgtccaggtatttgacaacaccccagcagccttggacggcacagtggcagctggcgatgagatcaccggtgtcaatggcaggtcaatcaaagggaaaactaaggtggaggtggcgaagatgattcaggaggtgaagggggaggtgaccatccactacaacaagctgcaggcggaccccaagcagggcatgtccctggacattgtgttgaagaaagtcaagcaccggctggtggagaacatgagttcagggaccgcagatgctctgggcctgagccgggccatcctgtgcaatgatgggcttgtcaagaggctagaggagctggagcggaccgctgagctatacaaagggatgacggaacacaccaagaacctcctacgggccttttatgagctgtcgcagactcaccgggcctttggggacgtgttctccgtgatcggggtgcgggagccccagccagctgcgagcgaggcttttgtgaagttcgccgatgcccaccgcagcatcgagaagttcggcattcggcttctgaaaaccatcaagccgatgctgacggatctgaacacgtacctcaacaaagccatcccggacactcgcctcaccatcaagaagtacctggacgtgaagtttgagtacctgtcgtactgcctgaaggtgaaggagatggatgacgaggaatacagctgcattgccctaggcgagcccctttaccgggtgagcaccggcaactatgagtaccgcctgatcctgcgctgccgccaggaggcgcgcgcccgcttctcccagatgcgcaaggatgtgctggagaagatggagctgctggaccagaagcacgtccaggacatcgtgttccagctgcagcgcctcgtgtccaccatgtccaagtactacaacgactgctacgcagtgctgcgggatgccgacgtcttccccatcgaggtagacctggcgcacaccacattggcctatggcctcaaccaggaggagttcacagatggggaggaggaggaggaggaggaagacacggcagctggggagccgtccagggatacacgaggggctgctgggcccttggacaagggtggaagctggtgtgactcctgagtgccccgcggctgtggtgccgggggcagggtgcgtgggaggacggagcctgggagcggggcggggccgccgcgcaagggggcgacgcataaaggcctgctggcttggggcgcctgcctccctgctcctctgtcctcgcacagcgaacctgggctcctgcccaggacaggcaccagggtcatggcctgggacctggacactggcccctccaccctccctcccctcccggctccccggccagagggagagcttggtctctggacctgccttaggaaggagagggagggcaggaaggaaaagaaaggacttggaggtggcaggagtccgagccctgctccttgtgggcgctcacactgcccccggagcctgctgggagtggggccagccgtggacagctgaggttggggtcaatgcctcctgggcacccttgcctcgccccagaccggcccgtccagtccccatcacacctcggcggcctttatttattctgttcccccagctcggccacttctctgaaggagggctgggttctgggcctgtatcgaataaacacaaacctggatggcgca

SEQ ID NO: 410268 - DNA, 1041 bp, Homo sapiens
gcacagtgcggtgcgaggccgtccctgagcaggcactcctgtcccacccccgccccaggccctaggcgagcccctttaccgggtgagcaccggcaactatgagtaccgcctgatcctgcgctgccgccaggaggcgcgcgcccgcttctcccagatgcgcaaggatgtgctggagaagatggagctgctggaccagaagcacgtccaggacatcgtgttccagctgcagcgcctcgtgtccaccatgtccaagtactacaacgactgctacgcagtgctgcgggatgccgacgtcttccccatcgaggtagacctggcgcacaccacattggcctatggcctcaaccaggaggagttcacagatggggaggaggaggaggaggaggaagacacggcagctggggagccgtccagggatacacgaggggctgctgggcccttggacaagggtggaagctggtgtgactcctgagtgccccgcggctgtggtgccgggggcagggtgcgtgggaggacggagcctgggagcggggcggggccgccgcgcaagggggcgacgcataaaggcctgctggcttggggcgcctgcctccctgctcctctgtcctcgcacagcgaacctgggctcctgcccaggacaggcaccagggtcatggcctgggacctggacactggcccctccaccctccctcccctcccggctccccggccagagggagagcttggtctctggacctgccttaggaaggagagggagggcaggaaggaaaagaaaggacttggaggtggcaggagtccgagccctgctccttgtgggcgctcacactgcccccggagcctgctgggagtggggccagccgtggacagctgaggttggggtcaatgcctcctgggcacccttgcctcgccccagaccggcccgtccagtccccatcacacctcggcggcctttatttattctgttcccccagctcggccacttctctgaaggagggctgggttctgggcctgtatcgaataaacacaaacctggatggcgca

SEQ ID NO: 410269 - DNA, 805 bp, Homo sapiens
gcggggttagacgctgtcagcctgtccagaccgttcctctgttttcgcttgttcctactaacagcgagcttccgccaatacttgttctcgttcttggttccgagcgtcccgggagccgggaagggaaggattgtctgcagggattggagcaaatatccagtggggggaaagccgggacttccgcgtcttgccggaagtgacgtgacaatcgcggccaccgccaggtggaacggcaggtgggttcaggtaccagcctggccgggacccggctgtgggaccaacgcttccggtgagcgacagaggcagctccccagggcctggagacccgtggggcggactctgggatctgagcctatcgccctggcctggagcccccctttgtacctattccccattcccctaccgagctgggcagttagccagcccactccaactctcggaaccatgtttgcagacttggattatgacatcgaagaggataaactcggaatcccgactgtgcctgggaaggtgaccctgcagaaggatgctcagaacctgatcgggatcagcattggaggaggggcccagtactgtccctgcctctatatcgtccaggtatttgacaacaccccagcagccttggacggcacagtggcagctggcgatgagatcaccggtgtcaatggcaggtcaatcaaagggaaaactaaggtggaggtggcgaagatgattcaggaggtgaaggtaagggctgctgcagagcaggtgtccagaggcagcaacacatgtttctgagacctccaggctgccagaggtcccagca

SEQ ID NO: 410270 - DNA, 2482 bp, Homo sapiens
gcgtccgcccacgcgtccgctcggtccccggggccggcggacccgcgggcaggcactgcccgggctggacgacgtctggccggctcccggcgaagggcagcggaggagcggcccagagcgcgcagctagggcactggcgaaaccccgggacagtccctctccgtgcgggggcggcgcagagcagtcccatccccggggtcccgggcgcggctgactgccggctggttccctgcgcgcagtagctccccgagccgggctgcaccggaggcggcgagatggtcgcgcgcgtcggcctcctgctgcgcgccctgcagctgctactgtggggccacctggacgcccagcccgcggagcgcggaggccaggagctgcgcaaggaggcggaggcattcctagagaagtacggatacctcaatgaacaggtccccaaagctcccacctccactcgattcagcgatgccatcagagcgtttcagtgggtgtcccagctacctgtcagcggcgtgttggaccgcgccaccctgcgccagatgactcgtccccgctgcggggttacagataccaacagttatgcggcctgggctgagaggatcagtgacttgtttgctagacaccggaccaaaatgaggcgtaagaaacgctttgcaaagcaaggtaacaaatggtacaagcagcacctctcctaccgcctggtgaactggcctgagcatctgccggagccggcagttcggggcgccgtgcgcgccgccttccagttgtggagcaacgtctcagcgctggagttctgggaggccccagccacaggccccgctgacatccggctcaccttcttccaaggggaccacaacgatgggctgggcaatgcctttgatggcccagggggcgccctggcgcacgccttcctgccccgccgcggcgaagcgcacttcgaccaagatgagcgctggtccctgagccgccgccgcgggcgcaacctgttcgtggtgctggcgcacgagatcggtcacacgcttggcctcacccactcgcccgcgccgcgcgcgctcatggcgccctactacaagaggctgggccgcgacgcgctgctcagctgggacgacgtgctggccgtgcagagcctgtatgggaagcccctagggggctcagtggccgtccagctcccaggaaagctgttcactgactttgagacctgggactcctacagcccccaaggaaggcgccctgaaacgcagggccctaaatactgccactcttccttcgatgccatcactgtagacaggcaacagcaactgtacatttttaaagggagccatttctgggaggtggcagctgatggcaacgtctcagagccccgtccactgcaggaaagatgggtcgggctgccccccaacattgaggctgcggcagtgtcattgaatgatggagatttctacttcttcaaagggggtcgatgctggaggttccggggccccaagccagtgtggggtctcccacagctgtgccgggcagggggcctgccccgccatcctgacgccgccctcttcttccctcctctgcgccgcctcatcctcttcaagggtgcccgctactacgtgctggcccgagggggactgcaagtggagccctactacccccgaagtctgcaggactggggaggcatccctgaggaggtcagcggcgccctgccgaggcccgatggctccatcatcttcttccgagatgaccgctactggcgcctcgaccaggccaaactgcaggcaaccacctcgggccgctgggccaccgagctgccctggatgggctgctggcatgccaactcggggagcgccctgttctgaaggcacctcctcacctcagaaactggtggtgctctcagggcaaaatcatgttccccacccccggggcagaacccctcttagaagcctctgagtccctctgcagaagaccgggcagcaaagcctccatctggaagtctgtctgcctttgttccttgaagaatgcagcattgtctttgtctgtccccaccacatggaggtgggggtgggatcaatcttaggaaaagcaaaaaagggtcccagatcccttggccctttcctccgaggacttctatcctccccaggcctttgtttcttcggctaaaggtacagttcctttcaagaggtaacagcactgggatccaagcagggggatgaaaaactcagcagagaaattcgagaccattttgcaagactgtgcccttctcctcaggaccccctggctcagttcttgaaaaacggtgtcatatttagtcagaggccccacccccaggaagcatggatggggatgaaggcacaggcgtctccaacctcagaggccctttgtggggtcaggacacagagtgggagggagactgatgcaggcctaccagtccctggctttttgtctggggctggaataaaaaggtgccttcagctggtgggccgagaggcaggaagcagcctta

SEQ ID NO: 410271 - DNA, 2545 bp, Homo sapiens
gcgtccgcccacgcgtccgctcggtccccggggccggcggacccgcgggcaggcactgcccgggctggacgacgtctggccggctcccggcgaagggcagcggaggagcggcccagagcgcgcagctagggcactggcgaaaccccgggacagtccctctccgtgcgggggcggcgcagagcagtcccatccccggggtcccgggcgcggctgactgccggctggttccctgcgcgcagtagctccccgagccgggctgcaccggaggcggcgagatggtcgcgcgcgtcggcctcctgctgcgcgccctgcagctgctactgtggggccacctggacgcccagcccgcggagcgcggaggccaggagctgcgcaaggaggcggaggcattcctagagaagtacggatacctcaatgaacaggtccccaaagctcccacctccactcgattcagcgatgccatcagagcgtttcagtgggtgtcccagctacctgtcagcggcgtgttggaccgcgccaccctgcgccagatgactcgtccccgctgcggggttacagataccaacagttatgcggcctgggctgagaggatcagtgacttgtttgctagacaccggaccaaaatgaggcgtaagaaacgctttgcaaagcaaggtaacaaatggtacaagcagcacctctcctaccgcctggtgaactggcctgagcatctgccggagccggcagttcggggcgccgtgcgcgccgccttccagttgtggagcaacgtctcagcgctggagttctgggaggccccagccacaggccccgctgacatccggctcaccttcttccaaggggaccacaacgatgggctgggcaatgcctttgatggcccagggggcgccctggcgcacgccttcctgccccgccgcggcgaagcgcacttcgaccaagatgagcgctggtccctgagccgccgccgcgggcgcaacctgttcgtggtgctggcgcacgagatcggtcacacgcttggcctcacccactcgcccgcgccgcgcgcgctcatggcgccctactacaagaggctgggccgcgacgcgctgctcagctgggacgacgtgctggccgtgcagagcctgtatgggaagcccctagggggctcagtggccgtccagctcccaggaaagctgttcactgactttgagacctgggactcctacagcccccaaggaaggcgccctgaaacgcagggccctaaatactgccactcttccttcgatgccatcactgtagacaggcaacagcaactgtacatttttaaagggagccatttctgggaggtggcagctgatggcaacgtctcagagccccgtccactgcaggaaagatgggtcgggctgccccccaacattgaggctgcggcagtgtcattgaatgatggagatttctacttcttcaaagtgcaatccgtttgattgatatgaataccaaccatcgtgggctccagcttaaaggagagcagagggggtcgatgctggaggttccggggccccaagccagtgtggggtctcccacagctgtgccgggcagggggcctgccccgccatcctgacgccgccctcttcttccctcctctgcgccgcctcatcctcttcaagggtgcccgctactacgtgctggcccgagggggactgcaagtggagccctactacccccgaagtctgcaggactggggaggcatccctgaggaggtcagcggcgccctgccgaggcccgatggctccatcatcttcttccgagatgaccgctactggcgcctcgaccaggccaaactgcaggcaaccacctcgggccgctgggccaccgagctgccctggatgggctgctggcatgccaactcggggagcgccctgttctgaaggcacctcctcacctcagaaactggtggtgctctcagggcaaaatcatgttccccacccccggggcagaacccctcttagaagcctctgagtccctctgcagaagaccgggcagcaaagcctccatctggaagtctgtctgcctttgttccttgaagaatgcagcattgtctttgtctgtccccaccacatggaggtgggggtgggatcaatcttaggaaaagcaaaaaagggtcccagatcccttggccctttcctccgaggacttctatcctccccaggcctttgtttcttcggctaaaggtacagttcctttcaagaggtaacagcactgggatccaagcagggggatgaaaaactcagcagagaaattcgagaccattttgcaagactgtgcccttctcctcaggaccccctggctcagttcttgaaaaacggtgtcatatttagtcagaggccccacccccaggaagcatggatggggatgaaggcacaggcgtctccaacctcagaggccctttgtggggtcaggacacagagtgggagggagactgatgcaggcctaccagtccctggctttttgtctggggctggaataaaaaggtgccttcagctggtgggccgagaggcaggaagcagcctta

SEQ ID NO: 410272 - DNA, 1044 bp, Homo sapiens
gcgtccgcccacgcgtccgctcggtccccggggccggcggacccgcgggcaggcactgcccgggctggacgacgtctggccggctcccggcgaagggcagcggaggagcggcccagagcgcgcagctagggcactggcgaaaccccgggacagtccctctccgtgcgggggcggcgcagagcagtcccatccccggggtcccgggcgcggctgactgccggctggttccctgcgcgcagtagctccccgagccgggctgcaccggaggcggcgagatggtcgcgcgcgtcggcctcctgctgcgcgccctgcagctgctactgtggggccacctggacgcccagcccgcggagcgcggaggccaggagctgcgcaaggaggcggaggcattcctagagaagtacggatacctcaatgaacaggtccccaaagctcccacctccactcgattcagcgatgccatcagagcgtttcagtgggtgtcccagctacctgtcagcggcgtgttggaccgcgccaccctgcgccagatgactcgtccccgctgcggggttacagataccaacagttatgcggcctgggctgagaggatcagtgacttgtttgctagacaccggaccaaaatgaggcgtaagaaacgctttgcaaagcaaggtgagcactgttaaaatccggctaggccaagatttcccaatgtcttgaagccaatggctaggaaaacagctgagcctgggactggactttgtcagtaacctctcttccctagggcacgggaggagtgggtgaataggacctcttggcttgaggaccatgattgtgaatacagacatttaattcagaatgacacctacattgatgaattttcattgtacaagtgtttttccagatcaaacacaaaacccatgtaattccttgataaattttcaatgcagggcagataaactgttgctaacatttttcatttatatttactgaagttattttcatcagaattcattctttttcataagttattaaacaaatgtgtgatctattgaaatactt

SEQ ID NO: 410273 - DNA, 1616 bp, Homo sapiens
gcgtccgcccacgcgtccgctcggtccccggggccggcggacccgcgggcaggcactgcccgggctggacgacgtctggccggctcccggcgaagggcagcggaggagcggcccagagcgcgcagctagggcactggcgaaaccccgggacagtccctctccgtgcgggggcggcgcagagcagtcccatccccggggtcccgggcgcggctgactgccggctggttccctgcgcgcagtagctccccgagccgggctgcaccggaggcggcgagatggtcgcgcgcgtcggcctcctgctgcgcgccctgcagctgctactgtggggccacctggacgcccagcccgcggagcgcggaggccaggagctgcgcaaggaggcggaggcattcctagagaagtacggatacctcaatgaacaggtccccaaagctcccacctccactcgattcagcgatgccatcagagcgtttcagtgggtgtcccagctacctgtcagcggcgtgttggaccgcgccaccctgcgccagatgactcgtccccgctgcggggttacagataccaacagttatgcggcctgggctgagaggatcagtgacttgtttgctagacaccggaccaaaatgaggcgtaagaaacgctttgcaaagcaaggtaacaaatggtacaagcagcacctctcctaccgcctggtgaactggcctgagcatctgccggagccggcagttcggggcgccgtgcgcgccgccttccagttgtggagcaacgtctcagcgctggagttctgggaggccccagccacaggccccgctgacatccggctcaccttcttccaaggggaccacaacgatgggctgggcaatgcctttgatggcccagggggcgccctggcgcacgccttcctgccccgccgcggcgaagcgcacttcgaccaagatgagcgctggtccctgagccgccgccgcgggcgcaacctgttcgtggtgctggcgcacgagatcggtcacacgcttggcctcacccactcgcccgcgccgcgcgcgctcatggcgccctactacaagaggctgggccgcgacgcgctgctcagctgggacgacgtgctggccgtgcagagcctgtatgggaagcccctagggggctcagtggccgtccagctcccaggaaagctgttcactgactttgagacctgggactcctacagcccccaaggaaggcgccctgaaacgcagggccctaaatactgccactcttccttcgatgccatcactgtagacaggcaacagcaactgtacatttttaaagggagccatttctgggaggtggcagctgatggcaacgtctcagagccccgtccactgcaggaaagatgggtcgggctgccccccaacattgaggctgcggcagtgtcattgaatgatggagatttctacttcttcaaagcctgaggacaaagttctgggagatcggcattgactatgtaagtaacaacaacggcctaaagaagcaacaagaagggaaccgagtgcctggagaacttcatggagcagagccacttgcctactttggatcatctgtctctaagagagggaaataaacatttcttttgtgtgagc

SEQ ID NO: 410274 - DNA, 340 bp, Homo sapiens
gggaccacaacgatgggctgggcaatgcctttgatggcccaggtgctggcacaaagcctccctcccgcacagcaggaggggaacccaacttggagaagcagtttgggggtggcaatgaagcattcaccctccctgtggccttggctgaggcacatctccctgcagagaaccctcagtctcctcatcctaaaatgggaacagtggtccctgccctattatgtgtcacatgtctgaagggacagtcagatgaagctctgcaagggaagtgctttgcaaattctcaagagtattatgcattctgggagaatctcccgaggttccatcatccatcctctgcctc

SEQ ID NO: 410275 - DNA, 587 bp, Homo sapiens
gttcagaaatattgagtgacttgcctgagatcatcagctagtcagtggtgacctggaattgagtccaggtccttttgactttaatcccagaactcattctgctatagcttatagaccctcttgggcaaaagacaagaggtgagactgggcaggatgtatgtgccctgggcccttggggaccaagggaggggaaaggatgctatggaaaaagcagatattcctctctcccgcaggcattcctagagaagtacggatacctcaatgaacaggtccccaaagctcccacctccactcgattcagcgatgccatcaggtagggtggagggatgtggaggacttggggtaggggtgctaggatgccaagctctgaccatttcctccctcctcctggaagcctggctggctacaccccagggaggcagacttccctgccctcacccttaccactcaccctccccttgcggtcctttcctcctgacagagcgtttcagtgggtgtcccagctacctgtcagcggcgtgttggaccgcgccaccctgcgccagatgactcgtccccgctgcggggttacagataccaacagttat

SEQ ID NO: 410276 - DNA, 1239 bp, Homo sapiens
gaatcagccctggttctcctttccccgatctggcctcacaggaggagttggcggggagccttgggcccctctggcctcagccggatttcccagccaaacgcagagagagatgccctggaccatcttgctctttgcagctggctccttggcgatcccagcaccatccatccggctggtgcccccgtacccaagcagccaagaggaccccatccacatcgcatgcatggcccctgggaacttcccgggggcgaatttcacactgtatcgaggggggcaggtggtccagctcctgcaggcccccacggaccagcgcggggtgacatttaacctgagcggcggcagcagcaaggctccagggggacccttccactgccagtatggagtgttaggtgagctcaaccagtcccagctgtcagacctcagcgagcccgtgaacgtctccttcccagtgcccacttggatcttggtgctctccctgagcctggctggtgccctcttcctccttgctgggctggtggctgttgccctggtggtcagaaaagttaaactcagaaatttacagaagaaaagagagatcgagaatcctgctgggcccagattaacttcgacagcacagacatgtccttcgataactccctgtttaccgtctccgcgaaaacgatgccagaagaagacccggccaccttggatgatcactcaggcaccactgccacccccagcaactccaggacccggaagaggcccacttccacgtcctcctcgcctgagacccccgaattcagcactttccgggcctgccagtgaggctgaggactgggggacccctctgtctccaggcattcgggggcctgaggtccctccagctacttctgggggggctctgtcagccactttctcagggaattggacagaggaaaggaaggggaaccctggccttgggattttcatcacagaggagtgggagaggggacacaggcatgggcctggcactatacagacaacaggaagttcccctctcgaccttcggctcctcaggaccaccagagaaggagatgtcaggaccccttcttgtcccccagctgggccataagacgtcccaggtctctgcacacccgtggaattcctcccttccccagtgggtttttgagcatagggtgcccttgggtgtgttgtgtgtctgcctgctggcttgcttaagttattaattataacacgggtcaaggtgttcccaggcctcta

SEQ ID NO: 410277 - DNA, 1239 bp, Homo sapiens
gaatcagccctggttctcctttccccgatctggcctcacaggaggagttggcggggagccttgggcccctctggcctcagccggatttcccagccaaacgcagagagagatgccctggaccatcttgctctttgcagctggctccttggcgatcccagcaccatccatccggctggtgcccccgtacccaagcagccaagaggaccccatccacatcgcatgcatggcccctgggaacttcccgggggcgaatttcacactgtatcgaggggggcaggtggtccagctcctgcaggcccccacggaccagcgcggggtgacatttaacctgagcggcggcagcagcaaggctccagggggacccttccactgccagtatggagtgttaggtgagctcaaccagtcccagctgtcagacctcagcgagcccgtgaacgtctccttcccagtgcccacttggatcttggtgctctccctgagcctggctggtgccctcttcctccttgctgggctggtggctgttgccctggtggtcagaaaaggtaacagcacgcaaagcctggcacacaaagagatcgagaatcctgctgggcccagattaacttcgacagcacagacatgtccttcgataactccctgtttaccgtctccgcgaaaacgatgccagaagaagacccggccaccttggatgatcactcaggcaccactgccacccccagcaactccaggacccggaagaggcccacttccacgtcctcctcgcctgagacccccgaattcagcactttccgggcctgccagtgaggctgaggactgggggacccctctgtctccaggcattcgggggcctgaggtccctccagctacttctgggggggctctgtcagccactttctcagggaattggacagaggaaaggaaggggaaccctggccttgggattttcatcacagaggagtgggagaggggacacaggcatgggcctggcactatacagacaacaggaagttcccctctcgaccttcggctcctcaggaccaccagagaaggagatgtcaggaccccttcttgtcccccagctgggccataagacgtcccaggtctctgcacacccgtggaattcctcccttccccagtgggtttttgagcatagggtgcccttgggtgtgttgtgtgtctgcctgctggcttgcttaagttattaattataacacgggtcaaggtgttcccaggcctcta

SEQ ID NO: 410278 - DNA, 362 bp, Homo sapiens
ggttgcagtgagccaagattgagccactgcactccagcctgggtgaaagaatgagactctgtctaaaaaaaaaaaaaaaaaaaaaaaaaacagaaattgccggatacaattaggaccaaaatctaacacatgctcatttcttttttgttccagttaaactcagaaatttacagaagaaaaggtgagatcatccctggagacccacagagggtggtttggggaaagaaggacacttccctggcagggtgggcactccatgccccccacaaacagcgcctcctggtgggcatgctgcgtaataggaacaggagccatttattaagtgcctcctgtgtgctggaggactgagctgggactctctg

SEQ ID NO: 410279 - DNA, 544 bp, Homo sapiens
ccagcagagacctcagacaaatcatatccctcctggggtgaccaggtgcagatcttccagggagccgtctaatggaatttcctggttaatggacacagagaaccactgctaagaacgatttccttttctctttcaatctgcagtactttttatgaagactggtcttttgtgatggatgaagagaggtccagtatgcttcctaccatggcagcaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctgatgccaaatgcaaaaaggagcggaagaagaaaaagcaagtgaccaacattaactcatttgatgatgaggaagatgagcagaact

SEQ ID NO: 410280 - DNA, 399 bp, Homo sapiens
gtcttgctctgtcacccaggctggagtgcagtggcacgatctcggctccctgcaacctctgtgtggcaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctgatgccaaatgcaaaaaggagcggaagaagaaaaagcaagtgaccaacattaactcatttgatgatgaggaagatgagcagaact

SEQ ID NO: 410281 - DNA, 528 bp, Homo sapiens
gtcttgctctgtcacccaggctggagtgcagtggcacgatctcggctccctgcaacctctgtgtggcaggtatttttatacctatttaagatcaacgtgtctcctcttctgtaatctgttgtctgcagctgtcttctcttattggtggtatgactgcccatcagcaagcactccagacttttccctttttttggacaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctgatgccaaatgcaaaaaggagcggaagaagaaaaagcaagtgaccaacattaactcatttgatgatgaggaagatgagcagaact

SEQ ID NO: 410282 - DNA, 506 bp, Homo sapiens
gtgggcatggctgagcatgcagtgggaggcagaacaaagccagagtcccacaggtaaccttctggccagtgcctggttcacgcagctttaaggtgctccaagaggactgggagacccctcaggaccacgggagccttgggagaaaataaagtaatgcctgccaaggtgccaagccagtgtcaagcaggtgggcccaggaagtaactcagtctcaacctgcttatgccaggactcctggtgagcccacagcctgggagggcatacgagtaggtcctgtcccataatagattactcagtcctgactcatatagggggcttatgagagaaggaatcctaaggccttcccaggtggcctgcaggagcctcaaagtcagcattgcagggaacactcattcccccttcctgaagtttctttccttcaggagggagctccactggtgcagtgctgtggttctcccaccccagcccacatctccgcagagccagggtgatgcacccagtggcta

SEQ ID NO: 410283 - DNA, 621 bp, Homo sapiens
tatctagagattccagtagaaccttccagggacatggcgaggggaagggtctgataccatctccttgtgtggttagttcttcctgctgggggcccttccctcatgcccctgcccctccctcatgtgtggactgctttggttgtggagctgattgcagaagcactgggctcagagcagtaaaagatttcctccccggctgggctggcatcttctgcctcgccctccccagagctgtccaggctgtgggagctagtgtgcctggcacttcaggcatggggggaacccagcatgtgctgagcctggcacagccctgcctcctctcagcaggcacctaggttccctaaaggacacgggcacaggctgggtcgagtccccactcacttggccatgcctcaagatcaacagaggcaagagggaaactgggccccctgcctgagaagcctggggggactgctgtggcctgtcttcctggaatcggtgaccagcaaacatccctattccccttagcacttggctttgcctggcagagccccgattgccctggcagcctgagattctggcctcaggatttctgaacaagaaaaggggtttcttgcttagatgaggtgaggggcaggcagg

SEQ ID NO: 410284 - DNA, 471 bp, Homo sapiens
tatataataatattgctgaaatattcccttttctatgacctaacagtgcagtcttcctgctcttattgcaccattttatctgtaattatatcttactgaagagtttttaaatgctctgctaaaatcaagctgtactgtgagtataacactcacctagtcaacatgacattttgtctcagatttaagaaaaaaattgtgaggaaattttgacagtactttaaaaccttaaattcttttttttttattactaagtatcatgtgtacaggtacatttaccacatcatgactttaaccatctatgttcttcaaggaagatagaggcttatgaatggggacagaaatagaacgaaggtcaagaacagagtgggagaaaattaaagagtaggggagcaaggtaaggatgtctattgtgacctttatcctgcaatgaaaatacttggtagtttgtcgttcttttgtttaattgttaag

SEQ ID NO: 410285 - DNA, 1389 bp, Homo sapiens
ctaattttttttgtatttttagtagagacggggtgtcaccgtattagccaggatggtctcgatctcctgacctcgtgatccgcccgcctcagcctcccaaagtgctaggattacaggcgtgagccaccgtggctggccttttttttttttttaaagacagggtctcggtatgttgcccaggccagtctcaaactcctggcctcaggcagtcctccccgaagggctgggattataggcaggaggcgccgggcctggcctctatttctttaatacctgccctcagagccgtcctgcttttaaactgatgcaaatggcagcagtgaataatcaattcatgggttcgcttgctttgggatttagtacaagattattttaagaaataacaaaggagaaaagattgagctggattttgctgattctcaggtatctgtaccccagggtcaaccctgagattggcccaatctgccagaacctaagatgccattttgaccccagtggcagcttccagagccacaagcctgcatttgggaggaggtgcgcagcctccagggctggactccaaactcgagctgaaggaacatgctggcaggtagctctctcagggtccacctggggttccagctgctccaagacacagcacatttagccataaacatggaagggctgggacctacaggaggctcctttgtgtagaggccagggcaggcgtgtgaccttgaaccaggtggacatgaggtcccttgaactcccttctctctctggcttgttcccctgaagcactggccccccagtgctgggcttatttggccatcctgtgccagccccctggtcacccaccgtcacagtggaagctgctccctcctcttacaatggtgttccttgctctggggtctggggacaagaccatctctttccactcctggacgacactgtgcactcagtcagccgcctcctacctgccctcctgcacagggtcagaacctcctgacctggacttcgccctgggcagcttccttggaacttgttgcagcttagcatctttggaagggagcactggactaggagtcagaaggtggagttctgggtgctgttttcccactcttgggccctgggcatgttctgttctgtgcatcagatgttttctgcctgcctccccctgagctgccaccagagccacctgtagacccctgcttctcctgcccctcctgtcccttgccaggcctctggactcagtgcttcctgtcccaaggacctgttgtgtgcccagcttggaagacagtggccactcacatccaggtctctgcctggctatttgctccatgaacccatctcagatgcccctgcccccagggagccaggtgacagggtgaggtcaagtgacaagcagta

SEQ ID NO: 410286 - DNA, 431 bp, Homo sapiens
tcagcctcccaagtagctggaattacaggtgtgcactaccacgcccagctgttttttgtagagatggggttagtagagatttgtttaatagagatggggtttcaccatggtctctgctaaaccctgtctctactaaaaatacaaaaattacccaggcgtggtggcacatgcctgtagtcccagctactcaagaggctgaggcaggagaataacttgaacctgagaggtggaggttgcagtgacccaaaatcatgcactctagcctggggtctcgcttttgcccaagttagagtgcagtggcacaatcacagtggctcactgcagcctcaaactcctgggctgaagggaatcctcccacctcagcctcccaagtagctaggactataggcatgtgccatcctggcgagttaattttttgtgtgtttttattc

SEQ ID NO: 410287 - DNA, 409 bp, Homo sapiens
ctctctaaggtagtgagaggaggagagaggacatctcttcccgagcaggggaagatgtcaagtctctcacctattcagctgggtaagaggagattctttctttcaggtagaaataccattgtcatcccactccctttttagctttgtataagtaaatgcctgagtgtgctaacctatctaggtcttttgttcagcaccgtgaagctttgctattgtagacaaaaacactgaatgtactgaaactcttctgcttgtaagtgtgtattgggataaggtgtggagggaggaatcttgaatattttagaacagggttgtccaatcttttggcttccctgggccacattggaagaagaagaattgtcttggggcacacataaaatacactaacactaacgattgctgatgagct

SEQ ID NO: 410288 - DNA, 422 bp, Homo sapiens
gcccagagataggaagggagagagcaaacagcagaggaaagaaaatggggcaatggaaaaagatctacctccccccacactactaacctagtggaagtgggggaaatgggggagacactcccagactccagagagtagtaacaatcaaccaacccccacctatttacccagatctctcaggatccctggggagagaaccctcagggttagggcgcagagagagaatctgcagtctcagagcctggagagcctaaggcccaatccagcccctttgcctctgcagcagagggatggaaagaaagatatgcctgaaaggggaagtgctcaatggggaatgggtgggccacgggtggtgagctgcgaggagcaggtctgataggaactaaatgggaagagaaggagcctggcaggatacaagggga

SEQ ID NO: 410289 - DNA, 320 bp, Homo sapiens
gcacgatctcggctcactgcaacctctacctcctgggttcaagcgattctcctgcctgagaggcagggtgtcactttgttgctcaggctggagtgcagtgattccaccactgatcagttatagttttgaatttctatgtttgtgacctaggccagttcacatctccttaggcaacctagtctagtggtctcctattcccaggaggttaccatttatttatttatttatttatttatttaattttattttatttgtttatttttttttaagacagactctcaggctggagtgcagtggcacgatctcggctcactgcagtc

SEQ ID NO: 410290 - DNA, 316 bp, Homo sapiens
gggactccacgatccttccaggtcaattggattccaggcgaaggcatctgaacatgccgtatttcctgttgctttctttctgtccaattatggcaagcctgccaacaacacgttcctagcggcatgaggaaattagtccctcagaggccccaaacgtggagaaggcgaaacccaggaacatgcatgtgttcagagaagacgtcccgagtacccttgagccagcaacctgccttgggaagggcattagtccgttccacttcatggaaggctgagtggaggcgctttgatccagttaatgcccaagacgcgatctttt

SEQ ID NO: 410291 - DNA, 887 bp, Homo sapiens
aagtatttcagtttaagatatgagcctctaaaaaagtcagcagtgtgtttacatctctttatgattatgcagagaattagattaaccaagacttccttcgccataatttgaagataagacatgtagatttacagcagttggacataaagacaatttcgtgaaaacattaaactaatgtgataaatcaagagtaaatgcaaggtaccaacatacataatttacacattaagccaaattaaggatatgaactatggctgtttgatgtcaggaggggtctgtacccattttcctctcctcaataatattaaaaagttttatagaggaagttatgggcaaagataaaatggatctaggaatgaggcagaaaaattaattgtagacccgtttgataggtgttatagtgagcattaccatatagggtttgttttctaatagccctttcatccctcgagaggataaaatagaaatcacagcattgaagtggttatggaaatagggtcattatctgcaaatattttaaacctggagcccttggttgtatattcagcacattattccaaggagggtagactaaacgtttaaacctatatgacagatagattatggctgatttctttgatcacgtaaatagccccagaaattggcatttgatttagtatgtttgtattatgaacttctcccctgcaggaattatgtaattcctgtatcaatttgtatgaaaacattttcatatgtcttttgaacttttaaagaaatttattgatcagaaatttaagttaagcattaattgggttccagctttgaattctttaaattttaggagcatttttacctgatattatactagttcattgaacagagctctagcctgacattttcccatttcc

SEQ ID NO: 410292 - DNA, 311 bp, Homo sapiens
ttcattacccactaatggatcataaactgcaatttgaaaaatactgatgaataatagctgggtgcagtggctcacacctgtaatcccagtactttgggaggctgaggcgggaagatcgcttgagagtaggagttcgagactagcctgggcaacatagtgagactatgtctctaaaaaacaaaaaacggggcatgggtcatggtggcttgcacctgtagtcgtagctccacaggaggctgaggtgggaggactgcttgagcccaggagtttgaggctgcagtgaggtatgactgcatcactacactccagtc

SEQ ID NO: 410293 - DNA, 444 bp, Homo sapiens
aaaccattctgctttcattgaagtaacaaaactgctgcatttgaaagacaccataaggaaagggattcttacaagctgccccatggtgccctctttcaggattctcttcgtgaccatactaaaatacccagctcatctgtgttcacatgagacattgctttattttgatccatagatggtcactgtgggagcctggctgagtcatatggacattttaaaaagtgagacatctattggctaaatctgcagggtatctggtgctggactagggacaatgcattctggccaagggctaggctgagaaaagcactccaggtcccaccatcccccacctttggttgaatccaactctatatccaaagtgccatgggcatcaggaaccaaaggaaactgcagtggccaaaccccgggagagcttgctcccccacgctgatccattcaagg

SEQ ID NO: 410294 - DNA, 306 bp, Homo sapiens
cctttactttcttcataaacttactttcactttactctatggacttgtcttgaattctttcttgcatgagattcaagaaccatctcttggggtctggactgggactcttttccataacatgaggacttgttaagatcacccttggtgccttctgcagggaaacaagaaggaattctatgtattgtctaaagatccagacaggcagtgaaggcttcctggaggaggtaagcctgagcttagctttgatgcttagctggtgcggaggtgggcagtgcaggaagggagagcaggacatccagtctctat

SEQ ID NO: 410295 - DNA, 396 bp, Homo sapiens
gttgggttttttaattaacttttattttaggtttggggatacatatgaaggtttcttacataggtaaacacgtgtcacaggagtttgttgaacagattattttgtcaataagcaatactattttgaacagaatcttttcttttttctgagcaggagaatctgtggggctggtgggaatctgtggacaatccgtgggaaggcttggtgggcagcaggtgcgggtgaggcagggaggtggcagagagagcttgtggagatgttctggataccagagccctggcctgatcctgtaccgtccccaccttctctggatgactggggccaacctaacctgttccgaagaaaataaatactcggacataatcctttgttgtgagattaatttgttgttttgtt

SEQ ID NO: 410296 - DNA, 501 bp, Homo sapiens
gatctcacttacagtggaatctaaaaaagttgatctcacagattcatggagttaaatggtggttaccaggggtctggggatggtggggatttaaacaaagggtacaatttcctttcgactatataaataaatcatagagctttgttgtatagcatggtgactatagttaataacatcatattgtttgtttgaaaaatactaggagaatagattttgaatgttctcatcacaaaacagtatgtgaggtgagaaataggttaattagctttatttaatcattgtacagtatgtatgtgtactcaaaatactgcattgtgcaccacaaatatatacttttcatttgtcaattaaaacatttaaaaataagaattttcttgaaagttcctctatcttaatgttcaaaatgcagtgtcttgatcctctgcatttctgttccctgaattttatttctactgagtttcttaggaaacccttgttcttgtttgtaacagaaaagctgcg

SEQ ID NO: 410297 - DNA, 362 bp, Homo sapiens
atcttcaaggagaccccctcagaagacactgtgtcgctacaactccctgtcccagccatttccaatgctgctgtttttcccttcattttcatcatttcatcttcctaatacatagtattgttcaactgagtgtgctgtttatgtgcctctctccctttctcctttagagagtaagttcctcaaccactggacttttgtctgttttgttcatgaatacattcccaggatctagaacactgcccagcacagagtgagttccatgaatacatgattaagaaaggagtggtaacgggaagttatatcatctcaagacatactttccatcaagaagtcacttgctttttgctaacagagaagtcagg

SEQ ID NO: 410298 - DNA, 625 bp, Homo sapiens
gtcaatcactgagacaatgaatgttgccatgaaagaagtatttcactgggtgctgcagccaaggagaatgggagataaagtctcaaatccctgaccaactacaactggggaggcttacatagtgagggaaggaattaaggggggtaaagaagcaattatgatgaatgagggggtctggcatcttatttcgatgtggtgatctggtgagtttaagtcccttgcctgaggatcagttccctgagggaggaactcagatgagacaaatgtaaatttcaagttttaagacctgaagggtcaatttccatgtgtgttccaaaacttttaaatgtcatttctatgggacagttggaacagtttcacttctaggtatttactgatttgaaaacttgtccacataaaaacagcacacacgtgttcataacaaggttataattggttaaaacttgaagcaacacacatttcttcaataagtgaatggataaacaaactggtacatccatatgatggaatactattcaacaataaagaaatgagctatcgagccacagaaagtcctgtatgaaccttaaatgcatactgttaagtgagagaagtcattctgaacaggctgcatactatatgagtc

SEQ ID NO: 410299 - DNA, 254 bp, Homo sapiens
cactccagccgctaatcacctcagactctctaaagcctgaagacaacagctaaggctgctaaacagcagaagtggtggtccacccctctctttgggagctctgttccagggaggtttgaaactgttgctagccaaaaaacactggtgcaggtggctggaaaccctggtcaaaaggtcctgtccactgaggaggaatgggattagggattcaagtaaaaaagcagtctggccactttttcatagagcagttgtgc

SEQ ID NO: 410300 - DNA, 385 bp, Homo sapiens
tccagtatgaatcttctcatgtttactaagggttgaggatgaaataaaggctttgccacatttatcacacttgtatggtttctctccagtatgagttttgttatgtgaagaaagggttgcaggatgtttaaaagctttgccacattctttacatttgtagggttgctctccagtatgagttatcttatgaatagcaagctgtgagggccagttaaaggctttgccacactcttcacatttgtaggatttctctccagtatggattatcttatgttcagtaagcgtagaggaatacttaaagccattgccacattcttcacatttgtagggtttctctccagtatgagttatcttatgtgtagttaggtgtgaggaccatctgaag

SEQ ID NO: 410301 - DNA, 427 bp, Homo sapiens
ccttgggttcaacattgtgctttatggtttgggttctaagagagatttactagaaaggtttcgaaccactatgctgcaagattccattcacgttgtcatcaatggcttctttcctggaatcagtgtgaaatcagtcctgaattctataacagaagaagtcctcgatcatatgggtacttggtgggggcaggggagggaatatattataatactattcagttgggataatgggaaaaacagagtatatagggtatctacccagcctagaaagcacaggaacaatacgtcatatatttggaacagttattgtctgtgccatgaccttcatgataccagtgagaagccaggctagagaaataaaatcctgaattacattttagtaattgttttcaagacaacaaaaaataaaacatttcattattcttgt

SEQ ID NO: 410302 - DNA, 424 bp, Homo sapiens
gcaaactacacataacataaaatttagcatgttaaccatttctaactgtgtcattcagtggtactgagtacattcacaatgttgtgcagtcatcacactatccaactccagaagtttctgtcatctgaaatagaaactctgtacacggtcagcacggtggcttacgcctgtaatcccaacagtgtgggaggctgaggcgggcagatcatgaggtcaagagatccagaccatcctgcccaacatggtgaaaccccatctctactaaaaatacaaaaattagctgggcgtgtaatcccagctactcaggaggctgaggcaggagaattgcttgaacccaggaggcggagattgcagtgagccgagatcgagtcgagccactgcactccagcctggtgacagagcgagactctgtctcaaaaaaaaa

SEQ ID NO: 410303 - DNA, 320 bp, Homo sapiens
gcggccgcctactactactactactactactaattacgcgcgctcgcatgggtggataactatcaccaacaaaaccagggtgtgtgactctgaggctcatccccacatctcaggccttgggagcagggatatagctatgagtttgattgtgggaggaagggtgcagcattgacatggctttgggaaaaaagtgtgatctcgggcttgggtcctggagatcagggcatagctacagttctggtcccagaactaacagggcacagcagcaactcaagccccaggggattggggtaccacacaatggcgactttgggaggacg

SEQ ID NO: 410304 - DNA, 539 bp, Homo sapiens
tttgttttaggttcaggggtgcatgtgtaggtttgttatacaggtaaattacatgtcatgggggatgggtgtatgaattattttgtcaaccaggtaataagcatagtacctcataggtagtttttcagtcctcactcctcttccacgctccactctaaagtaggccccagtgtctagggtttaaactaatgaatgtttttacaattgagttttcatttactttctatgttctggcttcaacaggttactgaagctgagtctctctcctcacaggcatctaggcctgacaatcagctgtgatgatgtatctttgaacagttgtatctctaagaggaggctataattaaccttgaaattaatatcttaatatatcaaaagtcaattgatttattttaaatgcttagtttttcaactcatttttcatttactttctagtgttcattccctatgattaaaaatacatatgaatatgtatatacaggtataaatgtacatgttataaacatacatacaaatttcattttctattacctgagcac

SEQ ID NO: 410305 - DNA, 409 bp, Homo sapiens
gaactgaattctgccagcaaccgaaatggacaaggagacagacccgaacacaggccagccaacacctttcttctagcccaatgagtcctttgtttgacttcaggcctatagaactgagagataataaatttgtcttgtttaagccactaagtttctgcttgttgttatggcagttatagaaaactgataacagatagtttcacacatgtatctggcatttggcaggctatttggcttcagctgggatgacttgtctcctttctattcaccagtaaactaacctgtgcttcttcacatagtgtctcagggttgtgtgtgtgacggaatctcgctctgtcgcccaggctggagtgccgtgattgcgccattgcactccagcctgggcaacaagagcgaaactccatctcca

SEQ ID NO: 410306 - DNA, 499 bp, Homo sapiens
gaactgaattctgccagcaaccgaaatggacaaggagacagacccgaacacaggccagccaacacctttcttctagcccaatgagtcctttgtttgacttcaggcctatagaactgagagataataaatttgtcttgtttaagccactaagtttctgcttgttgttatggcagttatagaaaactgataacagatagtttcacacatgtatctggcatttggcaggctatttggcttcagctgggatgacttgtctcctttctattcaccagtaaactaacctgtgcttcttcacatagtgtctcagggttgtgtgtgtgacggaatctcgctctgtcgcccaggctggagtgccgtggtgtagtctcagctcactgcaacctccgcctcctgggttcaagtgattctcctgcctcagcctccctagtagctgggattacaggcgcctgccactacacctggctaatttttgtatttttagtagagacagggtttcacc

SEQ ID NO: 410307 - DNA, 202 bp, Homo sapiens
ctagcagttgttgtgattatggcctgttaccatttaaggtctttatcagtgctgtccgatagaaatataatatgaactacatatgtcatttaaaaaagtaaagaatcaggcaaaattaatttataatataccgtattttatttgacactgtgtctaaaacattcattgcagatataatgaatattaaaacatttataatgag

SEQ ID NO: 410308 - DNA, 593 bp, Homo sapiens
acccactgcccttccatgtgaaaatggttttttaaacaaccttggttatagttttaaacttcgctggaagaattaggtcatccaaaatatgtgtggggtgtgaagttttgttttctgcacaaagacttgtcatgagtctaaacatttctctctcaagtaatttacaatttaattaccttgtgttatgttccctcaggaaggggaggagaagggaaaggaagaaaaggcaaaaaaaaaagttttaaaaatgtgtgctgcattcaggatttagatttcaccttataaagtttttattacagcgtcctcctcccctcattgtgccatgaaatagtgaatcactctgcttggtctctgaggacagatgctgttctcatgttttatcctgacacctccgagatgagctttccatatgaaggaagggaggacatttgatgtgtccagtgttgttctggggcctccccttctctggaagtcactgacacgtgtagttttggcattgaagcccagcgggagacgacatttggccaattcccctgctgattaatgtgcctgagggtccatgccaccctttgcccccttccagtgcattagtt

SEQ ID NO: 410309 - DNA, 2524 bp, Homo sapiens
gaaagaatcaaagcgcacatcttgtactttgatgcccataggaagggctctcctctggcccctctggctttgtttggagcagaaaacaacaaatagctgcagctgaggacagccaccctttcttcgtctctgctgagcgaaggctacacggcccttcctccttgcagctgtttcaccttctaccttgcgtggagccaggcttttgcaccgaatctgagatgccattttaaacagaagactccatcctcttgaagatgggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaaaccctttccagctgcaccctctgcctgaaggatgctgtaccacagacgggttttgccaggccgggaaggacctgcgccttgtctccatttccaacgagcccatggatgtccctgcgggctttctcctcgtgggggtcaagtcccccagcctgccggaccatctcctggtgtgcgccgttgacaagaggttcttgccagatgacaatggccacaatgctcttcttggtttctctgggaattgtgttggctgtggaaagaaaggcttctgttacttcacggaattctccaatcatataaatctgaaactgaccactcaacccaagaagcagaaacacttgaagtattacctggtccgtaatgcacaagggactctaaccaaaggacctttaatctgttggaaaggctcagagtttagaagccggcagatccccgccagtacttgttccagttccctcttcccagccctggagagcacggctgccttccccagcgagcccgttcctgggacgaaccccagcatcctgatgggagctcagcaggcaggaccagcttctgatcacccctcactaaacgcagcaatgggtccggctgttttcaacggcaaagattccccgaagtgccaacaactggcaaagaataacctgttggccctgccgcgaccatcggctttaggtatcttgtcaaactccgggccccccaaaaaacgccacaaagggtggtctccagaatctccatcagctccagatggtggctgcccccaaggtggtgggaacagagctaagtatgagagcgcaggcatgtcctgcgtgccgcaggttggcttggtgggaccagcttcagtcacctttccagtggtggcctctggagaaccagtgtctgttcctgacaacttgctgaaaatatgcaaggccaagccagtgatatttaaaggccatgggaacttcccttacctctgtgggaacctgaatgacgtcgtggtcagccccctcttgtacacgtgctaccagaattcccagtctgtctcacgggcatacgagcagtacggcgcctctgccatccagcccatctccgaggagatgcagctcctgcttaccgtctactacctggtccagctggcacatcaaatacgaaatccggacgtataaaccagacaattcataaaagagaaaataccagaaggaaacaaatattgaaaagtattcagtctcactcatcatcaaagacatgcaaatcacaaatcaagtcatctttttctgaattaataacccaaatgatggtacccagtggtgcttaggtgcggtaaaaccagcgcttgtccgatgcaccgttcgcgtggtaaactgacgcattcaggctcttgggaagcaagctgatgatatgtagtagctggttctgtaaatccacctttgagaatttaggcgaaggaagtaacgttctatacgtcaagatgtgcattgcagagggatttataaaggtgaatatttggaagaaataagagaatccacaatagagaccttgctaagtaaacggtggtgctcacgtatgatgggacattatggacacactaacagcactctttatgttggctgaaaatggcactgaaactgatgatagggtcatggttaaggaaagaatgcaagacccaaagtttatactgacaatcattgcagctatttgtaaggacagttttaatactaattccagcaatacatgtttttattccctgtcctggagtaggagaaagcctatattcccaggctgaatgttctacacatttaccactgtatatgcacatagggacagtgtaacctgtctataccaccgtagttccagtcctaactttctgaattctgtttaaagaccttctctaacaagctatgggaatttggcctcctactttttttttcttttttttttttttttaacaacagcagtgttttgggtgataattctggattgatacttattcctttttctgggttttgttggctttttgaaaaattgtctttccaacttataattggtgagtggcttggatagc

SEQ ID NO: 410310 - DNA, 2456 bp, Homo sapiens
tttggttgttgttgtagctctgggagcagatactagctctgaaacttttcccctggctggcttggctgcctctccctgccgggcaggggccaggaagcctgggtgtcaggcagacccgagccaggctctgcacagcagggcattacgcgccccacgcatcctcttccatccccaggcacagatcaaaggcgcagcccaggaggcgggagcccctgcacactttccacctctgctgggcttagcctcttggctggttggtctgtggagtgcctgaagtgaccagctttttgtaagtagctgcagctgaggacagccaccctttcttcgtctctgctgagcgaaggctacacggcccttcctccttgcagctgtttcaccttctaccttgcgtggagccaggcttttgcaccgaatctgagatgccattttaaacagaagactccatcctcttgaagatgggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaaaccctttccagctgcaccctctgcctgaaggatgctgtaccacagacgggttttgccaggccgggaaggacctgcgccttgtctccatttccaacgagcccatggatgtccctgcgggctttctcctcgtgggggtcaagtcccccagcctgccggaccatctcctggtgtgcgccgttgacaagaggttcttgccagatgacaatggccacaatgctcttcttggtttctctgggaattgtgttggctgtggaaagaaaggcttctgttacttcacggaattctccaatcatataaatctgaaactgaccactcaacccaagaagcagaaacacttgaagtattacctggtccgtaatgcacaagggactctaaccaaaggacctttaatctgttggaaaggctcagagtttagaagccggcagatccccgccagtacttgttccagttccctcttcccagccctggagagcacggctgccttccccagcgagcccgttcctgggacgaaccccagcatcctgatgggagctcagcaggcaggaccagcttctgatcacccctcactaaacgcagcaatgggtccggctgttttcaacggcaaagattccccgaagtgccaacaactggcaaagaataacctgttggccctgccgcgaccatcggctttaggtatcttgtcaaactccgggccccccaaaaaacgccacaaagggtggtctccagaatctccatcagctccagatggtggctgcccccaaggtggtgggaacagagctaagtatgagagcgcaggcatgtcctgcgtgccgcaggttggcttggtgggaccagcttcagtcacctttccagtggtggcctctggagaaccagtgtctgttcctgacaacttgctgaaaatatgcaaggccaagccagtgatatttaaagtatttgtaaatggtgctacccaaatggtagcccttggtccggcagaacctgcatcgccccggagcttatgagaggcgtgaattcatggacccatcctggaatcagaatcaggccccacttctgcatcagaagccctgggtggcaccagcaagtgtttggcaagcccttgagaagcagtgtctttgagaacgtgacctgtgccccaggcaccagctttactccccgagcccagcaggacatctgcatataacacacagccgaagtcagaaaatatatttttggtgactaaatggagtacctggagtacaagataacacacacacacacacacacacacacacacacacacacacacacgccacctttgggagctcagcagccccgagaggatttgatagcttcaccgcttcacctggttttacaaatgcggagactgaggtttagggcagttaagcttcttgcttagcatcatgtaggtaaagaatggtggaaagatatttgaacccgacctgggcaattccacctctgagggctgtcctcagaatgaatcttctgatgggctgggcacggtggctcacgcctgtaatcccagaactttgagaggccgaggcgggtagatcactttaggtcagaagttcaagatcagcctgggcaacatggtgaaaccttgtctctactaaaaatacaaaaattggccgggtgtggtggtgatgcgcacctgtcatcccagctactcgggaggctgaggtgggagaatcacttgaacttgggaggcagaggttgtggtgagccgagatcacgccactgcactccagcccggggacagagcaagacactgtctc

SEQ ID NO: 410311 - DNA, 471 bp, Homo sapiens
tttggttgttgttgtagctctgggagcagatactagctctgaaacttttcccctggctggcttggctgcctctccctgccgggcaggggccaggaagcctgggtgtcaggcagacccgagccaggctctgcacagcagggcattacgcgccccacgcatcctcttccatccccaggcacagatcaaaggcgcagcccaggaggcgggagcccctgcacactttccacctctgctgggcttagcctcttggctggttggtctgtggagtgcctgaagtgaccagctttttgtaaggtacggtttatttgactttgcaagcgagcacctgctttgggggttggagaggtttgtgttgacttacgaagacagctgtggcctgtgttcagcagaataatggcaaagcattggcccttctaataaggtgcaggggagcagtaaaccgagacaagtccacttaatgaacgggtgtcc

SEQ ID NO: 410312 - DNA, 3484 bp, Homo sapiens
aaataaagttttttcaatggaaggcttgcagctcttgaggacctgccaaatggaagaaggacagagacctggagccctatggaaagttctgacaccatgtgtggaaggacatggcttttaacacgtgtggtgactggagtagctgcagctgaggacagccaccctttcttcgtctctgctgagcgaaggctacacggcccttcctccttgcagctgtttcaccttctaccttgcgtggagccaggcttttgcaccgaatctgagatgccattttaaacagaagactccatcctcttgaagatgggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaaaccctttccagctgcaccctctgcctgaaggatgctgtaccacagacgggttttgccaggccgggaaggacctgcgccttgtctccatttccaacgagcccatggatgtccctgcgggctttctcctcgtgggggtcaagtcccccagcctgccggaccatctcctggtgtgcgccgttgacaagaggttcttgccagatgacaatggccacaatgctcttcttggtttctctgggaattgtgttggctgtggaaagaaaggcttctgttacttcacggaattctccaatcatataaatctgaaactgaccactcaacccaagaagcagaaacacttgaagtattacctggtccgtaatgcacaagggactctaaccaaaggacctttaatctgttggaaaggctcagagtttagaagccggcagatccccgccagtacttgttccagttccctcttcccagccctggagagcacggctgccttccccagcgagcccgttcctgggacgaaccccagcatcctgatgggagctcagcaggcaggaccagcttctgatcacccctcactaaacgcagcaatgggtccggctgttttcaacggcaaagattccccgaagtgccaacaactggcaaagaataacctgttggccctgccgcgaccatcggctttaggtatcttgtcaaactccgggccccccaaaaaacgccacaaagggtggtctccagaatctccatcagctccagatggtggctgcccccaaggtggtgggaacagagctaagtatgagagcgcaggcatgtcctgcgtgccgcaggttggcttggtgggaccagcttcagtcacctttccagtggtggcctctggagaaccagtgtctgttcctgacaacttgctgaaaatatgcaaggccaagccagtgatatttaaaggccatgggaacttcccttacctctgtgggaacctgaatgacgtcgtggtcagccccctcttgtacacgtgctaccagaattcccagtctgtctcacgggcatacgagcagtacggcgcctctgccatccagcccatctccgaggagatgcagctcctgcttaccgtctactacctggtccagctggccgcggaccaggtgcccttgatggaggacctggagcagatcttcctgcgctcttggcgcgagtcgcacctgaccgagatccggcagtaccagcaggcgccgccgcagcccttcccgcccgcgcccagcgccgcggcacccgtgacctccgcgcagctgccctggctggccagcctggccgccagctcctgcaacgacagcgtgcacgtcatcgagtgtgcttactccctggccgagggcctctccgagatgttccggctgttggtcgagggcaagcttgccaagaccaactacgtggtcatcatctgcgcctgccgcagcgcggccatcgactcctgcatcgccgtcaccggaaaataccaagcccggattctttccgagagccttctcactcctgcggagtaccagaaggaagtcaattacgagctggttacggggaaggtagactcgctgggggccttctttagcaccctctgtccagagggtgacattgacattttgctggacaaatttcaccaggaaaatcaaggccatatttcttcctcactcgctgcctcttctgtcactaaagcagcatccctggatgtcagtgggacaccggtgtgcacaagttacaatctggagccacacagcatccggcccttccagctggcagtagcgcagaagctcctctcccatgtgtgttccattgcggattccagcacccaaaatctggacctgggatcctttgagaaggtggactttctcatttgcattcccccctcagaagtgacctaccagcagactctgctccacgtgtggcattcaggggttttgctggagcttggtctgaagaaagagcacatgacgaagcagagggtggaacagtatgttctgaagctagacacggaggcacagacaaaatttaaggcttttctgcaaaactccttccagaacccgcatacactttttgtcctaatccatgaccatgcgcactgggatcttgtgagtagcactgttcataacctctattctcaaagtgacccgtcggtgggattggtggaccgattgctcaactgcagggaggtgaaggaggcccccaacattgtgacacttcacgtgacctccttcccgtatgcactgcagacacagcacaccctcatcagcccctacaacgagatccactggcctgcctcctgcagtaatggagtggacttatatcatgaaaataagaagtacttcgggctgtcggagtttattgaatccaccctttcaggacacagcctccccttgctcagatacgatagctcctttgaggccatggtcactgcattaggaaaaaggttcccccgcctgcacagcgcggtgatcaggacctttgttctcgtgcagcactacgcggccgccctgatggccgtaagcggcctcccgcagatgaagaactacacgtcggtggagacgctggagatcacgcagaacctcctcaactccccgaagcagtgcccctgcggccacgggctcatggtcctgctgcgggtgccctgttcgcccctggcggtggtggcctatgagcggctggcccacgtgcgggcccggctggcgctggaggagcactttgagatcatcctgggcagtcccagctcaggcgtcaccgtggggaagcacttcgtaaagcagctcaggatgtggcagaaaatcgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttgg

SEQ ID NO: 410313 - DNA, 2836 bp, Homo sapiens
ggtcgagctgtagaggatcgcctgacagtaaaatgaacacatctcctggtgtgcgccgttgacaagaggttcttgccagatgacaatggccacaatgctcttcttggtttctctgggaattgtgttggctgtggaaagaaaggcttctgttacttcacggaattctccaatcatataaatctgaaactgaccactcaacccaagaagcagaaacacttgaagtattacctggtccgtaatgcacaagggactctaaccaaaggacctttaatctgttggaaaggctcagagtttagaagccggcagatccccgccagtacttgttccagttccctcttcccagccctggagagcacggctgccttccccagcgagcccgttcctgggacgaaccccagcatcctgatgggagctcagcaggcaggaccagcttctgatcacccctcactaaacgcagcaatgggtccggctgttttcaacggcaaagattccccgaagtgccaacaactggcaaagaataacctgttggccctgccgcgaccatcggctttaggtatcttgtcaaactccgggccccccaaaaaacgccacaaagggtggtctccagaatctccatcagctccagatggtggctgcccccaaggtggtgggaacagagctaagtatgagagcgcaggcatgtcctgcgtgccgcaggttggcttggtgggaccagcttcagtcacctttccagtggtggcctctggagaaccagtgtctgttcctgacaacttgctgaaaatatgcaaggccaagccagtgatatttaaaggccatgggaacttcccttacctctgtgggaacctgaatgacgtcgtggtcagccccctcttgtacacgtgctaccagaattcccagtctgtctcacgggcatacgagcagtacggcgcctctgccatccagcccatctccgaggagatgcagctcctgcttaccgtctactacctggtccagctggccgcggaccaggtgcccttgatggaggacctggagcagatcttcctgcgctcttggcgcgagtcgcacctgaccgagatccggcagtaccagcaggcgccgccgcagcccttcccgcccgcgcccagcgccgcggcacccgtgacctccgcgcagctgccctggctggccagcctggccgccagctcctgcaacgacagcgtgcacgtcatcgagtgtgcttactccctggccgagggcctctccgagatgttccggctgttggtcgagggcaagcttgccaagaccaactacgtggtcatcatctgcgcctgccgcagcgcggccatcgactcctgcatcgccgtcaccggaaaataccaagcccggattctttccgagagccttctcactcctgcggagtaccagaaggaagtcaattacgagctggttacggggaaggtagactcgctgggggccttctttagcaccctctgtccagagggtgacattgacattttgctggacaaatttcaccaggaaaatcaaggccatatttcttcctcactcgctgcctcttctgtcactaaagcagcatccctggatgtcagtgggacaccggtgtgcacaagttacaatctggagccacacagcatccggcccttccagctggcagtagcgcagaagctcctctcccatgtgtgttccattgcggattccagcacccaaaatctggacctgggatcctttgagaaggtggactttctcatttgcattcccccctcagaagtgacctaccagcagactctgctccacgtgtggcattcaggggttttgctggagcttggtctgaagaaagagcacatgacgaagcagagggtggaacagtatgttctgaagctagacacggaggcacagacaaaatttaaggcttttctgcaaaactccttccagaacccgcatacactttttgtcctaatccatgaccatgcgcactgggatcttgtgagtagcactgttcataacctctattctcaaagtgacccgtcggtgggattggtggaccgattgctcaactgcagggaggtgaaggaggcccccaacattgtgacacttcacgtgacctccttcccgtatgcactgcagacacagcacaccctcatcagcccctacaacgagatccactggcctgcctcctgcagtaatggagtggacttatatcatgaaaataagaagtacttcgggctgtcggagtttattgaatccaccctttcaggacacagcctccccttgctcagatacgatagctcctttgaggccatggtcactgcattaggaaaaaggttcccccgcctgcacagcgcggtgatcaggacctttgttctcgtgcagcactacgcggccgccctgatggccgtaagcggcctcccgcagatgaagaactacacgtcggtggagacgctggagatcacgcagaacctcctcaactccccgaagcagtgcccctgcggccacgggctcatggtcctgctgcgggtgccctgttcgcccctggcggtggtggcctatgagcggctggcccacgtgcgggcccggctggcgctggaggagcactttgagatcatcctgggcagtcccagctcaggcgtcaccgtggggaagcacttcgtaaagcagctcaggatgtggcagaaaatcgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttgg

SEQ ID NO: 410314 - DNA, 2897 bp, Homo sapiens
ataatgatggtagtgaagatgatgatgatgtgggtaattctggctaccttattgggtccaagctccccacaattcgttgcacaaagcactctacatacattctctttagtcctgatcaaaccacctttcagagtaggatttagtgtcctattttaaagatgaaggagctcgggctcagagagagatcgtttagacacacacacaactttggaatgaaacatttacagccgggcgcggtggcgcgtgcctgtagtcccagctacttgggaggctgaggctggaggatcgcttgagtccaggagttctgggctgtagtgcgctatgccgatcgggtgtccgcactaagtttggcatcaatatggtgacctcccgggagtggaggaccaccaggttgcctaaggaggggtgaaccggtccaggtcggaatgaaacatttacaaaaattgacatttccttatgcatagatatttcactaggtccttaaaacccacgtgaatctgtgattagaaaaaaaaaaacaaaacaaaacagatcattgttctccaaaccaagggtaaattttattggagccctgtcctggtgatagcctaatccacactctgaatattgtctaggtatcttgtcaaactccgggccccccaaaaaacgccacaaagggtggtctccagaatctccatcagctccagatggtggctgcccccaaggtggtgggaacagagctaagtatgagagcgcaggcatgtcctgcgtgccgcaggttggcttggtgggaccagcttcagtcacctttccagtggtggcctctggagaaccagtgtctgttcctgacaacttgctgaaaatatgcaaggccaagccagtgatatttaaaggccatgggaacttcccttacctctgtgggaacctgaatgacgtcgtggtcagccccctcttgtacacgtgctaccagaattcccagtctgtctcacgggcatacgagcagtacggcgcctctgccatccagcccatctccgaggagatgcagctcctgcttaccgtctactacctggtccagctggccgcggaccaggtgcccttgatggaggacctggagcagatcttcctgcgctcttggcgcgagtcgcacctgaccgagatccggcagtaccagcaggcgccgccgcagcccttcccgcccgcgcccagcgccgcggcacccgtgacctccgcgcagctgccctggctggccagcctggccgccagctcctgcaacgacagcgtgcacgtcatcgagtgtgcttactccctggccgagggcctctccgagatgttccggctgttggtcgagggcaagcttgccaagaccaactacgtggtcatcatctgcgcctgccgcagcgcggccatcgactcctgcatcgccgtcaccggaaaataccaagcccggattctttccgagagccttctcactcctgcggagtaccagaaggaagtcaattacgagctggttacggggaaggtagactcgctgggggccttctttagcaccctctgtccagagggtgacattgacattttgctggacaaatttcaccaggaaaatcaaggccatatttcttcctcactcgctgcctcttctgtcactaaagcagcatccctggatgtcagtgggacaccggtgtgcacaagttacaatctggagccacacagcatccggcccttccagctggcagtagcgcagaagctcctctcccatgtgtgttccattgcggattccagcacccaaaatctggacctgggatcctttgagaaggtggactttctcatttgcattcccccctcagaagtgacctaccagcagactctgctccacgtgtggcattcaggggttttgctggagcttggtctgaagaaagagcacatgacgaagcagagggtggaacagtatgttctgaagctagacacggaggcacagacaaaatttaaggcttttctgcaaaactccttccagaacccgcatacactttttgtcctaatccatgaccatgcgcactgggatcttgtgagtagcactgttcataacctctattctcaaagtgacccgtcggtgggattggtggaccgattgctcaactgcagggaggtgaaggaggcccccaacattgtgacacttcacgtgacctccttcccgtatgcactgcagacacagcacaccctcatcagcccctacaacgagatccactggcctgcctcctgcagtaatggagtggacttatatcatgaaaataagaagtacttcgggctgtcggagtttattgaatccaccctttcaggacacagcctccccttgctcagatacgatagctcctttgaggccatggtcactgcattaggaaaaaggttcccccgcctgcacagcgcggtgatcaggacctttgttctcgtgcagcactacgcggccgccctgatggccgtaagcggcctcccgcagatgaagaactacacgtcggtggagacgctggagatcacgcagaacctcctcaactccccgaagcagtgcccctgcggccacgggctcatggtcctgctgcgggtgccctgttcgcccctggcggtggtggcctatgagcggctggcccacgtgcgggcccggctggcgctggaggagcactttgagatcatcctgggcagtcccagctcaggcgtcaccgtggggaagcacttcgtaaagcagctcaggatgtggcagaaaatcgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttgg

SEQ ID NO: 410315 - DNA, 2515 bp, Homo sapiens
ctggtctctgtggtgatatattgtcccaactcaccttgccagacagccctgggagaatgcagggcagaatcctccctgcttggagtcagggaggcaagacctggcaggcagcacccagtgaagctctggaaggtgctctgcccacaaggtgtcccattggtggtgctggaggagtgacaggtggcggctgcttggctctgggcaagtccctccctccagccccctcacttgtaaaaaataagaggattggacgaaatgaaccagcaagtggcacagccccattggttagaaaaggtgactcctctcatcctaggctccaggagggtgagcaggtgcactcaatgagcaaggcttcccaggacagggcactcgagggacctggcgcagctcacctatctccttcagtgccctcacccccagagaacccacatgtatgggaccgtaagctgtgcacaagactgggtgccaagtcgctgctgttcctctgcaggccatgggaacttcccttacctctgtgggaacctgaatgacgtcgtggtcagccccctcttgtacacgtgctaccagaattcccagtctgtctcacgggcatacgagcagtacggcgcctctgccatccagcccatctccgaggagatgcagctcctgcttaccgtctactacctggtccagctggccgcggaccaggtgcccttgatggaggacctggagcagatcttcctgcgctcttggcgcgagtcgcacctgaccgagatccggcagtaccagcaggcgccgccgcagcccttcccgcccgcgcccagcgccgcggcacccgtgacctccgcgcagctgccctggctggccagcctggccgccagctcctgcaacgacagcgtgcacgtcatcgagtgtgcttactccctggccgagggcctctccgagatgttccggctgttggtcgagggcaagcttgccaagaccaactacgtggtcatcatctgcgcctgccgcagcgcggccatcgactcctgcatcgccgtcaccggaaaataccaagcccggattctttccgagagccttctcactcctgcggagtaccagaaggaagtcaattacgagctggttacggggaaggtagactcgctgggggccttctttagcaccctctgtccagagggtgacattgacattttgctggacaaatttcaccaggaaaatcaaggccatatttcttcctcactcgctgcctcttctgtcactaaagcagcatccctggatgtcagtgggacaccggtgtgcacaagttacaatctggagccacacagcatccggcccttccagctggcagtagcgcagaagctcctctcccatgtgtgttccattgcggattccagcacccaaaatctggacctgggatcctttgagaaggtggactttctcatttgcattcccccctcagaagtgacctaccagcagactctgctccacgtgtggcattcaggggttttgctggagcttggtctgaagaaagagcacatgacgaagcagagggtggaacagtatgttctgaagctagacacggaggcacagacaaaatttaaggcttttctgcaaaactccttccagaacccgcatacactttttgtcctaatccatgaccatgcgcactgggatcttgtgagtagcactgttcataacctctattctcaaagtgacccgtcggtgggattggtggaccgattgctcaactgcagggaggtgaaggaggcccccaacattgtgacacttcacgtgacctccttcccgtatgcactgcagacacagcacaccctcatcagcccctacaacgagatccactggcctgcctcctgcagtaatggagtggacttatatcatgaaaataagaagtacttcgggctgtcggagtttattgaatccaccctttcaggacacagcctccccttgctcagatacgatagctcctttgaggccatggtcactgcattaggaaaaaggttcccccgcctgcacagcgcggtgatcaggacctttgttctcgtgcagcactacgcggccgccctgatggccgtaagcggcctcccgcagatgaagaactacacgtcggtggagacgctggagatcacgcagaacctcctcaactccccgaagcagtgcccctgcggccacgggctcatggtcctgctgcgggtgccctgttcgcccctggcggtggtggcctatgagcggctggcccacgtgcgggcccggctggcgctggaggagcactttgagatcatcctgggcagtcccagctcaggcgtcaccgtggggaagcacttcgtaaagcagctcaggatgtggcagaaaatcgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttgg

SEQ ID NO: 410316 - DNA, 2749 bp, Homo sapiens
gagtctcgctctgtcgcccaggctggagtgcagtggcgcgatctcggctcactgcaagctccgcctcccgggttcacgccattctcctgcctcagcctcctgtagtcccagctacttgggaggctgaggctggaggatcgcttgagtccaggagttctgggctgtagtgcgctatgccgatcgggtgtccgcactaagtttggcatcaatatggtgacctcccgggagtggaggaccaccaggttgcctaaggaggggtgaaccggtccaggtcggaatgaaacatttacaaaaattgacatttccttatgcatagatatttcactaggtccttaaaacccacgtgaatctgtgattagaaaaaaaaaaacaaaacaaaacagatcattgttctccaaaccaagggtaaattttattggagccctgtcctggtgatagcctaatccacactctgaatattgtctaggtatcttgtcaaactccgggccccccaaaaaacgccacaaagggtggtctccagaatctccatcagctccagatggtggctgcccccaaggtggtgggaacagagctaagtatgagagcgcaggcatgtcctgcgtgccgcaggttggcttggtgggaccagcttcagtcacctttccagtggtggcctctggagaaccagtgtctgttcctgacaacttgctgaaaatatgcaaggccaagccagtgatatttaaaggccatgggaacttcccttacctctgtgggaacctgaatgacgtcgtggtcagccccctcttgtacacgtgctaccagaattcccagtctgtctcacgggcatacgagcagtacggcgcctctgccatccagcccatctccgaggagatgcagctcctgcttaccgtctactacctggtccagctggccgcggaccaggtgcccttgatggaggacctggagcagatcttcctgcgctcttggcgcgagtcgcacctgaccgagatccggcagtaccagcaggcgccgccgcagcccttcccgcccgcgcccagcgccgcggcacccgtgacctccgcgcagctgccctggctggccagcctggccgccagctcctgcaacgacagcgtgcacgtcatcgagtgtgcttactccctggccgagggcctctccgagatgttccggctgttggtcgagggcaagcttgccaagaccaactacgtggtcatcatctgcgcctgccgcagcgcggccatcgactcctgcatcgccgtcaccggaaaataccaagcccggattctttccgagagccttctcactcctgcggagtaccagaaggaagtcaattacgagctggttacggggaaggtagactcgctgggggccttctttagcaccctctgtccagagggtgacattgacattttgctggacaaatttcaccaggaaaatcaaggccatatttcttcctcactcgctgcctcttctgtcactaaagcagcatccctggatgtcagtgggacaccggtgtgcacaagttacaatctggagccacacagcatccggcccttccagctggcagtagcgcagaagctcctctcccatgtgtgttccattgcggattccagcacccaaaatctggacctgggatcctttgagaaggtggactttctcatttgcattcccccctcagaagtgacctaccagcagactctgctccacgtgtggcattcaggggttttgctggagcttggtctgaagaaagagcacatgacgaagcagagggtggaacagtatgttctgaagctagacacggaggcacagacaaaatttaaggcttttctgcaaaactccttccagaacccgcatacactttttgtcctaatccatgaccatgcgcactgggatcttgtgagtagcactgttcataacctctattctcaaagtgacccgtcggtgggattggtggaccgattgctcaactgcagggaggtgaaggaggcccccaacattgtgacacttcacgtgacctccttcccgtatgcactgcagacacagcacaccctcatcagcccctacaacgagatccactggcctgcctcctgcagtaatggagtggacttatatcatgaaaataagaagtacttcgggctgtcggagtttattgaatccaccctttcaggacacagcctccccttgctcagatacgatagctcctttgaggccatggtcactgcattaggaaaaaggttcccccgcctgcacagcgcggtgatcaggacctttgttctcgtgcagcactacgcggccgccctgatggccgtaagcggcctcccgcagatgaagaactacacgtcggtggagacgctggagatcacgcagaacctcctcaactccccgaagcagtgcccctgcggccacgggctcatggtcctgctgcgggtgccctgttcgcccctggcggtggtggcctatgagcggctggcccacgtgcgggcccggctggcgctggaggagcactttgagatcatcctgggcagtcccagctcaggcgtcaccgtggggaagcacttcgtaaagcagctcaggatgtggcagaaaatcgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttgg

SEQ ID NO: 410317 - DNA, 1305 bp, Homo sapiens
tttggttgttgttgtagctctgggagcagatactagctctgaaacttttcccctggctggcttggctgcctctccctgccgggcaggggccaggaagcctgggtgtcaggcagacccgagccaggctctgcacagcagggcattacgcgccccacgcatcctcttccatccccaggcacagatcaaaggcgcagcccaggaggcgggagcccctgcacactttccacctctgctgggcttagcctcttggctggttggtctgtggagtgcctgaagtgaccagctttttgtaagtagctgcagctgaggacagccaccctttcttcgtctctgctgagcgaaggctacacggcccttcctccttgcagctgtttcaccttctaccttgcgtggagccaggcttttgcaccgaatctgagatgccattttaaacagaagactccatcctcttgaagatgggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaaaccctttccagctgcaccctctgcctgaaggatgctgtaccacagacggtgagcctctgccagctcctggccaggcagtgcctgccatgctgcccggaggcagtggccaggcgggtgactgggcctgtgactgtgtgctgcaggggtcctctttgctcttcctctttgctttccctgaggtgtgagccatgcccctgggcccgcagcaggtgctggcccggcctgccctcctgaaacaggagctccagagacaccatcctgggatgctaaggcaggcctctgtgccactctttggacagtctcaactttaccagtggcttgggagccagacattcatttttctgtgttggttgcttggaacctagaatacattttccctactcaggcctgtttgcacagcatattgaactcacaagtgattaggaggaataatctttctttctttcttttttttttttgacggaatctcactctgttgcccaggctggagtgcagtggtgcaatctcagatcactgcaacctccgcctcccaggttcaagcaattctcctgcctcagcctcccaagtagctgggattataggcacatgccaccatgcctggctaatttttgtatttttagt

SEQ ID NO: 410318 - DNA, 942 bp, Homo sapiens
catttccatattgattgctggtggttctcctgtttctagtaggaaccagaggcaacttagtcccctcctcagagagctgcacattgtgctgatagagacaaaataggcatttataccatttattcatctgctcattcattggacaaatatttattgagcagctactaagtgccaaatgctggaaaaacgtaataacaacaaacctatgtttttgttttccagctggaaaaaacaaaggactgtataatttgatttctaaagaaggcttctcattcaggttcccacaaccaccttccagaggcaacacaactgcgtataatgccggagttgcctgtggtagagtgacggatgtcttgggtgacttggcagcagcaggccggtgggcgcggccgtcacagacatggtctctctgtgttccttgcaggttcccccgcctgcacagcgcggtgatcaggacctttgttctcgtgcagcactacgcggccgccctgatggccgtaagcggcctcccgcagatgaagaactacacgtcggtggagacgctggagatcacgcagaacctcctcaactccccgaagcagtgcccctgcggccacgggctcatggtcctgctgcgggtgccctgttcgcccctggcggtggtggcctatgagcggctggcccacgtgcgggcccggctggcgctggaggagcactttgagatcatcctgggcagtcccagctcaggcgtcaccgtggggaagcacttcgtaaagcagctcaggatgtggcagaaaatcgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttgg

SEQ ID NO: 410319 - DNA, 328 bp, Homo sapiens
gagaaagaatcaaagcgcacatcttgtactttgatgcccataggaagggctctcctctggcccctctggctttgtttggagcagaaaacaacaaagtgagttcaggtaatacctggggcagtgggaattagctaattagttttctggaattctaacagcggtggcatcccaggggcctaaattaaagccgcagatgtgtttatttggtacacctggggctttaaatgctaatccaaatgctttcagacaggacctcagtctatttcttgacaatcctctctgtaaccttaagcatgtggtcttccttttcctcgtctactgtctcttt

SEQ ID NO: 410320 - DNA, 406 bp, Homo sapiens
atcctcttgaagatgggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtgggagacgcacgttgcttttatctgtgtatttcttttattgtgcgcagttaatgttagcaccagaacttgaaactcttttctttatgtagataacgttgaatctagcagaaaagaattattagaaaaagaaaactgggtacaagttcttactttggctaaaatgtaaataagtttcagccataaaattgcaagaagtaaaattattcattgaatcagtaggagaaaggaagagga

SEQ ID NO: 410321 - DNA, 462 bp, Homo sapiens
caaagaccaggatgtggtggcagcttgtgtggctgtctccatagctcactgtcctgtaggacacgttccactccaggaactcatttcgtagttgttggagaagagcgagttggttttcacgtgtgcaccttgcccccttagagtttagaagccggcagatccccgccagtacttgttccagttccctcttcccagccctggagagcacggctgccttccccagcgagcccgttcctgggacgaaccccagcatcctgatgggagctcagcaggcaggtgaggtggtggagacacaccagagctgctaaacccacagagctggcactgtctccgatgtgtccggttgactatgccgtcaagcattcttcaaaataaatcagggggctgttatctttttctataacacctttactttcatcttgaatttgtaatacttttcaacaaagaatgctaggtttttca

SEQ ID NO: 410322 - DNA, 711 bp, Homo sapiens
agagcacttgccattgcttttatcaagtgcttgctagccatggatgccaactaacttcttcaattgaaggccggaggatcatatcgggttccaggagcctcttgagcaggtcctggcaatcggccgagatgctcagatgagtggggaaggacacccccttctgctgctgccacagcatcttggggatgtctgtgtcgtcaaaagagacctgcccggctccgcctggaccggagcgttctcccgcggccagggctccggcagctgcttctagcctgggaccggtctcaaccgccgggagagcgccccggggcttggacatgagcgcccaggagcccccgcagggtcggagattccccattgaggccggagactcccgtggccttgccgccgcccccgagtcccaggacagcccggaggcggtagcgacggagcacaacccggtcaggccgcttcgtcgctgccctggatgccactgcctgacgctgctgcacgtgcccatcgacgtctacctcgccatgggcgggagcccccgggcccgcgccacgtgagtgcgcctgctccctgcggctccgcgggagctgggcgggaacgaggcccccagcgggccaccacgctgaggtcgcatgcgccgagcacgagacaatgatgcacattttaaaataaaagaatgatgcacattttaataaagcacagcacaaactgttctttcca

SEQ ID NO: 410323 - DNA, 960 bp, Homo sapiens
ggtgcaattgtgatgtagatgctgtgtgacccttggccaaaatgggcagtgcccctacctgccctcactaccaccaccaaactcagcccggattaagtcaccgccgagcccgcccccgtgccaggcattgagttgtagtcccgcctgggagggcgctccgccgcgtctgtgtggaccgggaatgcgcggctcctcggcgtggacgccgcctcgcggcgggttgccctggcctgctgcgcccccctcgggtgtccggggtctgcgcgaccccgtctccaggcgccatggccagaggcctccagtccccgattctggcccgcgctgagtgccaggggcggcagggggcaccgttgggggttctccagtgggaggaacgtgctctgtgaggtcagcgcgccgcggcccgggtcacaatgctgccctcctcgacgcccgggcccgggcacgccacagagacctgcccggctccgcctggaccggagcgttctcccgcggccagggctccggcagctgcttctagcctgggaccggtctcaaccgccgggagagcgccccggggcttggacatgagcgcccaggagcccccgcagggtcggagattccccattgaggccggagactcccgtggccttgccgccgcccccgagtcccaggacagcccggaggcggtagcgacggagcacaacccggtcaggccgcttcgtcgctgccctggatgccactgcctgacgctgctgcacgtgcccatcgacgtctacctcgccatgggcgggagcccccgggcccgcgccacgtgagtgcgcctgctccctgcggctccgcgggagctgggcgggaacgaggcccccagcgggccaccacgctgaggtcgcatgcgccgagcacgagacaatgatgcacattttaaaataaaagaatgatgcacattttaataaagcacagcacaaactgttctttcca

SEQ ID NO: 410324 - DNA, 1111 bp, Homo sapiens
ggtgcaattgtgatgtagatgctgtgtgacccttggccaaaatgggcagtgcccctacctgccctcactaccaccaccaaactcagcccggattaagtcaccgccgagcccgcccccgtgccaggcattgagttgtagtcccgcctgggagggcgctccgccgcgtctgtgtggaccgggaatgcgcggctcctcggcgtggacgccgcctcgcggcgggttgccctggcctgctgcgcccccctcgggtgtccggggtctgcgcgaccccgtctccaggcgccatggccagaggcctccagtccccgattctggcccgcgctgagtgccaggggcggcagggggcaccgttgggggttctccagtgggaggaacgtgctctgtgaggtcagcgcgccgcggcccgggtcacaatgctgccctcctcgacgcccgggcccgggcacgccacagagacctgcccggctccgcctggaccggagcgttctcccgcggccagggctccggcagctgcttctagcctgggaccggtctcaaccgccgggaggtgagcgacggcccagggggcgggcgcgaggcggcggcgcccggcgacccgggagaggcctgaccgccactccccgcgcagagcgccccggggcttggacatgagcgcccaggagcccccgcagggtcggagattccccattgaggccggagactcccgtggccttgccgccgcccccgagtcccaggacagcccggaggcggtagcgacggagcacaacccggtcaggccgcttcgtcgctgccctggatgccactgcctgacgctgctgcacgtgcccatcgacgtctacctcgccatgggcgggagcccccgggcccgcgccacgtgagtgcgcctgctccctgcggctccgcgggagctgggcgggaacgaggcccccagcgggccaccacgctgaggtcgcatgcgccgagcacgagacaatgatgcacattttaaaataaaagaatgatgcacattttaataaagcacagcacaaactgttctttccaaaaaaaaccgcaagcacagaaaacgagagcacaacaacaacacacagacacaccaaccacacaaaaagag

SEQ ID NO: 410325 - DNA, 1041 bp, Homo sapiens
ggtgcaattgtgatgtagatgctgtgtgacccttggccaaaatgggcagtgcccctacctgccctcactaccaccaccaaactcagcccggattaagtcaccgccgagcccgcccccgtgccaggcattgagttgtagtcccgcctgggagggcgctccgccgcgtctgtgtggaccgggaatgcgcggctcctcggcgtggacgccgcctcgcggcgggttgccctggcctgctgcgcccccctcgggtgtccggggtctgcgcgaccccgtctccaggcgccatggccagaggcctccagtccccgattctggcccgcgctgagtgccaggggcggcagggggcaccgttgggggttctccagtgggaggaacgtgctctgtgaggtcagcgcgccgcggcccgggtcacaatgctgccctcctcgacgcccgggcccgggcacgccacagagacctgcccggctccgcctggaccggagcgttctcccgcggccagggctccggcagctgcttctagcctgggaccggtctcaaccgccgggaggtgagcgacggcccagggggcgggcgcgaggcggcggcgcccggcgacccgggagaggcctgaccgccactccccgcgcagagcgccccggggcttggacatgagcgcccaggagcccccgcagggtcggagattccccattgaggccggagactcccgtggccttgccgccgcccccgagtcccaggacagcccggaggcggtagcgacggagcacaacccggtcaggccgcttcgtcgctgccctggatgccactgcctgacgctgctgcacgtgcccatcgacgtctacctcgccatgggcgggagcccccgggcccgcgccacgtgagtgcgcctgctccctgcggctccgcgggagctgggcgggaacgaggcccccagcgggccaccacgctgaggtcgcatgcgccgagcacgagacaatgatgcacattttaaaataaaagaatgatgcacattttaataaagcacagcacaaactgttctttcca

SEQ ID NO: 410326 - DNA, 1235 bp, Homo sapiens
ggtgcaattgtgatgtagatgctgtgtgacccttggccaaaatgggcagtgcccctacctgccctcactaccaccaccaaactcagcccggattaagtcaccgccgagcccgcccccgtgccaggcattgagttgtagtcccgcctgggagggcgctccgccgcgtctgtgtggaccgggaatgcgcggctcctcggcgtggacgccgcctcgcggcgggttgccctggcctgctgcgcccccctcgggtgtccggggtctgcgcgaccccgtctccaggcgccatggccagaggcctccagtccccgattctggcccgcgctgagtgccaggggcggcagggggcaccgttgggggttctccagtgggaggaacgtgctctgtgaggtcagcgcgccgcggcccgggtcacaatgctgccctcctcgacgcccgggcccgggcacgccacagagacctgcccggctccgcctggaccggagcgttctcccgcggccagggctccggcagctgcttctagcctgggaccggtctcaaccgccgggaggtgagcgacggcccagggggcgggcgcgaggcggcggcgcccggcgacccgggagaggcctgaccgccactccccgcgcagagcgccccggggcttggacatgagcgcccaggagcccccgcagggtcggagattccccattgaggccggagactcccgtggccttgccgccgcccccgagtcccaggacagcccggaggcggtagcgacggagcacaacccggtcaggtaaggcccgcgccccacccccgcctccgcccgtcccgcggccccgccctccgtcccacttggcgcccccagcagtcaggaccccgcatccacgtccggacccccggggaccccaggtgcactccctgggtgcgccccacaggatgggccaagcccctgcctcagcggcccctgtcgcgcgtcaatttccccaggccgcttcgtcgctgccctggatgccactgcctgacgctgctgcacgtgcccatcgacgtctacctcgccatgggcgggagcccccgggcccgcgccacgtgagtgcgcctgctccctgcggctccgcgggagctgggcgggaacgaggcccccagcgggccaccacgctgaggtcgcatgcgccgagcacgagacaatgatgcacattttaaaataaaagaatgatgcacattttaataaagcacagcacaaactgttctttcca

SEQ ID NO: 410327 - DNA, 1391 bp, Homo sapiens
ggtgcaattgtgatgtagatgctgtgtgacccttggccaaaatgggcagtgcccctacctgccctcactaccaccaccaaactcagcccggattaagtcaccgccgagcccgcccccgtgccaggcattgagttgtagtcccgcctgggagggcgctccgccgcgtctgtgtggaccgggaatgcgcggctcctcggcgtggacgccgcctcgcggcgggttgccctggcctgctgcgcccccctcgggtgtccggggtctgcgcgaccccgtctccaggcgccatggccagaggcctccagtccccgattctggcccgcgctgagtgccaggggcggcagggggcaccgttgggggttctccagtgggaggaacgtgctctgtgaggtcagcgcgccgcggcccgggtcacaatgctgccctcctcgacgcccgggcccgggcacgccacagagacctgcccggctccgcctggaccggagcgttctcccgcggccagggctccggcagctgcttctagcctgggaccggtctcaaccgccgggaggtgagcgacggcccagggggcgggcgcgaggcggcggcgcccggcgacccgggagaggcctgaccgccactccccgcgcagagcgccccggggcttggacatgagcgcccaggagcccccgcagggtcggagattccccattgaggccggagactcccgtggccttgccgccgcccccgagtcccaggacagcccggaggcggtagcgacggagcacaacccggtcaggccgcttcgtcgctgccctggatgccactgcctgacgctgctgcacgtgcccatcgacgtctacctcgccatgggcgggagcccccgggcccgcgccacgtgagtgcgcctgctccctgcggctccgcgggagctgggcgggaacgaggcccccagcgggccaccacgctgaggtcgcatgcgccgagcacgagacaatgatgcacattttaaaataaaagaatgatgcacattttaataaagcacagcacaaactgttctttccactccgggctggcagtgtatgtctatccgtcgggcccaccagctgctctgcccagtccaataacactttcccttccgcagcctcctcgtttggacccagccttaggggcccgcccttccgcctttcaacctacgccacttcactcctctcgtatcttgctggtcctgacccctcctgggcagcctttcccttgggccctgccctggtccatctctctaaccctctggtgattctccggtgaaattcacatcactgtgctggaccctggcaacccacagaagcggggaacaggaggaagaggtggaccgacaagtaacatagaatacagccataggccacccacaccaggct

SEQ ID NO: 410328 - DNA, 740 bp, Homo sapiens
agagcacttgccattgcttttatcaagtgcttgctagccatggatgccaactaacttcttcaattgaaggccggaggatcatatcgggttccaggagcctcttgagcaggtcctggcaatcggccgagatgctcagatgagtggggaaggacacccccttctgctgctgccacagcatcttggggatgtctgtgtcgtcaaaagagacctgcccggctccgcctggaccggagcgttctcccgcggccagggctccggcagctgcttctagcctgggaccggtctcaaccgccgggagagcgccccggggcttggacatgagcgcccaggagcccccgcagggtcggagattccccattgaggccggagactcccgtggccttgccgccgcccccgagtcccaggacagcccggaggcggtagcgacggagcacaacccggtcagcggcccctgtcgcgcgtcaatttccccaggccgcttcgtcgctgccctggatgccactgcctgacgctgctgcacgtgcccatcgacgtctacctcgccatgggcgggagcccccgggcccgcgccacgtgagtgcgcctgctccctgcggctccgcgggagctgggcgggaacgaggcccccagcgggccaccacgctgaggtcgcatgcgccgagcacgagacaatgatgcacattttaaaataaaagaatgatgcacattttaataaagcacagcacaaactgttctttcca

SEQ ID NO: 410329 - DNA, 1396 bp, Homo sapiens
caagatagccaggattcctactctcagagtcttgcattttaagggagagacagacaataaagatatcgtatcagaggaaaataatcatgaaagtcagggaggagcttttcccagagtaactgacagtatcaaatagcaagagagttaggatgaggactgaacagaagacatcagatttgaaaattagaaaatcagtgctgctataggaagaatagtccccaaagatacccaggtcctaattcctggaacctgtcacttatatgcataaaggactttgcagatttaagttaaggatcttgagatgggaaaattatattgcattatctaagcaggtcctaatgtaatcacaggtgtctctataagagggagtcagaaggagatttgactagggaaaagagagtaggaaattcgacaatggaagcaaaaggttggagtgatacaagaaagcagccatgagccaaggaatgtgaatggcctccagaagctaagaaaagaaaaagaaaacagattatcccctatagcctcccgaaggagcaagccctgctgacacgtttactttagttctgtgaaactgatttctgacttctggcctatagaactatgagagaataaatttgtgttgttttaagccaagtttgtgataatttggtacagcagcaatagaaaatgaatacaaatgtttccttgaccttattgagaacaacttttgtggagagggaagaggtaaactaaaagaaaattgtggtgggatgataactgaaagatacagaaaagacagcaaagtatccattttttaggaagtttttatatatctcatttgacccactaagaaacgacatccagaaaggagctaaagaccagaggtaattgattagctcagcacccaaaaatggcaggcagtgttggggcagtactagaatgaggtagccggccgggcacggtggctcatgcctgtaatgccagctctcagggaggcaagaggtgggagtatagcttgagcccaggagttcgagacctgcctgggcaatatagcaagaccccgttctccagaaaaaggaaaaaaaaaaaaaaaaaagcatagaatgaggtagccataacattctacctggcttttggctgaattgtggggaggagagttcagaggcctcaaaagtgaccctgacactggagagtaaaccatagtaacccattatagtccacagatatgcgcaccagacccatgactcttgttcaccatagagacaggatactttgatgctgtgacccaaaatcctgcacctggaacagatttggtacctctctattgacacagaaattcatgttgagcatggagacataatcaagagagaatggcctcattcgatcggtcttcagcttaggcactgacattttgcat

SEQ ID NO: 410330 - DNA, 1723 bp, Homo sapiens
aaggcgggcagatcacttgaggtcaggagtttgagaccagcctgaccaacatggtgaaaccccatctctactaaaaatacaaaaattagccaggtgtaatgatgcacgcctgtaatcccagctacttgggaggctgaggcacaagaatcacttgaactcaggaggtagagactgcagtgagccgagatggcgccactgcacttcagcctgggcgacagagcaagactctgtctcacaaataaaataaaataaaataaaataaaatggagataacagtaattaactcatgacattgttgtgaagatcatgcttataatctgtttaaaacaatgcccagccataataagctcgctaaatgttggtggttatttttatcctgtcaatggcatctctgtccaatcaagaacaagtcaaactcacacctgtaattcctgtaatctttggaggtcagaggtagggggcattgcttaagtccaggagtttgagactagcctgggcaacatggcaaaaccccatctctaccaaaaatacaaaaaaaaattagctgggtgttgtggggcacgcctgtggtcccagctactcgagaggctgagatgggagaattgcttgagcccagaagacagaggtggcagtgagctgatatcatgccactgcactgcagcctgggtgacagagtgagaccccatctcaaagaaaaagaacaagtctaagatcttggagtataccaaaacttccgctccagggtctctttttatctttacttacagaataactgaatcttgacatccaagaatctagtataattatttgtacatagtaggtcctcgatgtacgggctgaatgaaagtgttaattccctatgcttttacacgaatgatacgtccacatcacctttcatctggtctattacaacagcctaactgctctccttcacttcagtctccatccagtccctcttcatcctgctcttggtgatgacactaccctcttcaaaacccttggaggtctctctgctgcattcatgataaagtccaaactccatatcctggtattcaaggtataatataccttattttaaagtttcctcattgtaccctttcctgctgcctctatacacccgctgccccaactccttacacaaagcgatgctagtccactacctccaggaagcctttcctggctgttagcccacacagaccttcctctaaaatagcaatgcttagcaggcctcttccttggctattctcctaaaaggcctcacttgattcagctttttctggtctaggcccacaggagctcttcctcccctgtctcctctcaacttggctgggggctcagccagtaatgggatggtggtatgtacagcagtggtaggggagggagaaggggaaagggagattcagtaaactgtcaattgttttagggggaagaggccacacgggaagaagttcctccagagccttaccccttttccctccaacctgctcccctctagttagccatctcttcttgcagccacaggaattctcatccccagttacccacaaactcctctcttcctttctccattcttcttaagccgggattttccttgcttctttctagcctgcacctttaatgctgctgcttcccaacctgggcctccgcacccagtcatcttcctttttagccagtcttagcatcccagaagctccaggcggaaaagccagaccctctctgcctt

SEQ ID NO: 410331 - DNA, 421 bp, Homo sapiens
accttattgaattgctgattcgcattcctagagattctgattctgtaggggtaggctggagcctaggaacctaccttttaaactagttccataggtgattctgatgtacatatagagtgtgacagccatcactatagagaatagattgataaattacaacccacgcgtcaaatctggcttgctgtcttattttgtaaataaagttttattggaatagagcaacattcacttgtttacatattgtccatggccgcttttgtgctacaatggcagagttgaatgattatagaagaccatatggctggttaagtccaaaatatttactagctggccctttacagaaaaagttggctgaccccttctctaaatcaacatttctccttggtaactgaaactctattacagtcctgacaattccagc

SEQ ID NO: 410332 - DNA, 303 bp, Homo sapiens
taggcatatatacccaaaggattataaatcattctacaataaagacacatgcacacgtatgtttattggcggcactattcacaatagcaaagactgggaaccaacccaaatgtccatcaatgatagactagattacaggcgtgagccaccgcgcccggcctcagtgccttttttaacttgagggtgtagaggtcctccacgcttgtttgcctgaaagtaatataatgatgctgtctgaacaggttttactgcttgctttccaagtaaaggttaattatgataataaagagatttggaaatgaa

SEQ ID NO: 410333 - DNA, 1324 bp, Homo sapiens
agctgcgccggcgccgccgggagcgctaggcctggtccctcttcctaggatagcgttgcgcgcatgcgccttgacgagtgagccggggagccatggacaactgtttggcggccgcagcgctgaatggggtggaccgacgttccctgcagcgttcagcaaggctggctctagaagtgctggagagggccaagaggagggcggtggactggcatgccctggagcgtcccaaaggctgcatgggggtccttgcccgggaggcgccccacctagagaaacagccggcagccggcccgcagcgcgttctcccgggagagagagaagagagacccccaacccttagtgcttccttcagaacaatggctgaattcatggactatacttcaagtcagtgtgggaaatattattcatctgtgccagaggaaggaggggcaacccatgtctatcgttatcacagaggcgagtcgaagctgcacatgtgcttggacatagggaatggtcagagaaaagacagaaaaaagacatcccttggtcctggaggcagctatcaaatatcagagcatgctccagaggcatcccagcctgctgagaacatctctaaggacctctacatagaagtatatccagggacctattctgtcactgtgggctcaaatgacttaaccaagaagactcatgtggtagcagttgattctggacaaagcgtggacctggtcttccctgtgtgatgttgaccatcactgccatcacatcacctttttttaagtagtaagaataaagccactgtatgattctcttaatagctatacattaatcctgtttttagtgctgactgggtcagccttccgggaactggagtctgtctctttcagtgcttttttgtttgtttggttggtttttttttgagacagtctcgctctgttgcccaggctggagtgcagtggcgtgatctcggctcactgcaagttccgcctcccgggttcacaccattctcctgcctcagcctcccgagtagctggcactacaggcacccgccaccatgcccggctattttttttgtatttttagtagagacggggtttcaccatgttggccaggatggtctcgatctcttgacctcgtgatccacccaccttggcctcccaaagtgttgggattacaggcgtgagccaccgcgcccggcctcagtgccttttttaacttgagggtgtagaggtcctccacgcttgtttgcctgaaagtaatataatgatgctgtctgaacaggttttactgcttgctttccaagtaaaggttaattatgataataaagagatttggaaatgaa

SEQ ID NO: 410334 - DNA, 1243 bp, Homo sapiens
agctgcgccggcgccgccgggagcgctaggcctggtccctcttcctaggatagcgttgcgcgcatgcgccttgacgagtgagccggggagccatggacaactgtttggcggccgcagcgctgaatggggtggaccgacgttccctgcagcgttcagcaaggctggctctagaagtgctggagagggccaagaggagggcggtggactggcatgccctggagcgtcccaaaggctgcatgggggtccttgcccgggaggcgccccacctagagaaacagccggcagccggcccgcagcgcgttctcccgggagagaaatattattcatctgtgccagaggaaggaggggcaacccatgtctatcgttatcacagaggcgagtcgaagctgcacatgtgcttggacatagggaatggtcagagaaaagacagaaaaaagacatcccttggtcctggaggcagctatcaaatatcagagcatgctccagaggcatcccagcctgctgagaacatctctaaggacctctacatagaagtatatccagggacctattctgtcactgtgggctcaaatgacttaaccaagaagactcatgtggtagcagttgattctggacaaagcgtggacctggtcttccctgtgtgatgttgaccatcactgccatcacatcacctttttttaagtagtaagaataaagccactgtatgattctcttaatagctatacattaatcctgtttttagtgctgactgggtcagccttccgggaactggagtctgtctctttcagtgcttttttgtttgtttggttggtttttttttgagacagtctcgctctgttgcccaggctggagtgcagtggcgtgatctcggctcactgcaagttccgcctcccgggttcacaccattctcctgcctcagcctcccgagtagctggcactacaggcacccgccaccatgcccggctattttttttgtatttttagtagagacggggtttcaccatgttggccaggatggtctcgatctcttgacctcgtgatccacccaccttggcctcccaaagtgttgggattacaggcgtgagccaccgcgcccggcctcagtgccttttttaacttgagggtgtagaggtcctccacgcttgtttgcctgaaagtaatataatgatgctgtctgaacaggttttactgcttgctttccaagtaaaggttaattatgataataaagagatttggaaatgaa

SEQ ID NO: 410335 - DNA, 1162 bp, Homo sapiens
agctgcgccggcgccgccgggagcgctaggcctggtccctcttcctaggatagcgttgcgcgcatgcgccttgacgagtgagccggggagccatggacaactgtttggcggccgcagcgctgaatggggtggaccgacgttccctgcagcgttcagcaaggctggctctagaagtgctggagagggccaagaggagggcggtggactggcatgccctggagcgtcccaaaggctgcatgggggtccttgcccgggaggcgccccacctagagaaacagccggcagccggcccgcagcgcgttctcccgggagagaaatattattcatctgtgccagaggaaggaggggcaacccatgtctatcgttatcacagaggcgagtcgaagctgcacatgtgcttggacatagggaatggtcaggctgagaacatctctaaggacctctacatagaagtatatccagggacctattctgtcactgtgggctcaaatgacttaaccaagaagactcatgtggtagcagttgattctggacaaagcgtggacctggtcttccctgtgtgatgttgaccatcactgccatcacatcacctttttttaagtagtaagaataaagccactgtatgattctcttaatagctatacattaatcctgtttttagtgctgactgggtcagccttccgggaactggagtctgtctctttcagtgcttttttgtttgtttggttggtttttttttgagacagtctcgctctgttgcccaggctggagtgcagtggcgtgatctcggctcactgcaagttccgcctcccgggttcacaccattctcctgcctcagcctcccgagtagctggcactacaggcacccgccaccatgcccggctattttttttgtatttttagtagagacggggtttcaccatgttggccaggatggtctcgatctcttgacctcgtgatccacccaccttggcctcccaaagtgttgggattacaggcgtgagccaccgcgcccggcctcagtgccttttttaacttgagggtgtagaggtcctccacgcttgtttgcctgaaagtaatataatgatgctgtctgaacaggttttactgcttgctttccaagtaaaggttaattatgataataaagagatttggaaatgaa

SEQ ID NO: 410336 - DNA, 605 bp, Homo sapiens
agctgcgccggcgccgccgggagcgctaggcctggtccctcttcctaggatagcgttgcgcgcatgcgccttgacgagtgagccggggagccatggacaactgtttggcggccgcagcgctgaatggggtggaccgacgttccctgcagcgttcagcaaggctggctctagaagtgctggagagggccaagaggagggcggtggactggcatgccctggagcgtcccaaaggctgcatgggggtccttgcccgggaggcgccccacctagagaaacagccggcagccggcccgcagcgcgttctcccgggagagaaatattattcatctgtgccagaggaaggaggggcaacccatgtctatcgttatcacagaggcgagtcgaagctgcacatgtgcttggacatagggaatggtcagagaaaagacagaaaaaagacatcccttggtcctggaggcagctatcaaatatcagagcatgctccagaggcatcccagcctgtgagtacggaactgcttacgcactgggtttcaccaccgttgcaactccatgaaccagttgacatggttcttagagggctatttgaattgagtctatagtatttt

SEQ ID NO: 410337 - DNA, 301 bp, Homo sapiens
ggggtggaccgacgttccctgcagcgttcagcaaggctggctctagaagtgctggagagggccaagaggagggcggtggactggcatgccctggagcgtcccaaaggctgcatgggggtccttgcccgggaggcgccccacctagagaaacagccggcagccggcccgcagcgcgttctcccgggagaggtgagggtcgctgtgccgggggccgccccagtccttcgcgccgcggtagcccgctgggagccaggggtgcgcagcgcagaagcagctgaggaaaccttcccttagcggaagc

SEQ ID NO: 410338 - DNA, 286 bp, Homo sapiens
ctgtgctctatgtccgcacaagggacgcaggggcgtccaggacgcaggggcgagtgaggcagggctgcccttccaggaccctaggttccccaggatgctcctcctattggggtcctctggcttccagttacgcatctgggcagtgtcccaaggccggtccgggagttggatgagaggattggagttccctggagacctccagacctgcactgctacccttccgtgttcttgcctcctggcctctgtgcaatgctgacaataaacctgtctctgcgtcccagaatgc

SEQ ID NO: 410339 - DNA, 300 bp, Homo sapiens
aatgtagtgttcttcttcctgtgccccaacgaccggctcgtgcccgatgtgccagccctggctaccaagataactgcgcgagcgctacctggccaagcaggcggtggcagacaaccgggagacgctgtttcagtcagcaagttacgcatctgggcagtgtcccaaggccggtccgggagttggatgagaggattggagttccctggagacctccagacctgcactgctacccttccgtgttcttgcctcctggcctctgtgcaatgctgacaataaacctgtctctgcgtcccagaatgc

SEQ ID NO: 410340 - DNA, 475 bp, Homo sapiens
gacgccactgtaccgtgggagccatggtattatactcagttccctgttccgagaagctgccccagggattagtcaccctcacccttgggtgggcagcttaacttctgcccacacagaccctgggggtggttctgccttacggcggtgtcccagttatcagctgggctgcagcttctggggccagggcgcccaccgtgggtcccatgtttggccttggtgtgctctttctgcacgtgaggcagcagtgaggtgctggctaagagggcgtgtggtgggagttggaccctctcgcatggctgcagtgtgcagaacgtgctgggagaccccaggactacagacggtggctcctgtgccctgagaaggacccggcttcttcacgaggagatgcccaaggctctgcagggtaacccagagcccttggtctgcaacgtccggggaactgtgtgttcctgggcgttcatgtgcctgtgcactc

SEQ ID NO: 410341 - DNA, 322 bp, Homo sapiens
gctttgtctttctgcttgcacctgtcacggctcgcttcagggaacagcgcagacccgcatgctcagctctcagtccggctccctgctacccctgtgaccaggagcaccttcatgtctgctcgccctgtgatttggagagtgtgtttgatgcgcttggcttctgctgatggcctatcctcccagttctggccagaggcagatgcggtgggggcctcttctccactgcccccctgcctgcacctccagcaggtggcccagtcctatatttccattgctttgctctttcttgctttaaaataaacaacaaaggcaacagactcta

SEQ ID NO: 410342 - DNA, 417 bp, Homo sapiens
ctcccacctcagcctcctgagtagctgggactacatagcaagccaccatgcctggcttttttttttgtttgtttgtttgtttgtttgtattttttgtagagacgagattttaccatgttgctcaggctggtctcgaactcctagactcaagcaatctgcccacttagccccgaagagctgagattacaggcgtgagccactgtgccctgctagtctttaaaattctgcaataggtttagcagtgtcttagcagaaagtgctatttgagtgctggcgactggcttgcatagtggaaatatactggcctgagctctgcccacctgaccacatactgatgtcattatcctcccttcatcaaccccctctgcttcacatagtcttgtctgaagggaatgggtcagctggaagaaaaaaaaa

SEQ ID NO: 410343 - DNA, 335 bp, Homo sapiens
cttcagcagtgtctgaggagtgtgacaacacagatgctgggttatttaagaaaggagagtttcaaaaattgtagcttacattgtagtcattgtgtgctattttttgtatgtatgtatgtatttatacacacagaaatggggtcttgctctgtcacccgggtggcgtgcagtggagccatcacagcttgcagctcaggatccttctgcctcagcctcccagctactgacgtggctgaagcaggagaatcgtttgaacctgggaggtgtaggctgcagtgtgctgagattgcaccactgcaccccagcctgggcaagagagcagagctcagtctcaa

SEQ ID NO: 410344 - DNA, 380 bp, Homo sapiens
taagaatcaatagttggtcagtttgtcaaaaagttagttaaaagatagaggagtataaagatgatgtatacataccttcattattttattcaaataggccgggtgcagtggctcatgcctgtaatcccagcactttgggaggtcaaagtgggcagatcacttgaggccaggagttcgagaccagtctagccaacatggtgaaacccagtctctactaaaaatacgaaaattagctgagtgttatgacgcatgcctgtggtcccagctactgacgtggctgaagcaggagaatcgtttgaacctgggaggtgtaggctgcagtgtgctgagattgcaccactgcaccccagcctgggcaagagagcagagctcagtctcaa

SEQ ID NO: 410345 - DNA, 446 bp, Homo sapiens
taagaaaacagaatttcaaagaaggtaggggacttgcccagggatacatagctagcaagtggcagcgctggattgagtctgggccttgtctgaggctcgggtcctgtcatgctctgcggttgctatgttgacatgcaaagggagaggcagctgctgggagtctaggtgggtttctctttgagaatgctaacgtgaaccctcaaggtgaatcagaatccttttgcaagtgaataatcagatgtaggttcctgtgtctccctgtaaaatgaaagcctcttttttccaaggtccagtatagacctgaagctgggttactctggaatttccctctctggctggagtgactgaggccttgcacgtgacattggtgaggactcgcagcctcaggtctggcttcccttagcaacccccctttcctgtctctgcctctggagttcaccattaaa

SEQ ID NO: 410346 - DNA, 333 bp, Homo sapiens
gattttcgtttttgaagtgactcgcatttgtgatttttgtttttgttttgaagggacaggtgtggctcctgtgagaacagcttgttagagatgagtggaggcaaggagactgttaaaacactactgcaggccgggtgcggtggctcatgcctctaatcccagcactttgggaggctgaggtgggcagattacttgaggccaggaattcaagaccagcctggccaacatggcaaaaccccatctctgaagcatgaggatcacttgaacccaagaggaggaggttgcagtgagccaagatagcggccactgcactagtgagacactgtctcaaaa

SEQ ID NO: 410347 - DNA, 467 bp, Homo sapiens
aaaaatgtgcctgtacagtttgagaaaaggaggcactggtgtttctcaaacttctcaggccaactacccaaaggtttcatgagcatctcaacaacagagtgggctcttctgtgctacatattttgataaaatggtgatgggcttcacaataacaatgggcaggatggggaagaagaccaggtcatttctgattgtctcagggtcgttgaaatgaggctaaggcttgggagaaccagcctgtcctggaggtaggggtggaggctccagcaacatttccagtctcactggagagcttccccacatcggaaattcctcatcagcctccttaccgctgagaagagggaatagtggggtggtgtttgcaacttaggatccttgaaattggaacagagctctgccctctcctcaatgaatcctagtggagaccctacaaggtagactaggtgggaatcattgctctaactttc

SEQ ID NO: 410348 - DNA, 513 bp, Homo sapiens
gactccatctaaaaagattaaaaaagagagagagatattagttgtttggcataactgctacccctgccccttttggtaaatcattagccagaaaaccatgcaattactatttaatttttattcttttagaattacctttgcatcctgattctgctgtctgatattttttgttgttttgttttgtttttttgagacagagtctcactctgtcgcctgggctagagtgctgtggcataatctcggctcactgtaacctccgcctccctggttcaagcgattatcccgcctcagcttcccaagtagctgggattacaggtgcctcccccccatgcctgggtaatttttgtatttttagtagagatgggatttcatcatgctggccaggctggtctcgaactcctgacttcaagtgatctgcctccctcagcctcccaaagtgctgagattacaggcatgagccactatgcccagccattctaattttttaatatcccgtttccattcctatctctt

SEQ ID NO: 410349 - DNA, 697 bp, Homo sapiens
cccggtaggcagccacgccgggctccacacaggtacagacagctgtgcccaccaccagggcacctggtgggggtgtggcatccaaaactacatccacaccagcgcctggcaccccctcatagaaagtcagggctcggtcaccagggaactgcacgcccaggtcctggcttcggcgcacctggcgcaccacagccggcaggaaaaggccatcaccacgccgagccagcacccgctgggaccgcagctgccgcaggtcatagctgccactggtgctgccagggggccaagggcctggaccacaagcctcagccggctcatcctccaggtccgccgagtgctcgctggctgtgtcagtggaggaggaacgagtggaggtgggtggccgtggaggcacccccaggccactggcctcctcaggggtccgcacccgctcttcaggggccccagccaccccactgctgccagctccgtgctcctccacatacttcttcttgggcgctcgagacttgaacgtggctgtcttgcggctgagtgagggctcccagcggcctgcctccccatcccctttggggtcctctgctgggcctggagccgggtcgccagggtgcagctccagtggaggaccttcagccccagggccccgctcagcctcctcctcctccccttcctcagcctcttcgggcccggactgtggttg

SEQ ID NO: 410350 - DNA, 442 bp, Homo sapiens
gctgcaggccactcatcttttcccttcccccactttgaccccacaaccacaaagacttggtcccagagggtagacagtatagcatggggccaagtcttggctgtgtgacccaggcaagtcacccagcctctctgagtctccttgtaaaacaaggccattgaggcacctgcttctcaggtccggagggggcatctacccacagtggctcacagcacagcaggagcgaggccccagtaggaatttggtgtcactgcagtgtctaggccagcagtcttcaaggaggggaggctggcagagatggggggatctggatgtcacaatgacaagggagcatggctgacgagcaggcagggatgtgccatgggggactgccaggcaggacagccccacccacaacacaaacagtgccctgctgagaaaccctctccaagcccagctggtc

SEQ ID NO: 410351 - DNA, 449 bp, Homo sapiens
ttgtcttattttaaagaactgccacagacaacccaacattcagcaatcattaccctgaccagtcagcagatgtcgacattgaggctaaacccctcgctaataagaagattattatttgctgaaggctcaggtgatcattagcttttttgttgttgttgttagtaataaactatttttaaatcaaggtatttacatagctgtgagggaaatggctgcgcttcagtcaggagcaggctgaggtggccttctggtgcagcatgactcagcgggtttgtggtgcaggtgcacagctctgcacattatgcaaccacaccacgtgaggagcattagatgatgacctatgtgagctcatgcttggctcaaagccactattgtctgtaaaaggtataattaccccggtaatgctgcacatatggctcacttgcacccagagagagagtaaagccatg

SEQ ID NO: 410352 - DNA, 390 bp, Homo sapiens
caaatctcatattgaactgtagctcccacaattcccacgtgttgtgggagggactcggtaggtaactgaatcacagggctgggccttcccgtgctgctctcgtcctgacagtgaataagtctcacaagacctgatggttttctaagggggagttccccttcataagctctcttgcctgccatcatccacgtaagatgtgactttgctcctccttgccttccaccatgattgtgaggcctctgcagccatgtggaaatgtgagtcaattaaacctctctttatacatttcctagtcccaggtatgtctttattagcagcatgaaaatggactaacacaagatcagagcaggtctctccacgtgcagaacaccccaggacccaacacttcac

SEQ ID NO: 410353 - DNA, 362 bp, Homo sapiens
tcaggcttattaaactgccttaataacatgccttttttttcccctcattaactatttcaaagttagtgactttgtgggatcctgggggaagctgtaaaaggcagatcaaacgaaacagtctctgcccatcccagtccctccaccctctgagctccctgcccgtccattaccgtagaatgctgtttacagcccttttcatctctcactacctgcttctgaagaggaatggggtcggcaagaaaagggcaggaggaaggaagtctgaagccatcgaaggctgggcataaagacagcaaatgaggcagaagcgagcaaagggaagatccctcctgcctggggctgaattccccattctctccagc

SEQ ID NO: 410354 - DNA, 316 bp, Homo sapiens
tgtgtcggctccgtgcctccagcggtgtttgtctttagggcaaatacccactccgccctgggctgccacatctcacaatggggaagtggggaaggggggtttgcaggggtggttgcagggtgagggtgtgtctggctgcacagatttacacgcccgtgggctgggtgggagtgcggtaggccaggtctcactaacgtgggcctccatgaccagtttcagtactgagggagttaaaagccagtgcccttatacaaaggctggaatgtaacagaagcataccaagagttttgcctagccctttcctgggccttaaagc

SEQ ID NO: 410355 - DNA, 510 bp, Homo sapiens
cttaggcatacttttctcccttgcaaatgaaagagccttctctgagatagcttggcatgaaagtgatgtactggaaagagttccagcaggaaacagagggcacactcaacctgggtgctggggaggggttgatgaggggactgttgaggacagcagggcagcgtggagggacctgcaggcatgctgtggaaccagccaggggctgaaccagaacccaggggaagctctggttgtaggaagagcagctcagagaagtcagggcttcagttagagggcacagctcttgtaagggaaatggctgcacttcagtcaggagtaggtcgaggtggccctctggcacagcatgactcagtgggtttggagtgaaggtgtacaactccacacattatataaccatgccatgtgagatgcattaagtgaccactcacacgagctcgtggttggcccggagctgctattgtctgtaaaatgtactgctggcgctgtacgtatggctcacgcccagagaga

SEQ ID NO: 410356 - DNA, 320 bp, Homo sapiens
catataccccgctaaactttctctgctactgtggaataggtggaacatgtatagtgggaaccacaagctgtcactgccacattcttgcatgtctcaagaagctactggcaggcttcccctttttgccttattggccagaaaagtattgcatgcccgcgcctaagccaaccatgacaagggaatggtaggtaccatcatgattagcttacatcaatcaagactcccaatctaagcttggagttgggactagcctctcctgaaggatatgacttccagtaaaagagcaggtacctgggtgaagtcagaattcttaggaagaa

SEQ ID NO: 410357 - DNA, 361 bp, Homo sapiens
aatatctatccagaaaacttgcttaaattctgatatggtttatttagtttcccatcacacatcttttctggcatttaggataccatgctattcaaaagaataataaattatcatagtgtgcaacaaaaggaaatgcaaattcattctggacaattcctgatgggtgaataaatgattaaagcttcctatctgaaaccttggcaaaatatgtgttttaaagattattttaaaatataataaaggaaatgcagctcaacctccttcttgagattatttataccagattgctgatcacctgacccactggactgatggatttgttagaagcaccctaggagagcaccttgtatacagcgttcat

SEQ ID NO: 410358 - DNA, 164 bp, Homo sapiens
gctgagcagacttatccctaatggccggaagcgctcctctctttgcccaccaaccccagctccaaagcagatgcaagtgtctccatttccctggtcttactttactcctctgcctcctgggatcagaataataatttctagttctctggattggctctgctttg

SEQ ID NO: 410359 - DNA, 259 bp, Homo sapiens
gtctcagaggttgtagtgccactgggagttagttcagaattctggaattccttcctggatgttcaggttagaacctaccattctggcttttccaaaaatttcgaaagtatctaattctctattaagtctctctttggtgggtcagtgcagtggatcatgcctggaatcccagcattttgggaggctgaggtaggaggatcacttgagcccagaagtttgagaccagcctgggcaatataggaagacctcccatttctac

SEQ ID NO: 410360 - DNA, 247 bp, Homo sapiens
tctaacagttggtttcctaataaatttcttgcatatttaattttattctgggatcccaccttctctgaggacctggactaacacatccccaaatctgtttatgcctgttgcaggtgctactgtaattacataatttaactaagccataactaaaccatagaaatatggacacagaaggaaagtgagttgttatttctatgaaaaccaagtagactgctttagaaagttttgaaaagggtatttgctt

SEQ ID NO: 410361 - DNA, 432 bp, Homo sapiens
actactaaatttgcggccggtcgacttcagcctgctggctcctggtatgaatgtttgctgcattggcagccagatttgaatggaaggatggagtatttttaaacataaaaactaataagcacctggaaacgtaactttgtgggtggtgctgatgcagtgtatttctttatatatcagtaggctagtttttcagtgattcatcaaactaattagcatgggagcaccagaggtgacaaacccatgggttaactctggcttgatgtggtttgtttggcctgtaccaacgatatttaaaatgttattttaggccaggtgcggtggctcaccctgtaatttcagcactttgggaggctgaagcaggcgtatcacaaggtcaggagttcgagaccagcctagccagcatagtgaaaccccatctctactaaaaataca

SEQ ID NO: 410362 - DNA, 386 bp, Homo sapiens
aagctaccaccatttctgtgaccccatctttctcatgacctccccacctgactacagcatttccttcttagaatccacagacctctcggtcaagaccttggcaggaatataaactttatgaaaagagactttcagagaggaaaaagctttatgatatcaggttgggaaggttcatacagacccccttgggcagggcaggtaaatgttagctcagagttgggatccaggactttgcagtgagaatcaagcatgtgctaaaggctaatggccccagaaaaggggcaaaaatttagagttagagttctatgtcctaaaagaaaaatatcaaggataaaagaacatggctcactgggcagactatcaagacaggtattcaaaaaaaaaaa

SEQ ID NO: 410363 - DNA, 375 bp, Homo sapiens
gggatgtgagtaaataggacattcaagtgcttgaggtattctacgcactggcctaggaaatggtcacataggtatgtgccctttgaaagaattaacttagtcataaatataagacaagtatttttgtatatgtattttatgtacaaatatatgtgttacgtaaatttacttcaaagatgccatgtaaagaatggaagccaccattctgaataattctacctaaatatcctaggaacgaccccacccttagaagaaaccacgtagtgaatataagtagtttggtttttatttgtgtcattcagaaaattgactcatttctcccaccacactctgtataatctcaaaataatgagttatttctgcatgctatatagt

SEQ ID NO: 410364 - DNA, 351 bp, Homo sapiens
tttttttttctcatcagctattgttagtgttaatatattgtatgtgtggcccaagacaattcttctttttccaacatggcccagggaaggcaaaagcttggacacccctgctctaagagttcaccatcaggatggggcagcagcctgtaagcaactgtctgtggcagccagagggagagagagggtttagaaagggctcaggaaactaggatacatggatgcagaggagggccccctgagaccacaggggcagagcctacagtgatgcagccacaagccagggaacaccgggagcctctggaagtgggaaggggtaggaaggaaggctcttttcctggagcttccggggcc

SEQ ID NO: 410365 - DNA, 396 bp, Homo sapiens
tattttatttatttattttaatttatgtatgtatgtatgtatgtatgtatgtatttatttatgtatttatttttgagacggagtttcgctcttgttgctcagactggagtgcgatggcgcaatctcggctcactgcaacctccgcttcccaggttcaagcgattctcctgcctcagccttcctagcagctgggattataggcatgtgccaccgcgcccggctagttttgtattttcaattgagacgggatttctccatgttggtcgggcttgtctccaactcccgacttcaggtgatgcgtccacctcggcatcccaaagtgacgggatgacaggcatgagccaccgccccggcgtattgtattgtattgtattgtattgtattgtacgtgagtgg

SEQ ID NO: 410366 - DNA, 407 bp, Homo sapiens
tttttagtaaagacgggatttcaccatgttagccaggctggtctcaaactcctgacttcatgatccatccgcctcggcctcccaaagtgctgggattacaggcatgagccaccatgcccatcctagagctccattttataatgcctggttgagaagctcataaatggcaaagcaacacattaaagagagagaggaggaaggtggtgaaagcgaggtggcagggatgtatctgggaagataaataagggaaatgaatggcctttacctaggtgagaacagcagctcagtgcaggctgtgatttgcccactgaagcactgctcctcctgctgatacacaaattgcatgttgctttcttttaagaggctgtcttggtcaaaaatagcatctctttttttcctctctctcc

SEQ ID NO: 410367 - DNA, 441 bp, Homo sapiens
gctttggcctcccaaagtgctgggattaacaagcatgagccaccatgctggccagtttttgtacaccttaattgtttgcctcagtctcagctaatacagttcacttctgatattttaatatactttatattatatggagacataaaattacattgtgtagataaaaattttctactctgataactttgtcagcagttgaaataaggagaaatatattgtaaatttctacattcctacttaaaggacacagaaattttaactgaaaagtatttattaagcattcttgtaattaccaatttactggttgtccctgggagatcgtaagtgctgtgagggcaggtgtctaaggctgtggtgtcattctgtagcacatcagagtcagatgtactaagacagagcttaaccctgaggtgttcaatacatgttgaatgaatgagcact

SEQ ID NO: 410368 - DNA, 447 bp, Homo sapiens
tctgcctcttaccagcagcgtgaccttggacaagctatttcacctctgagaaccttagtctcttcatttgaaagttgagagtatgattatctatctcttcaggccattgagaggattaaataagaacagagtatctctactaaaaatacaaaaattagccaggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaagaacagagtagcacataagttccactgtacgtaagtgcttaattaaatattcgctgtcatcatcaacatcatcgatatctcttgccttctaacttctaactgtgcccccgccccca

SEQ ID NO: 410369 - DNA, 1915 bp, Homo sapiens
  misc_feature (1231)..(1231): n is a, c, g, or t
  misc_feature (1442)..(1442): n is a, c, g, or t
gtacaaaaggacatgatattccatgttagctatatttctctctgaaaaaaaaattccttcttttagaaaagtttatcaaacatttaatctaggagaataaactattgacaactacagaatttgttcccgcagaaaatacctaaagtctctgctcatttcatgtttactaatatttcattagtcaaagcaagtcacttaaccaagctcaaagccaagagacagagatatatatcccatctcccacattaacacatactctactgagagttacattcaagtcatatggtaaagtttatggatgtaaagttctattatagagagggagtgaagaattagagaaagtaatccggtctatcacatatattattggtttggactcagaaacaaatggtttgaataaacaacttaagaagcctgatgagttataagggacttttgtgttagtgattgataccacatttacaatcacagtctctctaatcactttcaggggttttcatcatagattacttttgaattcatcaattatggtaagcactgaatagaaaataagggtcagataaaacacagtaggttagagatgaagagtgcgaattctattccagctctatcactgagggtgaaatctcacacatttctactgattttctcccccctcagtattatgatctcaaaaaaaggagtactactcttcttttttattttttcttagtatagaaagcatacaaaaggcattgtagaattctgtgcgtagcataaattacaagaggacgattaaaatccccacaatcgtctagaagtaatttgttttcaaactttggggatatacctttctaatcattttttttcctgtgcatatataccctttttgtttttggtaaaacactgtgaacactgtttctacttttgtctcttaaatctgtgttgtgagtaacattctatgcctttaaataatcttcagtgtcatttttgtgaagatttattccacattcaccatcctttttttgtgaaatttaaatcagatgtcataaagtctttaaaaagcagaattactttgaaaataaaggtattattattatagaattttagagattaaagaaaaaacagaaactaacatttaatgaagacctactctgtgccatgccatgtgcttagaactttgtttaagccatttcatttaataacctttcaacctaatgaagcaatatagcatgatggttaaactctgtgngctataggctgtcaagttcagctgcacagcggctaactagctttatgacttttcaaatgtttatcttctttttggcttagtttctctgttacaaagtggcaataataataatagcactcacttccaaaagattgttgtaggattaaatgattggataggttcaaaatgttaggaacagtagtattcaataaacatagttattatttgctanctttcccactactccataaaccctctattaaaatacaaatccacattgattttaactgctttggtgtagaagtggattctaagaagaggcaatgtgaaataaatggaaaagccaaggattttatgttttttaatcctggctcccagccttctaataattttgcctctgggaattttgtcaagatttacaggctgggcgtggtggctcacgcctgtaatcccagcactttgggaggccaagggaggtggatcacctgaagtcaggagtttgagaccagcctagccaacatggcaaaaccccaactctactaacaatacaaaaattaaccgggcgtggtggcacacgcctaatagtcccagctactttggaggctaaggcagaaggatcgcttaaacccgggagacggaggttgcagtgagccaagatcgcaccactgcactgcaatctgggttacggagtgagactccgtctca

SEQ ID NO: 410370 - DNA, 442 bp, Homo sapiens
atccaatggggggaaataaaaccttccaaaagggatttggcctccccttcattcaaggaaccgtgggtctcgaatttgggtgagagttcctgactctctactgtagtggctcagacaagttcactagacctggagttatttgttcatttttggttatttaaatcaaaacaggccgggcatggtggctcacacctgtagtcccagcactttgggaggccgaggcgcgtagattgcttcagatcaagagttcgagaccagcctggccaacatgcgaaactttgtactaaaaatacaaagaaaaaaattaaaattagccggtgtggtggtgcatgcttgtaattccagctacttgggaggctgaagcaggagaatcacttgaaccctgggggtggaagttgtggtaaactgagatcatgccattgcactccagcctgggtgacag

SEQ ID NO: 410371 - DNA, 923 bp, Homo sapiens
tttttttttttgaaataaaatatttatttcagataaagttaatatttccataattaaggtaaagcaaacatatatgcttgagtccattatttaaggactataaaatgacttccatgaatattagagttcctgaatgtcatttgagtatctgcctacatgcttgttggaagcttctgtagccttttctttgtaggaattccagtttttctgaattcttccctttccttcaggtattccattttgcattcttcataaaaggctggatcattatagctatgagaaggaaatgaaaatattttcaagtaaataatcctgcatgtgttaaatgtaagcttactttaattactaatattcagacatctggttcatcaggctcaatctttagaagtacacttttagtaatggttaaaaattcactgttaactttatgctaccaaactaaagaccaaatcattcatttttatatagcactgtcacagaatagagcaatgagaagcacagctcctgtcctgggaacccacggtgtaaaggacaagtaaagactggattaaaattaaatctacaaaatactgtgacagaggtatggcccagtgcaccatggaaacaaggaagaaatggggagggcagaggtttcaaggggaaatgcttgcgttgtattttgaaagaccaacagaaatccatatagaaggcaagtgtgggaagacacatggatgaggaaaaattaatgcaggaaaacctgccaagtagataggtaccactatagcagattatgcacataggagaaaaggcctgaaatgaagatggaatgggcaaaagtcaaatcatgatgtgccatttatgctatactcagaaattaaaatcaatcctgaagaaaatggggcacaattaatagagcacctcacctgtaagatcagttttgtgtc

SEQ ID NO: 410372 - DNA, 635 bp, Homo sapiens
ttccattgcgcattcttaataaaggcttggttcataatggttatgagaagaaaatacttaatattcagacatctggttcatcaggctcaatctttagaagtacacttttagtaatggttaaaaattcactgttaactttatgctaccaaactaaagaccaaatcattcatttttatatagcactgtcacagaatagagcaatgagaagcacagctcctgtcctgggaacccacggtgtaaaggacaagtaaagactggattaaaattaaatctacaaaatactgtgacagaggtatggcccagtgcaccatggaaacaaggaagaaatggggagggcagaggtttcaaggggaaatgcttgcgttgtattttgaaagaccaacagaaatccatatagaaggcaagtgtgggaagacacatggatgaggaaaaattaatgcaggaaaacctgccaagtagataggtaccactatagcagattatgcacataggagaaaaggcctgaaatgaagatggaatgggcaaaagtcaaatcatgatgtgccatttatgctatactcagaaattaaaatcaatcctgaagaaaatggggcacaattaatagagcacctcacctgtaagatcagttttgtgtc

SEQ ID NO: 410373 - DNA, 441 bp, Homo sapiens
tctgaagagcagagatctccaaaaactaagcatttcaagtgataatatgcagcatgcatactgggaactgaagagagaaatgtctaatttacatctggtgactcaagtacaagctgaactactaagaaaactgaaaacctcaactgcaatcaagaaagcactgtcacagaatagagcaatgagaagcacagctcctgtcctgggaacccacggtgtaaaggacaagtaaagactggattaaaattaaatctacaaaatactgtgacagagctactctcatgaactactctggtccctccttctgaccactggctgccctagttccagactctgccacccctcatctactgtaagtaagcaactatttccaagtgagatcttaaacatcgtccttacaaagaagctgtaggcaaaaaaatgaaaataaaaataaattgtgta

SEQ ID NO: 410374 - DNA, 813 bp, Homo sapiens
atgggccctgaaaatacagacatatcagtttgagtccctgccctcagagggcttatactcattgggatcattagctcgactgcagaagcatcaaaacttgatgcaggaattattactaaaagatttgttcgtgaaaaattttgagtatcttatacattccatatggttgttataagttgggaatataaaaagtgaccaaaacatgttaaatgctaacatgaaggtacaaaccataaaatgcagtaggactaggaggttcggaatcccaggggaatctggattgcatgaagaggtgactggcataagctggatcttctcatcttgagattttcttaaggtaagaagagggagaatggccttgctatgaagagggcattgaatagtgaaaatggctgaaacagtgtgggagaggtctagtggaatatgagaccacaaagcaagactggagtcagacttgaagaacttgaaatgccgtattttaaaaggcagagttaatagggcataaagattcaaccaagtgttctacctacttggtggccgagcgtggtggctcatgcctgtaatcccagcactttgggaggccgaggcaggcagatcacaaggtcaggaaatcgagaccatcctggctaacatggtgaaaccctgtctttactaaacagaaaattagcctggcgtggtggcgggcacctgttgtcccagctactggggaggctgaggcaggagaatggcgtgaacccaggaggcgtagcttgcagtgagccgagatcatgccactgcactccagcctgagcgacagagcgagactccgtctca

SEQ ID NO: 410375 - DNA, 535 bp, Homo sapiens
gctactgatgttattttagaatctattaattttggattcagagcagcaaaaaacaattgatagtatatatcctagggtttcttcaagattttgaggcatggaaatctgatttaaaagattttatattttcctagcctttgaaaatgagcattttgcccatggcattcaaaagtagctttctctttctgagtggggtacataattattgatctcttattttctatcaggagcttaagaattgtgttttcggctgggtgcggtggctcacgcctgtaatcccagcactttgggaggccgaggtgggcagatcacaaggtcaggagttcgagagcagcctggccaacatagtgaaaccccgtctctactaaaaaatacaaaaagtaagccaggcgtggtggcgggcgcctgtaatcccagctactcaggaggctgaggcaggagaatcgcttgaacccaggaggcggagattgcaatgagcagagattgtgccattgcactccagcccgggcaatagtgtgagactctgtctcaaaaa

SEQ ID NO: 410376 - DNA, 446 bp, Homo sapiens
tgaaacatggctagtctgaattgagatgtgctacaagtgtaaaattcacactagagttcaaacgcttagtacaaagccaaaaaatataaaatatctgactcataacctttgaaatattgaatatatgtttaggtgataatattttggatctaggcctggcacggtggctcacgcctgtaatcccagcactttgggaggccaaggcgggtggatcacctgaggtcaggagtttgagatcagcctgaccatcatggtgaaacctggtctctactaaaaatacaaaaagtagctgggcatggtggcgcatacctgtaatcccagctattcaggaggctgaggcacaagaatcgcttgaatccgggagaaagaggttgtagtgagcagagattgcgccattgcattccagcctgggcaacatgagtgaaactccgtctcaaaaaaaaaaa

SEQ ID NO: 410377 - DNA, 446 bp, Homo sapiens
accactaaatagcaagctctagctgctaagcactctctaaagtggaacaactctttggataaaacataatagtatttctgttttgcattacagattatactgttctgctgataagagctttcacatttattatgtcacagcttccttgtgggtcagaggctgggcgcggtggctcacacctgtaatcccagcactttgggaggccgaggcaggcgaatcacgaggtcaggagatcgagaccatcctgactaacacagtgaaaccccgtctctactaaaaaaaaatataataaaattagccgggtgtggtggtgggcgcctgtagtcccagctactcggtaggctgaggcaggagaatggcatgaacctgggaggcaggggttgctgtgagctgagatcgcgccactgcactccagcctgggtgacagagtgagactccatctcaaa

SEQ ID NO: 410378 - DNA, 476 bp, Homo sapiens
aatttaattataagaggatatgtgcagtttttgttattggtatattgtttattttagcttattttttaattttattagaattctggcacaatatagcccttgtttgcttttaaaaagatgggctgttagattgcctggattttcccctttatccactacctatgagcaaattacttccctcagctttagtttcattttgtagaaaatgggattatttttgtacctcatacgtataatagtagcaacaaaaactttgcctagttagtacttaatacttttttcttgccgagattaaataagctgatgtagcttccatgcttaacactatgcccttcattggctttggcttcacatacgctttggttctgatcctagttctactgtgagtttacaggttaatttctctgagccttctttacttaatcagccaaaaataaaaataaaaaaaaaaaggtgggggggatcatgatgcctgg

SEQ ID NO: 410379 - DNA, 451 bp, Homo sapiens
aggctatggtctcgggcccaagttcaaggtcccagtggagtcattgttggtggaaggatctgaacccaccaatcggccagctctgtatgagaagacaaggacctttctccatgatcctttcgtccctgtagcccagcctacagcagaaagatggggctgcacccctgccgtgggctgaggctgggaaggaacgcggacggggaggaggacccaggcagcacctccccgcggaccagaactcgaacccacagctctggacttagccgggggctctggcgctcgcctccgcctccgagcggatgtgccggatatttgttgccctaagttcctgaatcacctcctgagaaatgcattgtggtgggcgtgtgtgttcctctggggactccgtgcttgggcttaaagcatttaggaaatcaataaaataaatactctctaagcctcaaaaaactgg

SEQ ID NO: 410380 - DNA, 289 bp, Homo sapiens
gggcactcacaaataaaaccacactgtcaggctatccctagagatgagtccagagaaaggtcccttcatgagattggaattaggagatttggtcttgacagagaacttgaaagtctgcattggcagtgtacttgaaaatctgcataggcaagacatgcctaattaaatgtgatggtttttttctaagagtgtactttaggttgacgtaatgtttctgccaggttgtataaaggaaaatgcctgttaggtttgctgcttgaaatacattatacctggaagagtttaaagt

SEQ ID NO: 410381 - DNA, 464 bp, Homo sapiens
gctgaggcaagaggatcgctagagcccaggagtttgaggctgtggtgagatatcatggcactccagcatgggcaacagagcaagaccctgtctgggaaaaaaaaaaaaaaagctggcttgattttcctctagagtttcccacaatctagattttgctgattgcatccctgtggtgctgtttaacatgttcctctgtcctctgaatttcccggaagctggtagctgatctagagctgtgctgtgcagtgccatggccaccagccatatgaggctactgagcacttgaaatgcagttgatccaaattgcaatgtgctggaattgtaaaatacagcccaggtttaaagacttcatatgagaaaagaacagaagctatttcattgatcactttttctactgattatatcctggaatgctaatatttttgatatattgagttaaataaaatatattattaaaatcgact

SEQ ID NO: 410382 - DNA, 344 bp, Homo sapiens
actggcaagacgacccatttttaaagggccaatttttaacagctggaaacaataaacgtcgtgggaggtgaagatgctgggaggactgatttctccttcgctgttttcaaaagtcaaaagatgctgggtgtaatggcaacagccacagaaagttagcacaactcctgccacggagcagctgtgtgatggtggcttccccagtccccctccctgggcctcggttcttacagctgcaaaatgaggaggtagaatgagatgctctttaatatccctttcatcttcaactttctacaattcttgtaagctggaaagatgtacacagaacttcatcttgattttattac

SEQ ID NO: 410383 - DNA, 631 bp, Homo sapiens
tagaggcaccacacagggagagcagtgtgtggccacatgcttcagcccattttttctgattctcttgcttgcaaattaagagtattctccaaatcacttgactttccttttctcagagttatagttctccagagatgtcaccagatgattcacattaaaggtacatttccagttgacttttttatttcagatattagtaaatgattaccagagaactaattcaaactgtcatggttggaaatactctgatgctcaactccctaatctatagagtgagttaaggtctatactcttttgcaagcattgttctagtggcagtgaccctgttcatgattcagcctgacatttactatgctgccctgaaaaccaactagatgggagcttgtttctctctgcattgtgtagtgagtggtgtcacccaggactttcatgtgagaaaaagcaccttgcttttaatctgggaattttgagtgttttttgtaatgcctcagtttattcttatttatggttgattatatgtgatttagaacacttgctatttatgtctgatcccacaaatcagcactcactttatttgcaaagcaccaaatttcgtgtaagaggtgtagtaattgggaatgtgaagctaagt

SEQ ID NO: 410384 - DNA, 438 bp, Homo sapiens
tgccgcgggagtcagagaaaacctggggtcctgatgatgttgttgagctgctgaatcaaccatccctaaaccctatgctcccaagacttcttgtcatactactacaacagcttcttcatgatgtccaaaccccaatttggcctctctctgatccttcatctatgctgctgtcacatgggccttccggtgatcttatctgaagcattaaaagcaagaacacacttttgcagacttcttttcctggctctctggtaaccagctacatgtcttccacatgaagcctcctgagttcatcagtacatcattgcatcattgacatgaccctgctgaactatgccacgtctgcctttgcttaagtgggtaggactgaacctgcagcaaactttggagcactcatttgggtcacaatgataaaaataataatacttaataataaaa

SEQ ID NO: 410385 - DNA, 584 bp, Homo sapiens
agacccctacctgactgtcatcctctctcagtggcgagtccatctagttcagactcagacaggtggaagaagtcaactcctaactagggtataatgaagcatgatggaagtatttgacccagcggctcttctatacccaggaggccctgactgccacattcaccagttgattttccagggaacataatcagaggcagaatcgtctggtggttaaaagtacaatctggagttagactgcttgattttcaatcccagctcttccactcatcagctttgttatcttagccattttctcagggccaggtaactagattgaagcagagtccatgaagaactaaccatgcctcactccacccctgcagatggctccttcatgaagatctccccatttggaacacaacatctgtttcctgctgggaccctgactgacacaagggtcaaaataagctcctccatgggaagcattgagagaggcagaaaataaagagaaggaagataatactatccattcattgcagtcgtctatgtgctaaacactgtgtgaagcattttgcatgtattcaataaatatttactcaatgctt

SEQ ID NO: 410386 - DNA, 421 bp, Homo sapiens
agacccctacctgactgtcatcctctctcagtggcgagtccatctagttcagactcagacaggtggaagaagtcaactcctaactagggtataatgaagcatgatggaagtatttgacccagcggctcttctatacccaggtaactagattgaagcagagtccatgaagaactaaccatgcctcactccacccctgcagatggctccttcatgaagatctccccatttggaacacaacatctgtttcctgctgggaccctgactgacacaagggtcaaaataagctcctccatgggaagcattgagagaggcagaaaataaagagaaggaagataatactatccattcattgcagtcgtctatgtgctaaacactgtgtgaagcattttgcatgtattcaataaatatttactcaatgctt

SEQ ID NO: 410387 - DNA, 429 bp, Homo sapiens
acttaactcactgatgggcatgtagtaaatgctcaagaagcaatagagagggtgataatagctaatttgtcatcactcattcagcaaactttgactgatgtcgattatacaaggcactattctaaaatctagttttgttttttttttcctggatgagcaatgtacccctacagtcctccaggaagtcgtaatttgatgggagacaaagaaacatagccaaggatacaattttaaggtcaccttgaatccttcctggaaaaaagcaggtcataaataataatggttgttggagaaaggtctctaggaaagatgaagaacttttaaattcctagaagcatcttagaaaagataacacaaaaactttatttaatgtaaaaataagagctgagagtcagttaaataaacattgttaacagttgaatttttctg

SEQ ID NO: 410388 - DNA, 609 bp, Homo sapiens
tcatcaaaggtcacagagctaagagtggcagagtcaggcctggagcccaggaagtctggtttcgaatttcatgcttctaacctgagcactgtactgcttggtggagttctctgctagtcctacctttcaggcagaggagttgaagagcaattccctccagtttccattagaaatgcttcttcttccatatcaaatattgtgagatagcctgaaacacctttcaacactttactacccttctccaaaattcaacagatatgatttccacggactttactcacaggggcttcagtagaagaggaagaggcttgggtttaattgaaggtggcctgagacatctgtgaggaacagcccttttagagacatatcccctacaaataaagcatcagaattattatcctaataaatgaacatccatggttccttcagcaccatcgtaatgcagagaccatggggagatgcagggagagggctctgcacagcatggccaacttgccgggttgaaaacagacaacctccatggagcagggacttcaattagttaattccccatccccactgtcacttactaacatgggattctgattaaaaattagattctctgcaaga

SEQ ID NO: 410389 - DNA, 557 bp, Homo sapiens
tcatcaaaggtcacagagctaagagtggcagagtcaggcctggagcccaggaagtctggtttcgaatttcatgcttctaacctgagcactgtactgcttggtggagttctctgctagtcctacctttcaggcagaggtgatgcagcaagaaagctgccaccagatgcagccccttgatctcggactgcccagcctctagaactatatgatttccacggactttactcacaggggcttcagtagaagaggaagaggcttgggtttaattgaaggtggcctgagacatctgtgaggaacagcccttttagagacatatcccctacaaataaagcatcagaattattatcctaataaatgaacatccatggttccttcagcaccatcgtaatgcagagaccatggggagatgcagggagagggctctgcacagcatggccaacttgccgggttgaaaacagacaacctccatggagcagggacttcaattagttaattccccatccccactgtcacttactaacatgggattctgattaaaaattagattctctgcaaga

SEQ ID NO: 410390 - DNA, 529 bp, Homo sapiens
tcatcaaaggtcacagagctaagagtggcagagtcaggcctggagcccaggaagtctggtttcgaatttcatgcttctaacctgagcactgtactgcttggtggagttctctgctagtcctacctttcaggcagaggtgatgcagcaagaaagctgccaccagatgcagccccttgatctcggactgcccagcctctagaactgggcttcagtagaagaggaagaggcttgggtttaattgaaggtggcctgagacatctgtgaggaacagcccttttagagacatatcccctacaaataaagcatcagaattattatcctaataaatgaacatccatggttccttcagcaccatcgtaatgcagagaccatggggagatgcagggagagggctctgcacagcatggccaacttgccgggttgaaaacagacaacctccatggagcagggacttcaattagttaattccccatccccactgtcacttactaacatgggattctgattaaaaattagattctctgcaaga

SEQ ID NO: 410391 - DNA, 676 bp, Homo sapiens
tcatcaaaggtcacagagctaagagtggcagagtcaggcctggagcccaggaagtctggtttcgaatttcatgcttctaacctgagcactgtactgcttggtggagttctctgctagtcctacctttcaggcagaggtgatgcagcaagaaagctgccaccagatgcagccccttgatctcggactgcccagcctctagaactgagttgaagagcaattccctccagtttccattagaaatgcttcttcttccatatcaaatattgtgagatagcctgaaacacctttcaacactttactacccttctccaaaattcaacagatatgatttccacggactttactcacaggggcttcagtagaagaggaagaggcttgggtttaattgaaggtggcctgagacatctgtgaggaacagcccttttagagacatatcccctacaaataaagcatcagaattattatcctaataaatgaacatccatggttccttcagcaccatcgtaatgcagagaccatggggagatgcagggagagggctctgcacagcatggccaacttgccgggttgaaaacagacaacctccatggagcagggacttcaattagttaattccccatccccactgtcacttactaacatgggattctgattaaaaattagattctctgcaaga

SEQ ID NO: 410392 - DNA, 2437 bp, Homo sapiens
gaagactgcgcgtttgagtgtccctggcaacgccacgcttccgccttctggaagcctgcactccagcttcgagtggaacgatgcctctggaggtggtggtggagctgcagatccgggcgatttcttgcccaggagtgttcctgcctggcaaacaagatgtgtacctcggggtctacctcatgaatcagtacctggagaccaacagctttccctctgcgttccccattatgattcaggagagcatgagatttgaaaaggtatttgaaagtgcagtagatcctggagctgtagtagaccttttggaaatgtgggatgagttggcctactacgaagaaaacacacgagattttcttttcccagagcccaagctgacaccttcgcaccctaggaggtgtagggaggtgctcatgaagacggctctgggttttccaggcattgctcccaaaatagagttttctacaaggacagccatcagagaatgtgtgtttctgcatagaaacagatttcttggctggggaaacaaagggaagatgttggttcagcaagaacacagaagcttaaagaagaaactgaacagaaatgggacccagacctctggagaagggctgctttcctggatgcttcttcaggaattcgaaggaagaaagacatgagtcacggaggcctttatctacatcacatgaaccaatatttcccttaaatactataaagatgaaactaaaggagaataatctcaacagactgcccaaaggcatgcaagcccgggcgccctctcaatattctaccaggcatttcttccaggaccagccagctcagttgaaccttggaaataatttcaaaatctctggaggaagcaagcctccatttgttgttagacacgtgagcctaaaattattttttagagcattttgcaatagtgaggatatggatgagggtggaagaaaggaaggttgagttataacaacaaatgaataatattcaataaaaaggtggacagtgcaaagccctttggtgagaatatttcagagcatcatttgaggaggtctggaagaaaatctaagttttcagactttccgtttccaacgagaagaggttccatcctggttctcagtccacatggaagaatatccatgagagggtatgcagtcttctgacatcccacagagcacagctgcaccaaaacaaggaagattctacctctgaagtaaattatatcattgaaagaccaagctaccctctgaagaaatactcactgcatgaacagagatatttttaaggggaaattaatgaaagcttaaggagaatcatgaagagctcactcactgagacaattgaagcatccttaaagaaatgaacactttttgttgtctgtgttgagtcactgatgtctaatcccctttaaaccaaaccctgtactcagtcttttgtgcccaggttttaagctccatgaaggcaggagacctagctatctgcttgttcacgaatgtatactcagtgcccagcacataggagatgctcagtaaacatgctgattgaatgactaacaggtatttaagtatggctgactgccctggatccctctcccaggctctggccccttggcagcagagtgttgccagaacaaaacttgccagttccagctgctgcccttatgatctgtgtgatcttgaaaaagtggcttaatctgtcttcaacctcctgtttccttatctctaaagatggagttaaggtcccacctacttgatgacttcatagggctgctatgaggattaaataaacaggttcatgatttttaaattccaaaatgtttcttttattccccagagaaaacaaggcaggatatgatcttactttgttaatccagggcatagggaaatctctgcagccttgattagtactccctggatgttcaaagggaaaggaagaggcaaagaggagcatgcaaaatctttctgtgcatgcatcacctatgacatctacttttcttagagacatgaagaactctcttaaaataggtaatatcaccactctaggctatttggtgatgttaacaaaataaactggtccttgagcagaatcagctaaaggtccccttgaagcctctgtcagctggtccacatttgaagttcaaaacatgcatcaagaagcagtgggctctccaggtgcagtggttcatgcctgtaatcccagcactttgggaggctgaggcaagtggatcacttgaggtcaggagttcaagaccagcctggccaacatggtgtaacctcatctctactaaaaatacaaaaattagccggtggtggtggcacacacctatagtcccagctacttgggaggctgaggcaggagaatcgcttgaacccaggaggtggaggttgcaagtgagctgagatcgcaccactgcactccagcctgggcaacacagtgagactctgtc

SEQ ID NO: 410393 - DNA, 1669 bp, Homo sapiens
gacccgtcccggtgggagggacctgggctgggggggacggtaggggaacaagggcgtgggactggggaagcttctgggaacatttgctctaggtattcagctaaactaagaaaaattggtccaaggctcggcacaaaaggatcttctcattccagtcctttcgcccacgcagggaacgatgcctctggaggtggtggtggagctgcagatccgggcgatttcttgcccaggagtgttcctgcctggcaaacaagatgtgtacctcggggtctacctcatgaatcagtacctggagaccaacagctttccctctgcgttccccattatgattcaggagagcatgagatttgaaaaggtatttgaaagtgcagtagatcctggagctgtagtagaccttttggaaatgtgggatgagttggcctactacgaagaaaacacacgagattttcttttcccagagcccaagctgacaccttcgcaccctaggaggtgtagggaggtgctcatgaagacggctctgggttttccaggcattgctcccaaaatagagttttctacaaggacagccatcagagaatgtgtgtttctgcatagaaacagatttcttgaagaaagacatgagtcacggaggcctttatctacatcacatgaaccaatatttcccttaaatactataaagatgaaactaaaggagaataatctcaacagactgcccaaaggcatgcaagcccgggcgccctctcaatattctaccaggcatttcttccaggaccagccagctcagttgaaccttggaaataatttcaaaatctctggaggaagcaagcctccatttgttgttagacacgtgagcctaaaattattttttagagcattttgcaatagtgaggatatggatgagggtggaagaaaggaaggttgagttataacaacaaatgaataatattcaataaaaaggtggacagtgcaaagccctttggtgagaatatttcagagcatcatttgaggaggtctggaagaaaatctaagttttcagactttccgtttccaacgagaagagcttcttctcttgacagccttgcagctaacgtaaaggttatcaaagagccagatgaacggattgttttaaggagtgactcatcatcatgtttagattcaagtcagtttggaaagtcttcatcccagtaaacaaggggatgctgatttccacgggaaagcttcatttgccacctaccagcattccacctctcctggccccttggatcagccccttctcagagaaaggttccatcctggttctcagtccacatggaagaatatccatgagagggtatgcagtcttctgacatcccacagagcacagctgcaccaaaacaaggaagattctacctctgaagtaaattatatcattgaaagaccaagctaccctctgaagaaatactcactgcatgaacagagatatttttaaggggaaattaatgaaagcttaaggagaatcatgaagagctcactcactgagacaattgaagcatccttaaagaaatgaacactttttgttgtctgtgttgagtcactgatgtctaatcccctttaaaccaaaccctgtactcagtcttttgtgcccaggtaagagttgttgattaaagtgtttgctgtttgggggctcaca

SEQ ID NO: 410394 - DNA, 1735 bp, Homo sapiens
gacccgtcccggtgggagggacctgggctgggggggacggtaggggaacaagggcgtgggactggggaagcttctgggaacatttgctctagggaacgatgcctctggaggtggtggtggagctgcagatccgggcgatttcttgcccaggagtgttcctgcctggcaaacaagatgtgtacctcggggtctacctcatgaatcagtacctggagaccaacagctttccctctgcgttccccattatgattcaggagagcatgagatttgaaaaggtatttgaaagtgcagtagatcctggagctgtagtagaccttttggaaagcttcctagccaggtttgaattaatacagctagttcctccagtgtgggatgagttggcctactacgaagaaaacacacgagattttcttttcccagagcccaagctgacaccttcgcaccctaggaggtgtagggaggtgctcatgaagacggctctgggttttccaggcattgctcccaaaatagagttttctacaaggacagccatcagagaatgtgtgtttctgcatagaaacagatttcttgttgattccaaatcttggctattgtgaatagtgctgcagtaaacatggggccacctttcttttgctgaggctgatgctcggattgtattcatggtccgtctttggaagaaagacatgagtcacggaggcctttatctacatcacatgaaccaatatttcccttaaatactataaagatgaaactaaaggagaataatctcaacagactgcccaaaggcatgcaagcccgggcgccctctcaatattctaccaggcatttcttccaggaccagccagctcagttgaaccttggaaataatttcaaaatctctggaggaagcaagcctccatttgttgttagacacgtgagcctaaaattattttttagagcattttgcaatagtgaggatatggatgagggtggaagaaaggaaggttgagttataacaacaaatgaataatattcaataaaaaggtggacagtgcaaagccctttggtgagaatatttcagagcatcatttgaggaggtctggaagaaaatctaagttttcagactttccgtttccaacgagaagagcttcttctcttgacagccttgcagctaacgtaaaggttatcaaagagccagatgaacggattgttttaaggagtgactcatcatcatgtttagattcaagtcagtttggaaagtcttcatcccagtaaacaaggggatgctgatttccacgggaaagcttcatttgccacctaccagcattccacctctcctggccccttggatcagccccttctcagagaaaggttccatcctggttctcagtccacatggaagaatatccatgagagggtatgcagtcttctgacatcccacagagcacagctgcaccaaaacaaggaagattctacctctgaagtaaattatatcattgaaagaccaagctaccctctgaagaaatactcactgcatgaacagagatatttttaaggggaaattaatgaaagcttaaggagaatcatgaagagctcactcactgagacaattgaagcatccttaaagaaatgaacactttttgttgtctgtgttgagtcactgatgtctaatcccctttaaaccaaaccctgtactcagtcttttgtgcccaggtaagagttgttgattaaagtgtttgctgtttgggggctcaca

SEQ ID NO: 410395 - DNA, 1503 bp, Homo sapiens
gaagactgcgcgtttgagtgtccctggcaacgccacgcttccgccttctggaagcctgcactccagcttcgagtggaacgatgcctctggaggtggtggtggagctgcagatccgggcgatttcttgcccaggagtgttcctgcctggcaaacaagatgtgtacctcggggtctacctcatgaatcagtacctggagaccaacagctttccctctgcgttccccattatgattcaggagagcatgagatttgaaaaggtatttgaaagtgcagtagatcctggagctgtagtagaccttttggaaagcttcctagccaggtttgaattaatacagctagttcctccagtgtgggatgagttggcctactacgaagaaaacacacgagattttcttttcccagagcccaagctgacaccttcgcaccctaggaggtgtagggaggtgctcatgaagacggctctgggttttccaggcattgctcccaaaatagagttttctacaaggacagccatcagagaatgtgtgtttctgcatagaaacagatttcttgaagaaagacatgagtcacggaggcctttatctacatcacatgaaccaatatttcccttaaatactataaagatgaaactaaaggagaataatctcaacagactgcccaaaggcatgcaagcccgggcgccctctcaatattctaccaggcatttcttccaggaccagccagctcagttgaaccttggaaataatttcaaaatctctggaggaagcaagcctccatttgttgttagacacgtggacagtgcaaagccctttggtgagaatatttcagagcatcatttgaggaggtctggaagaaaatctaagttttcagactttccgtttccaacgagaagagcttcttctcttgacagccttgcagctaacgtaaaggttatcaaagagccagatgaacggattgttttaaggagtgactcatcatcatgtttagattcaagtcagtttggaaagtcttcatcccagtaaacaaggggatgctgatttccacgggaaagcttcatttgccacctaccagcattccacctctcctggccccttggatcagccccttctcagagaaaggttccatcctggttctcagtccacatggaagaatatccatgagagggtatgcagtcttctgacatcccacagagcacagctgcaccaaaacaaggaagattctacctctgaagtaaattatatcattgaaagaccaagctaccctctgaagaaatactcactgcatgaacagagatatttttaaggggaaattaatgaaagcttaaggagaatcatgaagagctcactcactgagacaattgaagcatccttaaagaaatgaacactttttgttgtctgtgttgagtcactgatgtctaatcccctttaaaccaaaccctgtactcagtcttttgtgcccaggtaagagttgttgattaaagtgtttgctgtttgggggctcaca

SEQ ID NO: 410396 - DNA, 1675 bp, Homo sapiens
gaagactgcgcgtttgagtgtccctggcaacgccacgcttccgccttctggaagcctgcactccagcttcgagtggaacgatgcctctggaggtggtggtggagctgcagatccgggcgatttcttgcccaggagtgttcctgcctggcaaacaagatgtgtacctcggggtctacctcatgaatcagtacctggagaccaacagctttccctctgcgttccccattatgattcaggagagcatgagatttgaaaaggtatttgaaagtgcagtagatcctggagctgtagtagaccttttggaaatgtgggatgagttggcctactacgaagaaaacacacgagattttcttttcccagagcccaagctgacaccttcgcaccctaggaggtgtagggaggtgctcatgaagacggctctgggttttccaggcattgctcccaaaatagagttttctacaaggacagccatcagagaatgtgtgtttctgcatagaaacagatttcttgttgattccaaatcttggctattgtgaatagtgctgcagtaaacatggggccacctttcttttgctgaggctgatgctcggattgtattcatggtccgtctttggaagaaagacatgagtcacggaggcctttatctacatcacatgaaccaatatttcccttaaatactataaagatgaaactaaaggagaataatctcaacagactgcccaaaggcatgcaagcccgggcgccctctcaatattctaccaggcatttcttccaggaccagccagctcagttgaaccttggaaataatttcaaaatctctggaggaagcaagcctccatttgttgttagacacgtgagcctaaaattattttttagagcattttgcaatagtgaggatatggatgagggtggaagaaaggaaggttgagttataacaacaaatgaataatattcaataaaaaggtggacagtgcaaagccctttggtgagaatatttcagagcatcatttgaggaggtctggaagaaaatctaagttttcagactttccgtttccaacgagaagagcttcttctcttgacagccttgcagctaacgtaaaggttatcaaagagccagatgaacggattgttttaaggagtgactcatcatcatgtttagattcaagtcagtttggaaagtcttcatcccagtaaacaaggggatgctgatttccacgggaaagcttcatttgccacctaccagcattccacctctcctggccccttggatcagccccttctcagagaaaggttccatcctggttctcagtccacatggaagaatatccatgagagggtatgcagtcttctgacatcccacagagcacagctgcaccaaaacaaggaagattctacctctgaagtaaattatatcattgaaagaccaagctaccctctgaagaaatactcactgcatgaacagagatatttttaaggggaaattaatgaaagcttaaggagaatcatgaagagctcactcactgagacaattgaagcatccttaaagaaatgaacactttttgttgtctgtgttgagtcactgatgtctaatcccctttaaaccaaaccctgtactcagtcttttgtgcccaggtaagagttgttgattaaagtgtttgctgtttgggggctcaca

SEQ ID NO: 410397 - DNA, 636 bp, Homo sapiens
gacccgtcccggtgggagggacctgggctgggggggacggtaggggaacaagggcgtgggactggggaagcttctgggaacatttgctctaggtattcagctaaactaagaaaaattggtccaaggctcggcacaaaaggatcttctcattccagtcctttcgcccacgcagggaacgatgcctctggaggtggtggtggagctgcagatccgggcgatttcttgcccaggagtgttcctgcctggcaaacaagatgtgtacctcggggtctacctcatgaatcagtacctggagaccaacagctttccctctgcgttccccattatgattcaggagagcatgagatttgaaaaggtatttgaaagtgcagtagatcctggagctgtagtagaccttttggaaagcttcctagccaggtttgaattaatacagctagttcctccaggtaatgtggcagtaaatccgtttctaaattagcttaatatgattttaaaataaatttggcctgtcaaaatggggactgtacttaagagttgtgtttgaaaataacatacaactttatgtgtctgtaagtttatataacacatgccttttttctgccaatctattaaattttgtctattttcagaataata

SEQ ID NO: 410398 - DNA, 830 bp, Homo sapiens
tggaccagtattatatagctgaggtggatttgcaactgagcgcaattgcttactcaccaatacagctggtttctaacttttaaactatcataagcatttttgtagctatacatatagccatagttatttccttataatacattcctggaagtgaaattgctagacccctctatgtgtcaaattctctattatctatctattggaggtgtctgacactttctaacttccccctattataaataaatctcactgttaattagttgaatacattatactagcaagttataaatactactgatgttaaactgaacaggaaaaaaattagagaaatgtccttcttaagtttatgttttataaatctgaggtgtgttatctttgaccttaatttttaaaaattcaattaaatacagttatattctgattgaattttcttcttttctttctttattttaaaaaatattctttttttgtttatttcaggaagaaagacatgagtcacggaggcctttatctacatcacatgaaccaatatttcccttaaatactataaagatgaaactaaaggagaataatctcaacagactgcccaaaggcatgcaagcccgggcgccctctcaatattctaccaggcatttcttccaggaccagccagctcagttgaaccttggaaataatttcaaaatctctggaggaagcaagcctccatttgttgttagacacgtgagcctaaaattattttttagagcattttgcaatagtgaggatatggatgagggtggaagaaaggaaggttgagttataacaacaaatgaataatattcaataaaaag

SEQ ID NO: 410399 - DNA, 513 bp, Homo sapiens
ctccattatccattcccaggcctctccagtgtctctcctatgtctgagacatagtggcaagctgataaggctgtacagtggcaagggcaaaggagatcttaacccttagtccaatttaaggatgatgaattgaggttttttaccaacaaggcagaggatcagagatgtcttgcttcagctcctcccacggttcgtattgtgcactcaggcttggcctgtaacattgaagaggagcgctactccgaaagggtctacactatccgggaaggagaaacccttgagttgacttgtctagtcacaggacatccacgtccacagacatggaatagaaatttcagaatcaaaagttgggatctaaacaggagggtctaaacacatccaaaagaagccttgaagagctttatgagaggcagtttatggcaagagaagactcattgaggttcccattagtcccacaaagagtgtactaaatttacaccttctgaactccaaattatattttaaaatgcaaat

SEQ ID NO: 410400 - DNA, 689 bp, Homo sapiens
gcttgagcctgtaccagaatgataagtggaaattagtcctcaaagtaacctcagctgtttcattattgtgtgcctcgagcatctggttattcaagctcctcccacggttcgtattgtgcactcaggcttggcctgtaacattgaagaggagcgctactccgaaagggtctacactatccgggaaggagaaacccttgagttgacttgtctagtcacaggacatccacgtccacaggtggaccaaaacagcaggaagtgcctctgacagattccaagactcaagtgtcttcaatgagactttgaggattacaaatattcagcgacaccaaggaggccggtattactgtaaagcagagaatggcttggggtctccagcgataaagtcaatcagagtggatgtatactatttggatgatccagtagtaactgttcatcaaagtataggtgaagctaaagaacaattttactatgagagaacagtgttcctccggtgtgttgccaattccaatcctcctgttcggtatagctggagacgtggccaggaggtcttgctgcaaggatctgataaaggagttgagatttatgaaccattctttacccagggtgaaacaaagatcttaaaactaaagaatcttcgacctcaggactatgctaattatagctgcattgcttcagtgaggaatgtatgt

SEQ ID NO: 410401 - DNA, 427 bp, Homo sapiens
ccgaactctagtctctccttgaagtttcagtgtgggcatcccctcctcctcggcgagaccccctcctgggcccccatgacccctgcgcatcctggtggcactgcaccaatttatctgcagcaccactgtctgtccatgagagtaacagcaccagtactgcctcagcttcatttttccatttcatccttcaagacaccacaagctttattatcaaggagtcttgtggctcctacttgagtcttaccccataccaggaagagtttaagaacccagggtcttagtccaaatttggggcaggctgggtgcagtggcttatgcctataatcccaccactttgggagaccaaggtggaaagatcacttgagcctaggagttcaagactggcctgagccacacaatgagaccccatctctattttagaaggaaa

SEQ ID NO: 410402 - DNA, 575 bp, Homo sapiens
ctcctgccatgacctctgaccctgctggatctgagagaagaggaggtgaagggttgcattgcatgtctggtcctgtgcccccactgtgggctcactctgggaggatgaggacacagcagcaaggcaggacgggaggaagatagaggctggaggcagggttggacctgcaacccggaagtgcctggccaccttgtgcagcacagggctcagccctgcttccctctgtccttgcctctttgcctcctgcagccccatcctcataagaacaggtgcccccagcccactccggggccagatttctgtggtctgtctgcagagacgaggtcttgcagggcagcgccccgtgatggatccaccagggctctaaccccactgtcctgagcttcagtgaggcaggagctccctgaggacagggctggcaccaaactaaaagcagggagccctgggccacacactgtgagggctgcaggtgtgctccagggacacagcccccagacccagaggccaggcagtcccctccccatacatttatttctgtaaataatgtgcactgaataaattgtacagccggcaaa

SEQ ID NO: 410403 - DNA, 3451 bp, Homo sapiens
gcgaggatccggcgtgcagtgttccgagctgggctgggcgccgagagcatgggcagcgacccgagcgcgcccggacggccgggctggacgggcagcctcctcggcgaccgggaggaggcggcgcggccgcgactgctgccgctgctcctggtgcttctgggctgcctgggccttggcgtagcggccgaagacgcggaggtccatgccgagaactggctgcggctttatggctacctgcctcagcccagccgccatatgtccaccatgcgttccgcccagatcttggcctcggcccttgcagagatgcagcgcttctacgggatcccagtcaccggtgtgctcgacgaagagaccaaggagtggatgaagcggccccgctgtggggtgccagaccagttcggggtacgagtgaaagccaacctgcggcggcgtcggaagcgctacgccctcaccgggaggaagtggaacaaccaccatctgacctttagcatccagaactacacggagaagttgggctggtaccactcgatggaggcggtgcgcagggccttccgcgtgtgggagcaggccacgcccctggtcttccaggaggtgccctatgaggacatccggctgcggcgacagaaggaggccgacatcatggtactctttgcctctggcttccacggcgacagctcgccgtttgatggcaccggtggctttctggcccacgcctatttccctggccccggcctaggcggggacacccattttgacgcagatgagccctggaccttctccagcactgacctgcatggaaacaacctcttcctggtggcagtgcatgagctgggccacgcgctggggctggagcactccagcaaccccaatgccatcatggcgccgttctaccagtggaaggacgttgacaacttcaagctgcccgaggacgatctccgtggcatccagcagctctacggtaccccagacggtcagccacagcctacccagcctctccccactgtgacgccacggcggccaggccggcctgaccaccggccgccccggcctccccagccaccacccccaggtgggaagccagagcggcccccaaagccgggccccccagtccagccccgagccacagagcggcccgaccagtatggccccaacatctgcgacggggactttgacacagtggccatgcttcgcggggagatgttcgtgttcaagggccgctggttctggcgagtccggcacaaccgcgtcctggacaactatcccatgcccatcgggcacttctggcgtggtctgcccggtgacatcagtgctgcctacgagcgccaagacggtcgttttgtctttttcaaaggtgaccgctactggctctttcgagaagcgaacctggagcccggctacccacagccgctgaccagctatggcctgggcatcccctatgaccgcattgacacggccatctggtgggagcccacaggccacaccttcttcttccaagaggacaggtactggcgcttcaacgaggagacacagcgtggagaccctgggtaccccaagcccatcagtgtctggcaggggatccctgcctcccctaaaggggccttcctgagcaatgacgcagcctacacctacttctacaagggcaccaaatactggaaattcgacaatgagcgcctgcggatggagcccggctaccccaagtccatcctgcgggacttcatgggctgccaggagcacgtggagccaggcccccgatggcccgacgtggcccggccgcccttcaacccccacgggggtgcagagcccggggcggacagcgcagagggcgacgtgggggatggggatggggactttggggccggggtcaacaaggacgggggcagccgcgtggtggtgcagatggaggaggtggcacggacggtgaacgtggtgatggtgctggtgccactgctgctgctgctctgcgtcctgggcctcacctacgcgctggtgcagatgcagcgcaagggtgcgccacgtgtcctgctttactgcaagcgctcgctgcaggagtgggtctgaccacccagcgctcctgctaacggtgctcagggggcgcctgtggttctgagatggctcccaggggctccctccgcccccaggtaggggcccctctcagccctcacacaccctgtctgccccgccctcattatttatgtccaggtgtttgttttgttttgtttttggcaccttacttgaccatttgtttctgtttccccgactggggcagggtgtttagaattttctaaatgtagttctgctccagacagggaattaggcccccatcatcctctggcttggccacagccaggggagcagaggggcagaggcccacattggaagagcagcacctcctcagcctgaaccccagggctgtaactgccaggctctctttgcccagttggagactgtctggcccccctggtcccctccttcccaagtgagtctctctgggccttaggaagagccttccacccaggggcagccccaggccaaaggggacctggaagggaggtgggccgtggcccttgagtccccattgaggcttggttccttcccaatccagtggacttcgcagtccacttctgacagcctcagtgaccctggctccttgtgccagagaacccagcccacccccggcagcagcccccagctcccacctccccttgggcccacaccttggcccctctccccagggaagcagcagcctcgcccctggcagagatgcctccctgagctagaaccctctgttccttccctgtgcctcctccctccctctccgactcacaccactagcctcaggggtctgagctccagctcctttgggcttcagctgccagtgtcctgagccccagggagagggggctggtgggtgcctaggcctgggcagtggatggccgtgaatgggtgcccacagtgtcaggcactgggcatgaggggttcctcccctccagctccctgtgcccccagggtcctgggaggagagacactggtggggataggccagccgcgcatcagactgtgaaccccacgaaggagcccattgtggcctaagaggctgccctcctgtgctcagccctgaggacagatgcctccttcctcttttccttcccaaagcaagcaagaggccgtggctgctgtgggaaatggtactgtacagctggctctacttccccatggccctgagcgagtggagtctgccacccaggatccccaaggcacttgagggggaaggattctgctggcctctgcgagtggtttcttgtgcactggcaccaagtgcgggtccggcagcttctgccccctgcagaaccggagagccagctaaggggtggggctgcgggggttccgtgtccacccccatacatttatttctgtaaataatgtgcactgaataaattgtacagccggcaaa

SEQ ID NO: 410404 - DNA, 2318 bp, Homo sapiens
  misc_feature (1)..(1): n is a, c, g, or t
ngtctttgttttggctcgacatggtgggtggttaagtccggcacaaccgcgtcctggacaactatcccatgcccatcgggcacttctggcgtggtctgcccggtgacatcagtgctgcctacgagcgccaagacggtcgttttgtctttttcaaaggtgaccgctactggctctttcgagaagcgaacctggagcccggctacccacagccgctgaccagctatggcctgggcatcccctatgaccgcattgacacggccatctggtgggagcccacaggccacaccttcttcttccaagaggacaggtactggcgcttcaacgaggagacacagcgtggagaccctgggtaccccaagcccatcagtgtctggcaggggatccctgcctcccctaaaggggccttcctgagcaatgacgcagcctacacctacttctacaagggcaccaaatactggaaattcgacaatgagcgcctgcggatggagcccggctaccccaagtccatcctgcgggacttcatgggctgccaggagcacgtggagccaggcccccgatggcccgacgtggcccggccgcccttcaacccccacgggggtgcagagcccggggcggacagcgcagagggcgacgtgggggatggggatggggactttggggccggggtcaacaaggacgggggcagccgcgtggtggtgcagatggaggaggtggcacggacggtgaacgtggtgatggtgctggtgccactgctgctgctgctctgcgtcctgggcctcacctacgcgctggtgcagatgcagcgcaagggtgcgccacgtgtcctgctttactgcaagcgctcgctgcaggagtgggtctgaccacccagcgctcctgctaacggtgctcagggggcgcctgtggttctgagatggctcccaggggctccctccgcccccaggtaggggcccctctcagccctcacacaccctgtctgccccgccctcattatttatgtccaggtgtttgttttgttttgtttttggcaccttacttgaccatttgtttctgtttccccgactggggcagggtgtttagaattttctaaatgtagttctgctccagacagggaattaggcccccatcatcctctggcttggccacagccaggggagcagaggggcagaggcccacattggaagagcagcacctcctcagcctgaaccccagggctgtaactgccaggctctctttgcccagttggagactgtctggcccccctggtcccctccttcccaagtgagtctctctgggccttaggaagagccttccacccaggggcagccccaggccaaaggggacctggaagggaggtgggccgtggcccttgagtccccattgaggcttggttccttcccaatccagtggacttcgcagtccacttctgacagcctcagtgaccctggctccttgtgccagagaacccagcccacccccggcagcagcccccagctcccacctccccttgggcccacaccttcttccctctctggagaaagggccctgggcctgcctcaccacggaccaaagggagtctgccagggcccctctccccagggaagcagcagcctcgcccctggcagagatgcctccctgagctagaaccctctgttccttccctgtgcctcctccctccctctccgactcacaccactagcctcaggggtctgagctccagctcctttgggcttcagctgccagtgtcctgagccccagggagagggggctggtgggtgcctaggcctgggcagtggatggccgtgaatgggtgcccacagtgtcaggcactgggcatgaggggttcctcccctccagctccctgtgcccccagggtcctgggaggagagacactggtggggataggccagccgcgcatcagactgtgaaccccacgaaggagcccattgtggcctaagaggctgccctcctgtgctcagccctgaggacagatgcctccttcctcttttccttcccaaagcaagcaagaggccgtggctgctgtgggaaatggtactgtacagctggctctacttccccatggccctgagcgagtggagtctgccacccaggatccccaaggcacttgagggggaaggattctgctggcctctgcgagtggtttcttgtgcactggcaccaagtgcgggtccggcagcttctgccccctgcagaaccggagagccagctaaggggtggggctgcgggggttccgtgtccacccccatacatttatttctgtaaataatgtgcactgaataaattgtacagccggcaaa

SEQ ID NO: 410405 - DNA, 1617 bp, Homo sapiens
ctcattgtgcggctcttggtggggctcgtggtgatggtgctggtgccactgctgctgctgctctgcgtcctgggcctcacctacgcgctggtgcagatgcagcgcaagggtgcgccacgtgtcctgctttactgcaagcgctcgctgcaggagtgggtctgaccacccagcgctcctgctaacggtgctcagggggcgcctgtggttctgagatggctcccaggggctccctccgcccccaggtaggggcccctctcagccctcacacaccctgtctgccccgccctcattatttatgtccaggtgtttgttttgttttgtttttggcaccttacttgaccatttgtttctgtttccccgactggggcagggtgtttagaattttctaaatgtagttctgctccagacagggaattaggcccccatcatcctctggcttggccacagccaggggagcagaggggcagaggcccacattggaagagcagcacctcctcagcctgaaccccagggctgtaactgccaggctctctttgcccagttggagactgtctggcccccctggtcccctccttcccaagtgagtctctctgggccttaggaagagccttccacccaggggcagccccaggccaaaggggacctggaagggaggtgggccgtggcccttgagtccccattgaggcttggttccttcccaatccagtggacttcgcagtccacttctgacagcctcagtgaccctggctccttgtgccagagaacccagcccacccccggcagcagcccccagctcccacctccccttgggcccacaccttcttccctctctggagaaagggccctgggcctgcctcaccacggaccaaagggagtctgccagggcccctctccccagggaagcagcagcctcgcccctggcagagatgcctccctgagctagaaccctctgttccttccctgtgcctcctccctccctctccgactcacaccactagcctcaggggtctgagctccagctcctttgggcttcagctgccagtgtcctgagccccagggagagggggctggtgggtgcctaggcctgggcagtggatggccgtgaatgggtgcccacagtgtcaggcactgggcatgaggggttcctcccctccagctccctgtgcccccagggtcctgggaggagagacactggtggggataggccagccgcgcatcagactgtgaaccccacgaaggagcccattgtggcctaagaggctgccctcctgtgctcagccctgaggacagatgcctccttcctcttttccttcccaaagcaagcaagaggccgtggctgctgtgggaaatggtactgtacagctggctctacttccccatggccctgagcgagtggagtctgccacccaggatccccaaggcacttgagggggaaggattctgctggcctctgcgagtggtttcttgtgcactggcaccaagtgcgggtccggcagcttctgccccctgcagaaccggagagccagctaaggggtggggctgcgggggttccgtgtccacccccatacatttatttctgtaaataatgtgcactgaataaattgtacagccggcaaa

SEQ ID NO: 410406 - DNA, 3007 bp, Homo sapiens
gcgaggatccggcgtgcagtgttccgagctgggctgggcgccgagagcatgggcagcgacccgagcgcgcccggacggccgggctggacgggcagcctcctcggcgaccgggaggaggcggcgcggccgcgactgctgccgctgctcctggtgcttctgggctgcctgggccttggcgtagcggccgaagacgcggaggtccatgccgagaactggctgcggctttatggctacctgcctcagcccagccgccatatgtccaccatgcgttccgcccagatcttggcctcggcccttgcagagatgcagcgcttctacgggatcccagtcaccggtgtgctcgacgaagagaccaaggagtggatgaagcggccccgctgtggggtgccagaccagttcggggtacgagtgaaagccaacctgcggcggcgtcggaagcgctacgccctcaccgggaggaagtggaacaaccaccatctgacctttagcatccagaactacacggagaagttgggctggtaccactcgatggaggcggtgcgcagggccttccgcgtgtgggagcaggccacgcccctggtcttccaggaggtgccctatgaggacatccggctgcggcgacagaaggaggccgacatcatggtactctttgcctctggcttccacggcgacagctcgccgtttgatggcaccggtggctttctggcccacgcctatttccctggccccggcctaggcggggacacccattttgacgcagatgagccctggaccttctccagcactgacctgcatggaaacaacctcttcctggtggcagtgcatgagctgggccacgcgctggggctggagcactccagcaaccccaatgccatcatggcgccgttctaccagtggaaggacgttgacaacttcaagctgcccgaggacgatctccgtggcatccagcagctctacggtaccccagacggtcagccacagcctacccagcctctccccactgtgacgccacggcggccaggccggcctgaccaccggccgccccggcctccccagccaccacccccaggtgggaagccagagcggcccccaaagccgggccccccagtccagccccgagccacagagcggcccgaccagtatggccccaacatctgcgacggggactttgacacagtggccatgcttcgcggggagatgttcgtgttcaagggccgctggttctggcgagtccggcacaaccgcgtcctggacaactatcccatgcccatcgggcacttctggcgtggtctgcccggtgacatcagtgctgcctacgagcgccaagacggtcgttttgtctttttcaaaggtgaccgctactggctctttcgagaagcgaacctggagcccggctacccacagccgctgaccagctatggcctgggcatcccctatgaccgcattgacacggccatctggtgggagcccacaggccacaccttcttcttccaagaggacaggtactggcgcttcaacgaggagacacagcgtggagaccctgggtaccccaagcccatcagtgtctggcaggggatccctgcctcccctaaaggggccttcctgagcaatgacgcagcctacacctacttctacaagggcaccaaatactggaaattcgacaatgagcgcctgcggatggagcccggctaccccaagtccatcctgcgggacttcatgggctgccaggagcacgtggagccaggcccccgatggcccgacgtggcccggccgcccttcaacccccacgggggtgcagagcccggggcggacagcgcagagggcgacgtgggggatggggatggggactttggggccggggtcaacaaggacgggggcagccgcgtggtggtgcagatggaggaggtggcacggacggtgaacgtggtgatggtgctggtgccactgctgctgctgctctgcgtcctgggcctcacctacgcgctggtgcagatgcagcgcaagggtgcgccacgtgtcctgctttactgcaagcgctcgctgcaggagtgggtctgaccacccagcgctcctgctaacggtgctcagggggcgcctgtggttctgagatggctcccaggggctccctccgcccccaggtaggggcccctctcagccctcacacaccctgtctgccccgccctcattatttatgtccaggtgtttgttttgttttgtttttggcaccttacttgaccatttgtttctgtttccccgactggggcagggtgtttagaattttctaaatgtagttctgctccagacagggaattaggcccccatcatcctctggcttggccacagccaggggagcagaggggcagaggcccacattggaagagcagcacctcctcagcctgaaccccagggctgtaactgccaggctctctttgcccagttggagactgtctggcccccctggtcccctccttcccaagtgagtctctctgggccttaggaagagccttccacccaggggcagccccaggccaaaggggacctggaagggaggtgggccgtggcccttgagtccccattgaggcttggttccttcccaatccagtggacttcgcagtccacttctgacagcctcagtgaccctggctccttgtgccagagaacccagcccacccccggacagatgcctccttcctcttttccttcccaaagcaagcaagaggccgtggctgctgtgggaaatggtactgtacagctggctctacttccccatggccctgagcgagtggagtctgccacccaggatccccaaggcacttgagggggaaggattctgctggcctctgcgagtggtttcttgtgcactggcaccaagtgcgggtccggcagcttctgccccctgcagaaccggagagccagctaaggggtggggctgcgggggttccgtgtccacccccatacatttatttctgtaaataatgtgcactgaataaattgtacagccggcaaa

SEQ ID NO: 410407 - DNA, 1293 bp, Homo sapiens
cccccaggatcctgggaggagagacactgttggggataggccacaccgcgcatcagactgtgacacatcgaaggactccatacagcctaagagcccccctcctgtgctcagtcctgagcgacagaggcctcctgccgcgcatgccgtccccaagcaaacaagagcccgtggctactgtggaaaatggtactgtaactgccaggctctctttgcccagttggagactgtctggcccccctggtcccctccttcccaagtgagtctctctgggccttaggaagagccttccacccaggggcagccccaggccaaaggggacctggaagggaggtgggccgtggcccttgagtccccattgaggcttggttccttcccaatccagtggacttcgcagtccacttctgacagcctcagtgaccctggctccttgtgccagagaacccagcccacccccggcagcagcccccagctcccacctccccttgggcccacaccttcttccctctctggagaaagggccctgggcctgcctcaccacggaccaaagggagtctgccagggcccctctccccagggaagcagcagcctcgcccctggcagagatgcctccctgagctagaaccctctgttccttccctgtgcctcctccctccctctccgactcacaccactagcctcaggggtctgagctccagctcctttgggcttcagctgccagtgtcctgagccccagggagagggggctggtgggtgcctaggcctgggcagtggatggccgtgaatgggtgcccacagtgtcaggcactgggcatgaggggttcctcccctccagctccctgtgcccccagggtcctgggaggagagacactggtggggataggccagccgcgcatcagactgtgaaccccacgaaggagcccattgtggcctaagaggctgccctcctgtgctcagccctgaggacagatgcctccttcctcttttccttcccaaagcaagcaagaggccgtggctgctgtgggaaatggtactgtacagctggctctacttccccatggccctgagcgagtggagtctgccacccaggatccccaaggcacttgagggggaaggattctgctggcctctgcgagtggtttcttgtgcactggcaccaagtgcgggtccggcagcttctgccccctgcagaaccggagagccagctaaggggtggggctgcgggggttccgtgtccacccccatacatttatttctgtaaataatgtgcactgaataaattgtacagccggcaaa

SEQ ID NO: 410408 - DNA, 497 bp, Homo sapiens
caggcggatccagtaaggagccacgtgccctccggttatgaatgtacccaggcgagcttagaagcaatgcagcggtgggactggtaccgacgtcgattacattgtcatggccataactgatcccattgtggcctaagaggctgccctcctgtgctcagccctgaggacagatgcctccttcctcttttccttcccaaagcaagcaagaggccgtggctgctgtgggaaatggtactgtacagctggctctacttccccatggccctgagcgagtggagtctgccacccaggatccccaaggcacttgagggggaaggattctgctggcctctgcgagtggtttcttgtgcactggcaccaagtgcgggtccggcagcttctgccccctgcagaaccggagagccagctaaggggtggggctgcgggggttccgtgtccacccccatacatttatttctgtaaataatgtgcactgaataaattgtacagccggcaaa

SEQ ID NO: 410409 - DNA, 254 bp, Homo sapiens
agctaatgtcagtctggtcaggaagcccagggttctagtcgtacccttagcccaaagccctctgagcctcagtctggctcctgcaagttgagaaggggcagatttgaaaatactcagggaagcaaatgagaagaagggtgttttgaagccctcagcatgtcctggcctttgatggttctcactggtggttcggctcaacctgaagccactctggcctccttgcccctgcagcctacacctacttctacaagggc

SEQ ID NO: 410410 - DNA, 329 bp, Homo sapiens
gaaacaacctcttcctggtggcagtgcatgagctgggccacgcgctggggctggagcactccagcaaccccaatgccatcatggcgccgttctaccagtggaaggacgttgacaacttcaagctgcccgaggacgatctccgtggcatccagcagctctacggtgcgtgggctgtgaccagcgggctctgcatgccgctctcaagtccctggccaatgaggagtaggcattgctgccatccccattttgtagatgaggaacccaaggctcagtgaggattagtgacttgcccacatcatttggggaataaatggtggtactggaaatga

SEQ ID NO: 410411 - DNA, 3513 bp, Homo sapiens
gcgaggatccggcgtgcagtgttccgagctgggctgggcgccgagagcatgggcagcgacccgagcgcgcccggacggccgggctggacgggcagcctcctcggcgaccgggaggaggcggcgcggccgcgactgctgccgctgctcctggtgcttctgggctgcctgggccttggcgtagcggccgaagacgcggaggtccatgccgagaactggctgcggctttatggctacctgcctcagcccagccgccatatgtccaccatgcgttccgcccagatcttggcctcggcccttgcagagatgcagcgcttctacgggatcccagtcaccggtgtgctcgacgaagagaccaaggagtggatgaagcggccccgctgtggggtgccagaccagttcggggtacgagtgaaagccaacctgcggcggcgtcggaagcgctacgccctcaccgggaggaagtggaacaaccaccatctgacctttagcatccagaactacacggagaagttgggctggtaccactcgatggaggcggtgcgcagggccttccgcgtgtgggagcaggccacgcccctggtcttccaggaggtgccctatgaggacatccggctgcggcgacagaaggaggccgacatcatggtactctttgcctctggcttccacggcgacagctcgccgtttgatggcaccggtggctttctggcccacgcctatttccctggccccggcctaggcggggacacccattttgacgcagatgagccctggaccttctccagcactgacctgcatggaaacaacctcttcctggtggcagtgcatgagctgggccacgcgctggggctggagcactccagcaaccccaatgccatcatggcgccgttctaccagtggaaggacgttgacaacttcaagctgcccgaggacgatctccgtggcatccagcagctctacggtaccccagacggtcagccacagcctacccagcctctccccactgtgacgccacggcggccaggccggcctgaccaccggccgccccggcctccccagccaccacccccaggtgggaagccagagcggcccccaaagccgggccccccagtccagccccgagccacagagcggcccgaccagtatggccccaacatctgcgacggggactttgacacagtggccatgcttcgcggggagatgttcgtgttcaagggccgctggttctggcgagtccggcacaaccgcgtcctggacaactatcccatgcccatcgggcacttctggcgtggtctgcccggtgacatcagtgctgcctacgagcgccaagacggtcgttttgtctttttcaaaggtgaccgctactggctctttcgagaagcgaacctggagcccggctacccacagccgctgaccagctatggcctgggcatcccctatgaccgcattgacacggccatctggtgggagcccacaggccacaccttcttcttccaagaggacaggtactggcgcttcaacgaggagacacagcgtggagaccctgggtaccccaagcccatcagtgtctggcaggggatccctgcctcccctaaaggggccttcctgagcaatgacgcagcctacacctacttctacaagggcaccaaatactggaaattcgacaatgagcgcctgcggatggagcccggctaccccaagtccatcctgcgggacttcatgggctgccaggagcacgtggagccaggcccccgatggcccgacgtggcccggccgcccttcaacccccacgggggtgcagagcccggggcggacagcgcagagggcgacgtgggggatggggatggggactttggggccggggtcaacaaggacgggggcagccgcgtggtggtgcagatggaggaggtggcacggacggtgaacgtggtgatggtgctggtgccactgctgctgctgctctgcgtcctgggcctcacctacgcgctggtgcagatgcagcgcaagggtgcgccacgtgtcctgctttactgcaagcgctcgctgcaggagtgggtctgaccacccagcgctcctgctaacggtgctcagggggcgcctgtggttctgagatggctcccaggggctccctccgcccccaggtaggggcccctctcagccctcacacaccctgtctgccccgccctcattatttatgtccaggtgtttgttttgttttgtttttggcaccttacttgaccatttgtttctgtttccccgactggggcagggtgtttagaattttctaaatgtagttctgctccagacagggaattaggcccccatcatcctctggcttggccacagccaggggagcagaggggcagaggcccacattggaagagcagcacctcctcagcctgaaccccagggctgtaactgccaggctctctttgcccagttggagactgtctggcccccctggtcccctccttcccaagtgagtctctctgggccttaggaagagccttccacccaggggcagccccaggccaaaggggacctggaagggaggtgggccgtggcccttgagtccccattgaggcttggttccttcccaatccagtggacttcgcagtccacttctgacagcctcagtgaccctggctccttgtgccagagaacccagcccacccccggcagcagcccccagctcccacctccccttgggcccacaccttcttccctctctggagaaagggccctgggcctgcctcaccacggaccaaagggagtctgccagggcccctctccccagggaagcagcagcctcgcccctggcagagatgcctccctgagctagaaccctctgttccttccctgtgcctcctccctccctctccgactcacaccactagcctcaggggtctgagctccagctcctttgggcttcagctgccagtgtcctgagccccagggagagggggctggtgggtgcctaggcctgggcagtggatggccgtgaatgggtgcccacagtgtcaggcactgggcatgaggggttcctcccctccagctccctgtgcccccagggtcctgggaggagagacactggtggggataggccagccgcgcatcagactgtgaaccccacgaaggagcccattgtggcctaagaggctgccctcctgtgctcagccctgaggacagatgcctccttcctcttttccttcccaaagcaagcaagaggccgtggctgctgtgggaaatggtactgtacagctggctctacttccccatggccctgagcgagtggagtctgccacccaggatccccaaggcacttgagggggaaggattctgctggcctctgcgagtggtttcttgtgcactggcaccaagtgcgggtccggcagcttctgccccctgcagaaccggagagccagctaaggggtggggctgcgggggttccgtgtccacccccatacatttatttctgtaaataatgtgcactgaataaattgtacagccggcaaa

SEQ ID NO: 410412 - DNA, 3045 bp, Homo sapiens
gcgaggatccggcgtgcagtgttccgagctgggctgggcgccgagagcatgggcagcgacccgagcgcgcccggacggccgggctggacgggcagcctcctcggcgaccgggaggaggcggcgcggccgcgactgctgccgctgctcctggtgcttctgggctgcctgggccttggcgtagcggccgaagacgcggaggtccatgccgagaactggctgcggctttatggctacctgcctcagcccagccgccatatgtccaccatgcgttccgcccagatcttggcctcggcccttgcagagatgcagcgcttctacgggatcccagtcaccggtgtgctcgacgaagagaccaaggagtggatgaagcggccccgctgtggggtgccagaccagttcggggtacgagtgaaagccaacctgcggcggcgtcggaagcgctacgccctcaccgggaggaagtggaacaaccaccatctgacctttagcatccagaactacacggagaagttgggctggtaccactcgatggaggcggtgcgcagggccttccgcgtgtgggagcaggccacgcccctggtcttccaggaggtgccctatgaggacatccggctgcggcgacagaaggaggccgacatcatggtactctttgcctctggcttccacggcgacagctcgccgtttgatggcaccggtggctttctggcccacgcctatttccctggccccggcctaggcggggacacccattttgacgcagatgagccctggaccttctccagcactgacctgcatggaaacaacctcttcctggtggcagtgcatgagctgggccacgcgctggggctggagcactccagcaaccccaatgccatcatggcgccgttctaccagtggaaggacgttgacaacttcaagctgcccgaggacgatctccgtggcatccagcagctctacggtaccccagacggtcagccacagcctacccagcctctccccactgtgacgccacggcggccaggccggcctgaccaccggccgccccggcctccccagccaccacccccaggtgggaagccagagcggcccccaaagccgggccccccagtccagccccgagccacagagcggcccgaccagtatggccccaacatctgcgacggggactttgacacagtggccatgcttcgcggggagatgttcgtgttcaagggccgctggttctggcgagtccggcacaaccgcgtcctggacaactatcccatgcccatcgggcacttctggcgtggtctgcccggtgacatcagtgctgcctacgagcgccaagacggtcgttttgtctttttcaaaggtgaccgctactggctctttcgagaagcgaacctggagcccggctacccacagccgctgaccagctatggcctgggcatcccctatgaccgcattgacacggccatctggtgggagcccacaggccacaccttcttcttccaagaggacaggtactggcgcttcaacgaggagacacagcgtggagaccctgggtaccccaagcccatcagtgtctggcaggggatccctgcctcccctaaaggggccttcctgagcaatgacgcagcctacacctacttctacaagggcaccaaatactggaaattcgacaatgagcgcctgcggatggagcccggctaccccaagtccatcctgcgggacttcatgggctgccaggagcacgtggagccaggcccccgatggcccgacgtggcccggccgcccttcaacccccacgggggtgcagagcccggggcggacagcgcagagggcgacgtgggggatggggatggggactttggggccggggtcaacaaggacgggggcagccgcgtggtggtgcagatggaggaggtggcacggacggtgaacgtggtgatggtgctggtgccactgctgctgctgctctgcgtcctgggcctcacctacgcgctggtgcagatgcagcgcaagggtgcgccacgtgtcctgctttactgcaagcgctcgctgcaggagtgggtctgaccacccagcgctcctgctaacggtgctcagggggcgcctgtggttctgagatggctcccaggggctccctccgcccccaggtaggggcccctctcagccctcacacaccctgtctgccccgccctcattatttatgtccaggtgtttgttttgttttgtttttggcaccttacttgaccatttgtttctgtttccccgactggggcagggtgtttagaattttctaaatgtagttctgctccagacagggaattaggcccccatcatcctctggcttggccacagccaggggagcagaggggcagaggcccacattggaagagcagcacctcctcagcctgaaccccagggctgtaactgccaggctctctttgcccagttggagactgtctggcccccctggtcccctccttcccaagtgagtctctctgggccttaggaagagccttccacccaggggcatggatggccgtgaatgggtgcccacagtgtcaggcactgggcatgaggggttcctcccctccagctccctgtgcccccagggtcctgggaggagagacactggtggggataggccagccgcgcatcagactgtgaaccccacgaaggagcccattgtggcctaagaggctgccctcctgtgctcagccctgaggacagatgcctccttcctcttttccttcccaaagcaagcaagaggccgtggctgctgtgggaaatggtactgtacagctggctctacttccccatggccctgagcgagtggagtctgccacccaggatccccaaggcacttgagggggaaggattctgctggcctctgcgagtggtttcttgtgcactggcaccaagtgcgggtccggcagcttctgccccctgcagaaccggagagccagctaaggggtggggctgcgggggttccgtgtccacccccatacatttatttctgtaaataatgtgcactgaataaattgtacagccggcaaa

SEQ ID NO: 410413 - DNA, 1882 bp, Homo sapiens
aatcgagtcggccccttttgtggtctcctccaatgagcgcctgcggatggagcccggctaccccaagtccatcctgcgggacttcatgggctgccaggagcacgtggagccaggcccccgatggcccgacgtggcccggccgcccttcaacccccacgggggtgcagagcccggggcggacagcgcagagggcgacgtgggggatggggatggggactttggggccggggtcaacaaggacgggggcagccgcgtggtggtgcagatggaggaggtggcacggacggtgaacgtggtgatggtgctggtgccactgctgctgctgctctgcgtcctgggcctcacctacgcgctggtgcagatgcagcgcaagggtgcgccacgtgtcctgctttactgcaagcgctcgctgcaggagtgggtctgaccacccagcgctcctgctaacggtgctcagggggcgcctgtggttctgagatggctcccaggggctccctccgcccccaggtaggggcccctctcagccctcacacaccctgtctgccccgccctcattatttatgtccaggtgtttgttttgttttgtttttggcaccttacttgaccatttgtttctgtttccccgactggggcagggtgtttagaattttctaaatgtagttctgctccagacagggaattaggcccccatcatcctctggcttggccacagccaggggagcagaggggcagaggcccacattggaagagcagcacctcctcagcctgaaccccagggctgtaactgccaggctctctttgcccagttggagactgtctggcccccctggtcccctccttcccaagtgagtctctctgggccttaggaagagccttccacccaggggcagccccaggccaaaggggacctggaagggaggtgggccgtggcccttgagtccccattgaggcttggttccttcccaatccagtggacttcgcagtccacttctgacagcctcagtgaccctggctccttgtgccagagaacccagcccacccccggcagcagcccccagctcccacctccccttgggcccacaccttcttccctctctggagaaagggccctgggcctgcctcaccacggaccaaagggagtctgccagggcccctctccccagggaagcagcagcctcgcccctggcagagatgcctccctgagctagaaccctctgttccttccctgtgcctcctccctccctctccgactcacaccactagcctcaggggtctgagctccagctcctttgggcttcagctgccagtgtcctgagccccagggagagggggctggtgggtgcctaggcctgggcagtggatggccgtgaatgggtgcccacagtgtcaggcactgggcatgaggggttcctcccctccagctccctgtgcccccagggtcctgggaggagagacactggtggggataggccagccgcgcatcagactgtgaaccccacgaaggagcccattgtggcctaagaggctgccctcctgtgctcagccctgaggacagatgcctccttcctcttttccttcccaaagcaagcaagaggccgtggctgctgtgggaaatggtactgtacagctggctctacttccccatggccctgagcgagtggagtctgccacccaggatccccaaggcacttgagggggaaggattctgctggcctctgcgagtggtttcttgtgcactggcaccaagtgcgggtccggcagcttctgccccctgcagaaccggagagccagctaaggggtggggctgcgggggttccgtgtccacccccatacatttatttctgtaaataatgtgcactgaataaattgtacagccggcaaa

SEQ ID NO: 410414 - DNA, 475 bp, Homo sapiens
cttctgggctgcctgggccttggcgtagcggccgaagacgcggaggtccatgccgaggtaagacccccgccctgccctttggctgcgggctgggggcttggagggagaggcgccacgtccgcaggctgggacttggaggtggagggagcggagacgcgccccctgttctgggccgtggcggggaagcaagcggacttggcagtctgcccctccccagctcgccctctgcagcgcacctcttcgcaaacccttgagggcgcagggcctcgctctcctccccgctactcctacagccctgttctgggcactgagcccccaccccgacccccttacattcagcctgtgtcccgggagccgcttccgccgcccccagcccttgcctcccctccttccttccctccagggcagccgattcctcgagagcccggctggcgcgcagtggcgctctttgcgagtggggagggggctgctctcg

SEQ ID NO: 410415 - DNA, 1725 bp, Homo sapiens
gagcggactcttcgtttcagccctggcgcggtcctgtggtgaactccttgtctctatggcgactggacgcggtcggatcttgcagcagcactggctcggcctccagacgctgcgcgggcccagcaggggcggtggcgcggcccgggggcgcgccaggcctttgggtgcagaaaggggccaggggtcaagctttctgcaggctctgctgccctgaggtgccatgccggaggtggacagcactgggagagctctttctcctgctgttctgggttcctggatggaatgccttcagaaatcttgctgaagatattttcctacttggatgctgtgagccttctgtgtactggatgtgtgagcaggcgcttttatcatctagccaatgacaattttatttggatcggaatctactcaactgctttttcacctgcaagatcaaattggaaatttaattcagtagagaagatagctatgtctatgagctttctgtcagttcaggataaagaagctggttattggaagaaagaatatatcacaaaacaaatagcatctgtaaaagccgcactagctgacattctcaaacctgtcaacccttacacaggccttccagttaagaccaaagaggccctcagaatatttggtttaggttgggcaattatactgaaagaaaaaggtggaaaagaatatatcatggagcatgttgatctttccataaatgacacatcagttactgttatatggtatggcaaaaaatggccatgcctagcatcattgtcaaccttagatttatgtggcatgacaccagtttttaccgactggtataaaactcccaccaaacatagactccgatggcattctttaattgcaaagtacaatctgagtcattgaccatatctaccatgattggctgtgacagactcattcggatcttctgcctgcaccctggcctcctggtgggagtgtggaagaaggaggaagaactggcttttgttatggcaaatcttcattttcatcaccttgtggagaggagcacattaggctcggctactatcccctatgaactgcctccacatagcccctttttggatgatagccccgagtatggactgcacggctaccaactccatgttgatctgcacagcggtggggttttctacctatgtggtacatttcgcaatctcttcaccaagagaggaaatattgaaaatggacatgtgaagctcattgttatacatttaaaaaataacagagaacacctacctcttattggaaaagttggcctctcgtggaaaactgatatttttgatggctgtataaagagttgttccatgatggacgtaactcttttggatgaacatgggaaacccttttggtgtttcagttccccggtgtgcctgagatcgcctgccacaccctctgacagctctagcttcttgggacagacatacaacgtggactacgttgatgcggaaggaagagtgcacgtggagctggtgtggatcagagagaccgaagaataccttattgtcaacctggtcctttatcttagtatcgcaaaaatcaaccattggtttgggactgaatattagcagtaggtggcaaattattgttgttatttagttgtttatttttgactggctttgttcttggtgttgaaaattaaaataaagcagatgcggccgaaaatatatattttgagactcgtatccgtgcgtaagacgaataaca

SEQ ID NO: 410416 - DNA, 1721 bp, Homo sapiens
gagcggactcttcgtttcagccctggcgcggtcctgtggtgaactccttgtctctatggcgactggacgcggtcggatcttgcagcagcactggctcggcctccagacgctgcgcgggcccagcaggggcggtggcgcggcccgggggcgcgccaggcctttgggtgcagaaaggggccaggggtcaagctttctgcaggctctgctgccctgaggtgccatgccggaggtggacagcactgggagagctctttctcctgctgttctgggttcctggatggaatgccttcagaaatcttgctgaagatattttcctacttggatgctgtgagccttctgtgtactggatgtgtgagcaggcgcttttatcatctagccaatgacaattttatttggatcggaatctactcaactgctttttcacctgcaagatcaaattggaaatttaattcagtagagaagatagctatgtctatgagctttctgtcagttcaggataaagaagctggttattggaagaaagaatatatcacaaaacaaatagcatctgtaaaagccgcactagctgacattctcaaacctgtcaacccttacacaggccttccagttaagaccaaagaggccctcagaatatttggtttaggttgggcaattatactgaaagaaaaaggtggaaaagaatatatcatggagcatgttgatctttccataaatgacacatcagttactgttatatggtatggcaaaaaatggccatgcctagcatcattgtcaaccttagatttatgtggcatgacaccagtttttaccgactggtataaaactcccaccaaacatagactccgatggcattctttaattgcaaagtacaatctgagtcattgaccatatctaccatgattggctgtgacagactcattcggatcttctgcctgcaccctggcctcctggtgggagtgtggaagaaggaggaagaactggcttttgttatggcaaatcttcattttcatcaccttgtggagaggagcacattaggctcggctactatcccctatgaactgcctccacatagcccctttttggatgatagccccgagtatggactgcacggctaccaactccatgttgatctgcacagcggtggggttttctacctatgtggtacatttcgcaatctcttcaccaagagaggaaatattgaaaatggacatgtgaagctcattgttatacatttaaaaaataacagagaacacctacctcttattggaaaagttggcctctcgtggaaaactgatatttttgatggctgtataaagagttgttccatgatggacgtaactcttttggatgaacatgggaaacccttttggtgtttcagttccccggtgtgcctgagatcgcctgccacaccctctgacagctctagcttcttgggacagacatacaacgtggactacgttgatgcggaaggaagagtgcacgtggagctggtgtggatcagagagaccgaagaataccttattgtcaacctggtcctttatcttagtatcgcaaaaatcaaccattggtttgggactgaatattagcagtaggtggcaaattattgttgttatttagttgtttatttttgactggctttgttcttggtgttgaaaattaaaataaagcaccgatgcggcagaccgaaacataaacatgataataaaaaacgatatactgta

SEQ ID NO: 410417 - DNA, 1727 bp, Homo sapiens
gagcggactcttcgtttcagccctggcgcggtcctgtggtgaactccttgtctctatggcgactggacgcggtcggatcttgcagcagcactggctcggcctccagacgctgcgcgggcccagcaggggcggtggcgcggcccgggggcgcgccaggcctttgggtgcagaaaggggccaggggtcaagctttctgcaggctctgctgccctgaggtgccatgccggaggtggacagcactgggagagctctttctcctgctgttctgggttcctggatggaatgccttcagaaatcttgctgaagatattttcctacttggatgctgtgagccttctgtgtactggatgtgtgagcaggcgcttttatcatctagccaatgacaattttatttggatcggaatctactcaactgctttttcacctgcaagatcaaattggaaatttaattcagtagagaagatagctatgtctatgagctttctgtcagttcaggataaagaagctggttattggaagaaagaatatatcacaaaacaaatagcatctgtaaaagccgcactagctgacattctcaaacctgtcaacccttacacaggccttccagttaagaccaaagaggccctcagaatatttggtttaggttgggcaattatactgaaagaaaaaggtggaaaagaatatatcatggagcatgttgatctttccataaatgacacatcagttactgttatatggtatggcaaaaaatggccatgcctagcatcattgtcaaccttagatttatgtggcatgacaccagtttttaccgactggtataaaactcccaccaaacatagactccgatggcattctttaattgcaaagtacaatctgagtcattgaccatatctaccatgattggctgtgacagactcattcggatcttctgcctgcaccctggcctcctggtgggagtgtggaagaaggaggaagaactggcttttgttatggcaaatcttcattttcatcaccttgtggagaggagcacattaggctcggctactatcccctatgaactgcctccacatagcccctttttggatgatagccccgagtatggactgcacggctaccaactccatgttgatctgcacagcggtggggttttctacctatgtggtacatttcgcaatctcttcaccaagagaggaaatattgaaaatggacatgtgaagctcattgttatacatttaaaaaataacagagaacacctacctcttattggaaaagttggcctctcgtggaaaactgatatttttgatggctgtataaagagttgttccatgatggacgtaactcttttggatgaacatgggaaacccttttggtgtttcagttccccggtgtgcctgagatcgcctgccacaccctctgacagctctagcttcttgggacagacatacaacgtggactacgttgatgcggaaggaagagtgcacgtggagctggtgtggatcagagagaccgaagaataccttattgtcaacctggtcctttatcttagtatcgcaaaaatcaaccattggtttgggactgaatattagcagtaggtggcaaattattgttgttatttagttgtttatttttgactggctttgttcttggtgttgaaaattaaaataaagcataagatgcgcgcagtttttattttgataaaaatgatggaagggagggaaaattagggg

SEQ ID NO: 410418 - DNA, 1727 bp, Homo sapiens
gagcggactcttcgtttcagccctggcgcggtcctgtggtgaactccttgtctctatggcgactggacgcggtcggatcttgcagcagcactggctcggcctccagacgctgcgcgggcccagcaggggcggtggcgcggcccgggggcgcgccaggcctttgggtgcagaaaggggccaggggtcaagctttctgcaggctctgctgccctgaggtgccatgccggaggtggacagcactgggagagctctttctcctgctgttctgggttcctggatggaatgccttcagaaatcttgctgaagatattttcctacttggatgctgtgagccttctgtgtactggatgtgtgagcaggcgcttttatcatctagccaatgacaattttatttggatcggaatctactcaactgctttttcacctgcaagatcaaattggaaatttaattcagtagagaagatagctatgtctatgagctttctgtcagttcaggataaagaagctggttattggaagaaagaatatatcacaaaacaaatagcatctgtaaaagccgcactagctgacattctcaaacctgtcaacccttacacaggccttccagttaagaccaaagaggccctcagaatatttggtttaggttgggcaattatactgaaagaaaaaggtggaaaagaatatatcatggagcatgttgatctttccataaatgacacatcagttactgttatatggtatggcaaaaaatggccatgcctagcatcattgtcaaccttagatttatgtggcatgacaccagtttttaccgactggtataaaactcccaccaaacatagactccgatggcattctttaattgcaaagtacaatctgagtcattgaccatatctaccatgattggctgtgacagactcattcggatcttctgcctgcaccctggcctcctggtgggagtgtggaagaaggaggaagaactggcttttgttatggcaaatcttcattttcatcaccttgtggagaggagcacattaggctcggctactatcccctatgaactgcctccacatagcccctttttggatgatagccccgagtatggactgcacggctaccaactccatgttgatctgcacagcggtggggttttctacctatgtggtacatttcgcaatctcttcaccaagagaggaaatattgaaaatggacatgtgaagctcattgttatacatttaaaaaataacagagaacacctacctcttattggaaaagttggcctctcgtggaaaactgatatttttgatggctgtataaagagttgttccatgatggacgtaactcttttggatgaacatgggaaacccttttggtgtttcagttccccggtgtgcctgagatcgcctgccacaccctctgacagctctagcttcttgggacagacatacaacgtggactacgttgatgcggaaggaagagtgcacgtggagctggtgtggatcagagagaccgaagaataccttattgtcaacctggtcctttatcttagtatcgcaaaaatcaaccattggtttgggactgaatattagcagtaggtggcaaattattgttgttatttagttgtttatttttgactggctttgttcttggtgttgaaaattaaaataaagcagagatgcggccggaaatttttatattgtataatttcgggaatatttcgaaaaaataaa

SEQ ID NO: 410419 - DNA, 1854 bp, Homo sapiens
gagcggactcttcgtttcagccctggcgcggtcctgtggtgaactccttgtctctatggcgactggacgcggtcggatcttgcagcagcactggctcggcctccagacgctgcgcgggcccagcaggggcggtggcgcggcccgggggcgcgccaggcctttgggtgcaggtgactgtagggcctgcgggtggggtcccctggcgggaagcccgtcactgcgcggccccgctctcttcaccgtgtattttattcgtccagcttggcgcaaggcccgtggccgtcttcaacgtgagaaggaaaggggccaggggtcaagctttctgcaggctctgctgccctgaggtgccatgccggaggtggacagcactgggagagctctttctcctgctgttctgggttcctggatggaatgccttcagaaatcttgctgaagatattttcctacttggatgctgtgagccttctgtgtactggatgtgtgagcaggcgcttttatcatctagccaatgacaattttatttggatcggaatctactcaactgctttttcacctgcaagatcaaattggaaatttaattcagtagagaagatagctatgtctatgagctttctgtcagttcaggataaagaagctggttattggaagaaagaatatatcacaaaacaaatagcatctgtaaaagccgcactagctgacattctcaaacctgtcaacccttacacaggccttccagttaagaccaaagaggccctcagaatatttggtttaggttgggcaattatactgaaagaaaaaggtggaaaagaatatatcatggagcatgttgatctttccataaatgacacatcagttactgttatatggtatggcaaaaaatggccatgcctagcatcattgtcaaccttagatttatgtggcatgacaccagtttttaccgactggtataaaactcccaccaaacatagactccgatggcattctttaattgcaaagtacaatctgagtcattgaccatatctaccatgattggctgtgacagactcattcggatcttctgcctgcaccctggcctcctggtgggagtgtggaagaaggaggaagaactggcttttgttatggcaaatcttcattttcatcaccttgtggagaggagcacattaggctcggctactatcccctatgaactgcctccacatagcccctttttggatgatagccccgagtatggactgcacggctaccaactccatgttgatctgcacagcggtggggttttctacctatgtggtacatttcgcaatctcttcaccaagagaggaaatattgaaaatggacatgtgaagctcattgttatacatttaaaaaataacagagaacacctacctcttattggaaaagttggcctctcgtggaaaactgatatttttgatggctgtataaagagttgttccatgatggacgtaactcttttggatgaacatgggaaacccttttggtgtttcagttccccggtgtgcctgagatcgcctgccacaccctctgacagctctagcttcttgggacagacatacaacgtggactacgttgatgcggaaggaagagtgcacgtggagctggtgtggatcagagagaccgaagaataccttattgtcaacctggtcctttatcttagtatcgcaaaaatcaaccattggtttgggactgaatattagcagtaggtggcaaattattgttgttatttagttgtttatttttgactggctttgttcttggtgttgaaaattaaaataaagcagatgcggccgaaaatatatattttgagactcgtatccgtgcgtaagacgaataaca

SEQ ID NO: 410420 - DNA, 1368 bp, Homo sapiens
gagcggactcttcgtttcagccctggcgcggtcctgtggtgaactccttgtctctatggcgactggacgcggtcggatcttgcagcagcactggctcggcctccagacgctgcgcgggcccagcaggggcggtggcgcggcccgggggcgcgccaggcctttgggtgcaggtgactgtagggcctgcgggtggggtcccctggcgggaagcccgtcactgcgcggccccgctctcttcaccgtgtattttattcgtccagcttggcgcaaggcccgtggccgtcttcaacgtgagaaggaaaggggccaggggtcaagctttctgcaggctctgctgccctgaggtgccatgccggaggtggacagcactgggagagctctttctcctgctgttctgggttcctggatggaatgccttcagaaatcttgctgaagatattttcctacttggatgctgtgagccttctgtgtactggatgtgtgagcaggcgcttttatcatctagccaatgacaaatgaacgttcaactgtaaatattcagcttggcttattcatggaattggattatttgaaaatatgcatctctaatttgatatattatgactaagaaggaggaagaactggcttttgttatggcaaatcttcattttcatcaccttgtggagaggagcacattaggctcggctactatcccctatgaactgcctccacatagcccctttttggatgatagccccgagtatggactgcacggctaccaactccatgttgatctgcacagcggtggggttttctacctatgtggtacatttcgcaatctcttcaccaagagaggaaatattgaaaatggacatgtgaagctcattgttatacatttaaaaaataacagagaacacctacctcttattggaaaagttggcctctcgtggaaaactgatatttttgatggctgtataaagagttgttccatgatggacgtaactcttttggatgaacatgggaaacccttttggtgtttcagttccccggtgtgcctgagatcgcctgccacaccctctgacagctctagcttcttgggacagacatacaacgtggactacgttgatgcggaaggaagagtgcacgtggagctggtgtggatcagagagaccgaagaataccttattgtcaacctggtcctttatcttagtatcgcaaaaatcaaccattggtttgggactgaatattagcagtaggtggcaaattattgttgttatttagttgtttatttttgactggctttgttcttggtgttgaaaattaaaataaagcagatgcggccgaaaatatatattttgagactcgtatccgtgcgtaagacgaataaca

SEQ ID NO: 410421 - DNA, 1904 bp, Homo sapiens
gagcggactcttcgtttcagccctggcgcggtcctgtggtgaactccttgtctctatggcgactggacgcggtcggatcttgcagcagcactggctcggcctccagacgctgcgcgggcccagcaggggcggtggcgcggcccgggggcgcgccaggcctttgggtgcaggtgactgtagggcctgcgggtggggtcccctggcgggaagcccgtcactgcgcggccccgctctcttcaccgtgtattttattcgtccagcttggcgcaaggcccgtggccgtcttcaacgtgagaaggcctacagtgagagtgtatatttctaaacctttgggtgaaagcacatcagaaaaggggccaggggtcaagctttctgcaggctctgctgccctgaggtgccatgccggaggtggacagcactgggagagctctttctcctgctgttctgggttcctggatggaatgccttcagaaatcttgctgaagatattttcctacttggatgctgtgagccttctgtgtactggatgtgtgagcaggcgcttttatcatctagccaatgacaattttatttggatcggaatctactcaactgctttttcacctgcaagatcaaattggaaatttaattcagtagagaagatagctatgtctatgagctttctgtcagttcaggataaagaagctggttattggaagaaagaatatatcacaaaacaaatagcatctgtaaaagccgcactagctgacattctcaaacctgtcaacccttacacaggccttccagttaagaccaaagaggccctcagaatatttggtttaggttgggcaattatactgaaagaaaaaggtggaaaagaatatatcatggagcatgttgatctttccataaatgacacatcagttactgttatatggtatggcaaaaaatggccatgcctagcatcattgtcaaccttagatttatgtggcatgacaccagtttttaccgactggtataaaactcccaccaaacatagactccgatggcattctttaattgcaaagtacaatctgagtcattgaccatatctaccatgattggctgtgacagactcattcggatcttctgcctgcaccctggcctcctggtgggagtgtggaagaaggaggaagaactggcttttgttatggcaaatcttcattttcatcaccttgtggagaggagcacattaggctcggctactatcccctatgaactgcctccacatagcccctttttggatgatagccccgagtatggactgcacggctaccaactccatgttgatctgcacagcggtggggttttctacctatgtggtacatttcgcaatctcttcaccaagagaggaaatattgaaaatggacatgtgaagctcattgttatacatttaaaaaataacagagaacacctacctcttattggaaaagttggcctctcgtggaaaactgatatttttgatggctgtataaagagttgttccatgatggacgtaactcttttggatgaacatgggaaacccttttggtgtttcagttccccggtgtgcctgagatcgcctgccacaccctctgacagctctagcttcttgggacagacatacaacgtggactacgttgatgcggaaggaagagtgcacgtggagctggtgtggatcagagagaccgaagaataccttattgtcaacctggtcctttatcttagtatcgcaaaaatcaaccattggtttgggactgaatattagcagtaggtggcaaattattgttgttatttagttgtttatttttgactggctttgttcttggtgttgaaaattaaaataaagcagatgcggccgaaaatatatattttgagactcgtatccgtgcgtaagacgaataaca

SEQ ID NO: 410422 - DNA, 1965 bp, Homo sapiens
gagcggactcttcgtttcagccctggcgcggtcctgtggtgaactccttgtctctatggcgactggacgcggtcggatcttgcagcagcactggctcggcctccagacgctgcgcgggcccagcaggggcggtggcgcggcccgggggcgcgccaggcctttgggtgcagaaaggggccaggggtcaagctttctgcaggctctgctgccctgaggtgccatgccggaggtggacagcactgggagagctctttctcctgctgttctgggttcctggatggaatgccttcagaaatcttgctgaagatattttcctacttggatgctgtgagccttctgtgtactggatgtgtgagcaggcgcttttatcatctagccaatgacaattttatttggatcggaatctactcaactgctttttcacctgcaagatcaaattggaaatttaattcagtagagaagatagctatgtctatgagctttctgtcagttcaggataaagaagctggttattggaagaaagaatatatcacaaaacaaatagcatctgtaaaagccgcactagctgacattctcaaacctgtcaacccttacacaggccttccagttaagaccaaagaggccctcagaatatttggtttaggttgggcaattatactgaaagaaaaaggtggaaaagaatatatcatggagcatgttgatctttccataaatgacacatcagttactgttatatggtatggcaaaaaatggccatgcctagcatcattgtcaaccttagatttatgtggcatgacaccagtttttaccgactggtataaaactcccaccaaacatagactccgatggcattctttaattgcaaagtacaatctgagtcattgaccatatctaccatgattggctgtgacagactcattcggatcttctgcctgcaccctggcctcctggtgggagtgtggaagaaggaggaagaactggcttttgttatggcaaatcttcattttcatcaccttgtggagaggagcacattaggctcggctactatcccctatgaactgcctccacatagcccctttttggatgatagccccgagtatggactgcacggctaccaactccatgttgatctgcacagcggtggggttttctacctatgtggtacatttcgcaatctcttcaccaagagaggtgaaattgattgagtttttatttcattatgaaattaaaggttgaggtgagggaaccaattttgatgtccgagttaagaattgccctcactggtcactttataatcttttggcaccagtatcctcccagacccgtgtgtcatcccagggcttgtgaaagtcctcactggaccgagtctcttcagaactggctctgtctccttcaccaccatcactctcaatgccaccttctgggggtagcccctactcatcttctctactgatgcttccttattatttttccatgctctctgctttccccagacttcttcccttctttcttaaaggaatgtggtaaatttgccagcagggcccgtgccgctccaggatgagagtaaagagaaaccagcctttctcctctacgtactgcatcactgtttgccacacctaccaaagccaggacagaggctggggcagacagaggaaaggagggagcttacgccaagcaggaaaaacgagggagtggagaatgccccattctcacttatctgattatttccttttggtttcattctactgtagcctgtaaacttggagtttcatgtaaggacttgcttagattcaagtttaacatttctggtaaaaatattttaaaagggaagttatgtacttcattttgcattatattgagaggtatataatgtcaggttgtcccattattagtaatgcctggttttatcatctggttaagatggtgaccactagatatcttcattattaaaagtattcttttcca

SEQ ID NO: 410423 - DNA, 454 bp, Homo sapiens
atttagccacttcttaaatagcacatcaggaaggaggtgcgccaatatccaatacctgtgtgttgtatgttgcttaaagcagaagcttccaaacctttcctagagaaatagtgtaaccattcatggctctccgggtgtgctgctgcctagacatggaggctgtgagctgtatgattttctggtgtttcagattccctcaagagtgcacgtggagctggtgtggatcagagagaccgaagaataccttattgtcaacctggtcctttatcttagtatcgcaaaaatcaaccattggtttgggactgaatattagcagtaggtggcaaattattgttgttatttagttgtttatttttgactggctttgttcttggtgttgaaaattaaaataaagcagagatgcggccggaaatttttatattgtataatttcgggaatatttcgaaaaaataaa

SEQ ID NO: 410424 - DNA, 351 bp, Homo sapiens
cctgcagccctggaggtggacatggggctccggcctgaagaagctcagtggcagaggttgtgcttcccaaggagtccagacctcccattcctggctgtctccactccactgtagtgcctctcttcaccctgactcttcttcccctgcagcctcaggtcagcctgtctccctgaagaatatctccacagacacatcgggttactacatctgtacctccagcaatgaggaggggacgcagttctgcaacatcacggtggccgtcagatctcgtaagagcagcctgcggggggagggctgacaaacgccacaggataactggtgggggtccagaaagtcagctgagaccaccgt

SEQ ID NO: 410425 - DNA, 430 bp, Homo sapiens
atcagctgaccatggctgacaacggcacctacgagtgttctgtctcgctgatgtcagacctggagggcaacaccaagtcacgtgtccgcctgttggtcctcggtgagtgtcttcatgtctttcaggagttgtaggaagagggtgggcaggtggcagcacagggagaagagcccaggtgttgagacgaagccagaggcagcaacaaggagctaagactcctcacctcgtccaggctgtcttcagcagagggaccgctcctccctttggaactaaacactattctgagttctccgccaatggccaacagtctcgaggacagagaaggccgacttggagtggtcccttgctctgtcggtgtcctttcctccataccagctcctctttttcataccacacttattacaaagataaaggaaaatcttaaatccta

SEQ ID NO: 410426 - DNA, 2807 bp, Homo sapiens
ctacccctttgtgagcagtctaggactttgtacacctgttaagtagggagaaggcaggggaggtggctggtttaaggggaacttgagggaagtagggaagactcctcttgggacctttggagtaggtgacacatgagcccagccccagctcacctgccaatccagctgaggagctcacctgccaatccagctgaggctgggcagaggtgggtgagaagagggaaaattgcagggacctccagttgggccaggccagaagctgctgtagctttaaccagacagctcagacctgtctggaggctgccagtgacaggttaggtttagggcagagaagaagcaagaccatggtggggaagatgtggcctgtgttgtggacactctgtgcagtcagggtgaccgtcgatgccatctctgtggaaactccgcaggacgttcttcgggcttcgcagggaaagagtgtcaccctgccctgcacctaccacacttccacctccagtcgagagggacttattcaatgggataagctcctcctcactcatacggaaagggtggtcatctggccgttttcaaacaaaaactacatccatggtgagctttataagaatcgcgtcagcatatccaacaatgctgagcagtccgatgcctccatcaccattgatcagctgaccatggctgacaacggcacctacgagtgttctgtctcgctgatgtcagacctggagggcaacaccaagtcacgtgtccgcctgttggtcctcgtgccaccctccaaaccagaatgcggcatcgagggagagaccataattgggaacaacatccagctgacctgccaatcaaaggagggctcaccaacccctcagtacagctggaagaggtacaacatcctgaatcaggagcagcccctggcccagccagcctcaggtcagcctgtctccctgaagaatatctccacagacacatcgggttactacatctgtacctccagcaatgaggaggggacgcagttctgcaacatcacggtggccgtcagatctccctccatgaacgtggccctgtatgtgggcatcgcggtgggcgtggttgcagccctcattatcattggcatcatcatctactgctgctgctgccgagggaaggacgacaacactgaagacaaggaggatgcaaggccgaaccgggaagcctatgaggagccaccagagcagctaagagaactttccagagagagggaggaggaggatgactacaggcaagaagagcagaggagcactgggcgtgaatccccggaccacctcgaccagtgacaggccagcagcagagggcggcggaggaagggttaggggttcattctcccgcttcctggcctcccttctcctttctaagccctgttctcctgtccctccatcccagacattgatggggacatttcttccccagtgtcagctgtggggaacatggctggcctggtaagggggtccctgtgctgatcctgctgacctcactgtcctgtgaagtaacccctcctggctgtgacacctggtgcgggcctggccctcactcaagaccaggctgcagcctccacttccctcgtagttggcaggagctcctggaagcacagcgctgagcatggggcgctcccactcagaactctccagggaggcgatgccagccttggggggtgggggctgtcctgctcacctgtgtgcccagcacctggaggggcaccaggtggagggtttgcactccacacatctttcttgaatgaatgaaagaataagtgagtatgcttgggccctgcattggcctggcctccagctcccactccctttccaacctcacttcccgtagctgccagtatgttccaaaccctcctgggaaggccacctcccactcctgctgcacaggccctggggagcttttgcccacacactttccatctctgcctgtcaatatcgtacctgtccctccaggcccatctcaaatcacaaggatttctctaaccctatcctaattgtccacatacgtggaaacaatcctgttactctgtcccacgtccaatcatgggccacaaggcacagtcttctgagcgagtgctctcactgtattagagcgccagctccttggggcagggcctgggcctcatggcttttgctttccctgaagccctagtagctggcgcccatcctagtgggcacttaagcttaattggggaaactgctttgattggttgtgccttcccttctctggtctccttgagatgatcgtagacacagggatgattcccacccaaacccacgtattcattcagtgagttaaacacgaattgatttaaagtgaacacacacaagggagcttgcttgcagatggtctgagttcttgtgtcctggtaattcctctccaggccagaataattggcatgtctcctcaacccacatggggttcctggttgttcctgcatcccgatacctcagccctggccctgcccagcccatttgggctctggttttctggtggggctgtcctgctgccctcccacagcctccttctgtttgtcgagcatttcttctactcttgagagctcaggcagcgttagggctgcttaggtctcatggaccagtggctggtctcacccaactgcagtttactattgctatcttttctggatgatcagaaaaataattccataaatctattgtctacttgcgattttttaaaaaatgtatatttttatatatattgttaaatcctttgcttcattccaaatgctttcagtaataataaaattgtgggtggaaattcttaaaact

SEQ ID NO: 410427 - DNA, 231 bp, Homo sapiens
actctgcggctccagtccttggaggtgtgtccttcgcccacattggggtcgtttgtctgtcttcctgcacttttcccggctgtgaactggattgatggggccagtctcctcctcccctgtcctggggtcattctccacattccttccagcccacctgtcctttccgtagccctctttggacctttacaaccacagatggtagcaccagcctgatgagccacagtcaggaga

SEQ ID NO: 410428 - DNA, 686 bp, Homo sapiens
cggggagggcggcttttgccggcttccggagaagggaggaaagagagaggtttacctaacactgtaaagagaacgttcaatgaaatacaaagaaaaagatgatttttttgctccaagagaattattccagccttggggtggagtgggtgtggacagtgagcagaaaaacaagaaaccaagttctgggaggaaataaaatgaatataatcagtggaaaattcagcaacgcaatattgtgtgacaacagtaaatgaccaatttataatttaaattctatgaaaaagagatttagaagagagttctaccaaacccactgttccctagggaataaaatgagtaacgctgactggcaacagtgcatcctgagggagcctggagaaacaacagcagcctccgacctcaagatatcctggttagctgcaaagtctgttatatattcattcaaatatttattaagcaccttactgtgtgctgggaactcttaagtgctagggattatgaacaaaacatatttacatggagcttacaatctaagtaaggggaagacaagtaaatacatgtcagatagtgaaatggtagagaaaagaaaaaacggtggtcagggaaagccttactgacatttgagctagtactgaaggaagtgaggaagaaggctaagcagctaccttggaggaggaattttccag

SEQ ID NO: 410429 - DNA, 828 bp, Homo sapiens
gcggccgcctcactcccggaggaacccgacggcggtggcggtccggacgacttgctgccgctcccgctgtggctggtggccgagggcatcttcagaccgcaaggagagagaagaaaaagcgggaggaaggacaagagcggccagtcaggagacggacggggcgagacgcgggacaaaacgcgcagcgagcggtttacctaacactgtaaagagaacgttcaatgaaatacaaagaaaaagatgatttttttgctccaagagaattattccagccttggggtggagtgggtgtggacagtgagcagaaaaacaagaaaccaagttctgggaggaaataaaatgaatataatcagtggaaaattcagcaacgcaatattgtgtgacaacagtaaatgaccaatttataatttaaattctatgaaaaagagatttagaagagagttctaccaaacccactgttccctagggaataaaatgagtaacgctgactggcaacagtgcatcctgagggagcctggagaaacaacagcagcctccgacctcaagatatcctggttagctgcaaagtctgttatatattcattcaaatatttattaagcaccttactgtgtgctgggaactcttaagtgctagggattatgaacaaaacatatttacatggagcttacaatctaagtaaggggaagacaagtaaatacatgtcagatagtgaaatggtagagaaaagaaaaaacggtggtcagggaaagccttactgacatttgagctagtactgaaggaagtgaggaagaaggctaagcagctaccttggaggaggaattttccag

SEQ ID NO: 410430 - DNA, 487 bp, Homo sapiens
gttctcttacaagaccaccaacattcttcaaacatcagtgaaataaaacaggaggagggtttcgagctctggatcctcagcctggaaatgtcacaatttaatcccaaaggtttgctgtgaagttgtaagcatgacagtgtgaaactcgacagattattcttgaattctttgtttgttttcgttgtgacccgactctcataaaatttatgttttcttccaaacccccagggtgtgtggtcatatgacttaaatagagaaaaacattgtcaaaacagtattgaggagttatcacttttacattgttttaattaaagaaaaagcctttctatccaggtctaataccatcatttttatgggcatgttaaagtatctaatctaatactgtagttagtagtagtatttagtatttttagtattattatagttttatctgtatcttaaagaaaaagtcaataaatatgaaaacagagtttgttttgggaatgta

SEQ ID NO: 410431 - DNA, 2331 bp, Homo sapiens
ctgcacagggagtttgtcttgtgcaaacaatttccaaggcagcgttttcttccctgcctgggagtgcagggctcagcgccttcactttggaactgactcagagacctaaagaagcccacctggccagcgggaaggggggccgccgccgcctcccggttttgggcagccctggccagctccctgtggccttggaggacttccaccgggcaggcgttcccatgatgccaggctaccaggcgcgggggattcctgcaggccggcgctgcttttcttagaaccccctttctagaaaagtacacctggaggttttgcttcaaagagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcagcagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaagaaacaaaaatatttttccccctaaaataggagagagccaaaactgaccaaggctattcagcagtgaaccagtgaccaaagaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaaaaaaaaaaaaaa

SEQ ID NO: 410432 - DNA, 2165 bp, Homo sapiens
gggcgggcggccggagcggagccgggccgcgggccgcgccgggagggcgggcagggccgcggccgctgcagcccggagctgagctagccgtccgagccgagccgtccgagccggggaagccgggcgcgtgctgccgctcgtggcgggccgaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcagcagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaagaaacaaaaatatttttccccctaaaataggagagagccaaaactgaccaaggctattcagcagtgaaccagtgaccaaagaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaaaaaaaaaaaaaa

SEQ ID NO: 410433 - DNA, 2087 bp, Homo sapiens
aggttcaagtgcgcatgtgcgcgaggagtcgctcgggcacttattgagcgccgactgtctacgggcggccgggggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcagcagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaagaaacaaaaatatttttccccctaaaataggagagagccaaaactgaccaaggctattcagcagtgaaccagtgaccaaagaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaaaaaaaaaaaaaa

SEQ ID NO: 410434 - DNA, 1980 bp, Homo sapiens
  misc_feature (449)..(449): n is a, c, g, or t
cttctacaaggaaacaaaaggaaaccgaattcactgctcaataaatgtgggaattcctggagttatctacattggcagctgtcatgagtggttactaggaatctagctaaatccctaagtaactgggcgatggatttgggtgggggaattgtcacacctctgcttataagagaggatggagtcgtgtagttgggcttcccacgtgacgtctaggtcctagaattgtgttctgtggacagacagtccagcacgcatgttttgaatacttcctacgggccaagaattggactaagtaagactttcaggttgaagaaggcttagtccctgcccttgtggagggcatggttcagattgagagagaaatgaatatgtaactatggttaattataataaccagtcaaagtactaattactagaggcatgagaaggtgttgtaggtaccagagggnccaacctattttgcccttgtggatgagaaacttatcacagagggtgacatttaggatggtcttcgctgcatgtagtaggtactcaaggaacatgcagcttgctgtgtgctgatatttcttaaaattcttttgtgcctattttatcagtctgtgggccaatttgcaaattagttattaaaaggtattgctttcagtgagaaagctttatgaaatgggccagccctcctccttgttagaatgagtggccgcttagcgatttcatgtttggcccacttggagctgtggctgacctatggggcccagacatgtagctggtgttttcacaaatagccctgaacctggatacccatgagcacactactactctcaagcagttgctggaagatcccatatcttatcccagccatgccccctagacgcagaaggcttggggcctcttttggcacgtgccatggcatgttcttggtaggtgatccagttgagaagttaaatcttctgcggtgattaagtcatgaggctagcacgtagaccagcgctgagggaagggttccaggatgagattggagcctcgcaataaggagactactgcaaggcattggatgatactccagtgttgtcctcgagaaagccgagtgtgtcccagctctttctggtcattgcacttacgcagagatgcaccttctgctgctgtcatgaggctgtggggattgtgggcagactctgaacacttcctgagctagaatccgggctgcaccctcgtcttccgcaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaagaaacaaaaatatttttccccctaaaataggagagagccaaaactgaccaaggctattcagcagtgaaccagtgaccaaagaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaaaaaaaaaaaaaa

SEQ ID NO: 410435 - DNA, 2205 bp, Homo sapiens
gggcgggcggccggagcggagccgggccgcgggccgcgccgggagggcgggcagggccgcggccgctgcagcccggagctgagctagccgtccgagccgagccgtccgagccggggaagccgggcgcgtgctgccgctcgtggcgggccgaggtgatgggcagaggcttcagtgtccccttcgcctccgcaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcagcagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaagaaacaaaaatatttttccccctaaaataggagagagccaaaactgaccaaggctattcagcagtgaaccagtgaccaaagaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaaaaaaaaaaaaaa

SEQ ID NO: 410436 - DNA, 2077 bp, Homo sapiens
  misc_feature (43)..(43): n is a, c, g, or t
tcgggttctgtggacacaggcaggaagcttaagaggctctgcngagcagggacctggggaagaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcagcagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaagaaacaaaaatatttttccccctaaaataggagagagccaaaactgaccaaggctattcagcagtgaaccagtgaccaaagaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaaaaaaaaaaaaaa

SEQ ID NO: 410437 - DNA, 1868 bp, Homo sapiens
taactctagcaggatcctctgtcgctgtatcgggggatcacgagtgcacaggactggtggagcagcacagctggatggagggtcaggtgaccgtctggctgctggagcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcagcagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaagaaacaaaaatatttttccccctaaaataggagagagccaaaactgaccaaggctattcagcagtgaaccagtgaccaaagaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaaaaaaaaaaaaaa

SEQ ID NO: 410438 - DNA, 2127 bp, Homo sapiens
aggttcaagtgcgcatgtgcgcgaggagtcgctcgggcacttattgagcgccgactgtctacgggcggccgggggtgatgggcagaggcttcagtgtccccttcgcctccgcaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcagcagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaagaaacaaaaatatttttccccctaaaataggagagagccaaaactgaccaaggctattcagcagtgaaccagtgaccaaagaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaaaaaaaaaaaaaa

SEQ ID NO: 410439 - DNA, 857 bp, Homo sapiens
gagatgtccgctgtcgtcccctgccttctggtttctgtgccctgtctccagtggcgtggactccgaccccacccagatgaagtcaccagggttagtccccagagaggagcccagatggcggatgcaccagatgggatgactgtttggtcctcagagcctctggcccctggtcctggtgacttttgccgggagctgcccctttggcctctgcttgttctcccagccccacttggccactctcctgggcccaccacctgtgtggggctcgatttgcattcctctctttctgcaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaagaaacaaaaatatttttccccctaaaataggagagagccaaaactgaccaaggctattcagcagtgaaccagtgaccaaagaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaaaaaaaaaaaaaa

SEQ ID NO: 410440 - DNA, 2248 bp, Homo sapiens
aggttcaagtgcgcatgtgcgcgaggagtcgctcgggcacttattgagcgccgactgtctacgggcggccggggacagtcttgcactgtttcctaggctggagtgcagtggcacaatcacagctcactgcagccttgacttccccaggctcaagccattctcctacctcagcctcccaagcagttgggaccacaggtgatgggcagaggcttcagtgtccccttcgcctccgcaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcagcagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaagaaacaaaaatatttttccccctaaaataggagagagccaaaactgaccaaggctattcagcagtgaaccagtgaccaaagaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaaaaaaaaaaaaaa

SEQ ID NO: 410441 - DNA, 2208 bp, Homo sapiens
aggttcaagtgcgcatgtgcgcgaggagtcgctcgggcacttattgagcgccgactgtctacgggcggccggggacagtcttgcactgtttcctaggctggagtgcagtggcacaatcacagctcactgcagccttgacttccccaggctcaagccattctcctacctcagcctcccaagcagttgggaccacaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcagcagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaagaaacaaaaatatttttccccctaaaataggagagagccaaaactgaccaaggctattcagcagtgaaccagtgaccaaagaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaaaaaaaaaaaaaa

SEQ ID NO: 410442 - DNA, 336 bp, Homo sapiens
ggcccaaactcccacatagacaggattcttccagtgcaagctctatcaggttttgaaattatggattccaaatttaggtttgcttatgtcatttaagagactaaaaattccagtttccctcagatcttccatatagctggccaagccaatggagcaaccagacaacacagttcagatgccatctgaaggcaaaaagtagccaaactataaatatgaaaggaaagaaataggaaatgagagaaagggagagaggagattaaaggtaggggtggtatttagcagatgaagcctccttagaagagaggaaatactcctttatagataggctcaactagg

SEQ ID NO: 410443 - DNA, 834 bp, Homo sapiens
ctaattttttgtattttttagtagagatggggtttcactgtgttagccaggatggtcacgatctcctgacctcgtgatccgtccacctcagccccccagagtgctgggattacaggcatgagccactgtgcccggccaaaaaaaatctctttttaaatatctcctatgattttggttgaatttgttcacctatagaacaaatttatgttgttttctgcttatcattagatgtaaaggagtaaagtccagtgggttctgctggcacattggtggggaagctgagaacttttaaactctttcccctttctccagtgaacaatcgacaggatatgggttatagttacagttaaagggtttattgaactaattgtcactgctgaagttcctgtgccctctgatagcttccttgaaaagttttcatagtttaaaaactctgcttgtccttagcctttgatctcttgctttgatgctcaaacagaagaatgatacaagactgaggatcttgccaggcaagggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaataaaaatgtggttatgggttggagaagacagcttgtgtggagagccttttttc

SEQ ID NO: 410444 - DNA, 480 bp, Homo sapiens
gggaggtgatcgagagaggcagggatgggggcgccggagtggagcggttgcggcggcctgggctgctgactgcgcacttggaatagtagcaggcggcggcggcggaacgccaggcagggctgaattggaaccctgtctcaggtactgagtgggaattactgctgaaatgaaaccgagcaaattcgggattcgcttaggatgaaagatggtgggacgtaaacttgaagtgctttgctgtttcatctcaagtgacacttgaactctgccacttgttacagagttataaacacacgaagagtatggaaacagactcttttttctgcattgctacatccaaagggagtgacaagtgcttttgtaaacatcattgtgggcagtgtgactgtctggtgaagtcatgataattaaatgagtacttattttgaagcactgaatggaagtttggagatatgattcgtaataaaattgtctccaacgagt

SEQ ID NO: 410445 - DNA, 4941 bp, Homo sapiens
gggaggtgatcgagagaggcagggatgggggcgccggagtggagcggttgcggcggcctgggctgctgactgcgcacttggaatagtagcaggcggcggcggcggaacgccaggcagtgtatgttttaactggaaaaagtcttccatgaaaacgtcacttttaaaaaataagtaatgccatctgttttcctaaaagactgaaatgggggcgaccattcttagacagggtctcactttgttgtccaggctggagtgcagtggtactattttagctcaatgcagccttagattcttggactcaagcaatcctcatgcctcagtctcccaagtagctgggactacagggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaatcagactgctgtatatgaggagcttgaagatgaaacacgaagactctgtgatgtcagaccttttcttccagttctcaaattagtgacaagaagttgtgacccaggggaaaaattagactcaaaaattggagtccttataggaaaaggtctgcatgaatttgattccttgaaggatcctgaagtaaatgaatttcgaagaaaaatgcgcaaattcagcgaggaaaaaatcctgtcacttgtgggattgtcttggatggactggctaaaacaaacatatccaccagagcatgaaccatccatccctgaaaacttagaagataaactttatgggggaaagctcatcgtagctgttcattttgaaaactgccaggacgtgtttagctttcaagtgtctcctaatatgaatcctatcaaagtaaatgaattggcaatccaaaaacgtttgactattcatgggaaggaagatgaagttagcccctatgattatgtgttgcaagtcagcgggagagtagaatatgtttttggtgatcatccactaattcagttccagtatatccggaactgtgtgatgaacagagccctgccccattttatacttgtggaatgctgcaagatcaagaaaatgtatgaacaagaaatgattgccatagaggctgccataaatcgaaattcatctaatcttcctcttccattaccaccaaagaaaacacgaattatttctcatgtttgggaaaataacaaccctttccaaattgtcttggttaagggaaataaacttaacacagaggaaactgtaaaagttcatgtcagggctggtctttttcatggtactgagctcctgtgtaaaaccatcgtaagctcagaggtatcagggaaaaatgatcatatttggaatgaaccactggaatttgatattaatatttgtgacttaccaagaatggctcgattatgttttgctgtttatgcagttttggataaagtaaaaacgaagaaatcaacgaaaactattaatccctctaaatatcagaccatcaggaaagctggaaaagtgcattatcctgtagcgtgggtaaatacgatggtttttgactttaaaggacaattgagaactggagacataatattacacagctggtcttcatttcctgatgaactcgaagaaatgttgaatccaatgggaactgttcaaacaaatccatatactgaaaatgcaacagctttgcatgttaaatttccagagaataaaaaacaaccttattattaccctcccttcgataagattattgaaaaggcagctgagattgcaagcagtgatagtgctaatgtgtcaagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcagcttcaggcgctgcttcagatttggcctaaactgcccccccgggaggccctagagcttctggatttcaactatccagaccagtacgttcgagaatatgctgtaggctgcctgcgacagatgagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtcagaagtgcacattcctgctgtctcagtacaatttggtgtcatccttgaagcatactgccggggaagtgtggggcacatgaaagtgctttctaagcaggttgaagcactcaataagttaaaaactttaaatagtttaatcaaactgaatgccgtgaagttaaacagagccaaagggaaggaggccatgcatacctgtttaaaacagagtgcttaccgggaagccctctctgacctgcagtcacccctgaacccatgtgttatcctctcagaactctatgttgaaaagtgcaaatacatggattccaaaatgaagcctttgtggctggtatacaataacaaggtatttggtgaggattcagttggagtgatttttaaaaatggtgatgatttacgacaggatatgttgacactccaaatgttgcgcttgatggatttactctggaaagaagctggtttggatcttcggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctggggatgacctggaccgagccattgaggaatttacactgtcctgtgctggctactgtgtagcttcttatgtccttgggattggtgacagacatagtgacaacatcatggtcaaaaaaactggccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggttccgccagtgttgtgaggatgcatatctgattttacgacggcatgggaatctcttcatcactctctttgcgctgatgttgactgcagggcttcctgaactcacatcagtcaaagatatacagtatcttaaggactctcttgcattagggaagagtgaagaagaagcactcaaacagtttaagcaaaaatttgatgaggcgctcagggaaagctggactactaaagtgaactggatggcccacacagttcggaaagactacagatcttaacgatcagccttcgctcctaatgtatttgttggtttcatttcattttcattttgcacttgcactaaattgaacatgaccctgttagagatgttataaagggaatgaaatcctggaactcagagttaaattaagaacaaggcatcccacagaacctaatctgaacaatccccgatgattccctctgctttttgaatgcttccaagacttatcatgaaaactgtcaatggataatcatttcctgctgactttgcacgccaaggaatgctactagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataacatatataaatatgctacatatatatttataaaatttctagtgggagttctatataaatgtttctttggtattcttcagcctgtgatttaaagttttacaaaaagcagagctttttcctaagttacttttcagttaggtaactgtgtgatccagttcttccagctgcttctataatgaggcacatattactaccagtttttatatggtatctatgaaagagttcacttcatagagaataatacttgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgccacacggaaatctttaagttatttgttgaggtaccatatatttagggtgctaggggcaagtaatgttaatatgtgcaataggaactactggtttgaatgtgtaaatgggtgatctctctgagtcctggcaacatccagcaaaactactgcttattctccaaagaatattgggagctctcaatcctcggtgatatgggaaagagaactgagtatttgccctatgactgagctttctataggaattttattaaagaatgtttaattttgttgtccttcttaatgttctcagtcaaataaatgagtgagctggtttcggctgctcttgg

SEQ ID NO: 410446 - DNA, 4103 bp, Homo sapiens
  misc_feature (3956)..(3956): n is a, c, g, or t
gggaggtgatcgagagaggcagggatgggggcgccggagtggagcggttgcggcggcctgggctgctgactgcgcacttggaatagtagcaggcggcggcggcggaacgccaggcagtgtatgttttaactggaaaaagtcttccatgaaaacgtcacttttaaaaaataagtaatgccatctgttttcctaaaagactgaaatgggggcgaccattcttagggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaatcagactgctgtatatgaggagcttgaagatgaaacacgaagactctgtgatgtcagaccttttcttccagttctcaaattagtgacaagaagttgtgacccaggggaaaaattagactcaaaaattggagtccttataggaaaaggtctgcatgaatttgattccttgaaggatcctgaagtaaatgaatttcgaagaaaaatgcgcaaattcagcgaggaaaaaatcctgtcacttgtgggattgtcttggatggactggctaaaacaaacatatccaccagagcatgaaccatccatccctgaaaacttagaagataaactttatgggggaaagctcatcgtagctgttcattttgaaaactgccaggacgtgtttagctttcaagtgtctcctaatatgaatcctatcaaagtaaatgaattggcaatccaaaaacgtttgactattcatgggaaggaagatgaagttagcccctatgattatgtgttgcaagtcagcgggagagtagaatatgtttttggtgatcatccactaattcagttccagtatatccggaactgtgtgatgaacagagccctgccccattttatacttgtggaatgctgcaagatcaagaaaatgtatgaacaagaaatgattgccatagaggctgccataaatcgaaattcatctaatcttcctcttccattaccaccaaagaaaacacgaattatttctcatgtttgggaaaataacaaccctttccaaattgtcttggttaagggaaataaacttaacacagaggaaactgtaaaagttcatgtcagggctggtctttttcatggtactgagctcctgtgtaaaaccatcgtaagctcagaggtatcagggaaaaatgatcatatttggaatgaaccactggaatttgatattaatatttgtgacttaccaagaatggctcgattatgttttgctgtttatgcagttttggataaagtaaaaacgaagaaatcaacgaaaactattaatccctctaaatatcagaccatcaggaaagctggaaaagtgcattatcctgtagcgtgggtaaatacgatggtttttgactttaaaggacaattgagaactggagacataatattacacagctggtcttcatttcctgatgaactcgaagaaatgttgaatccaatgggaactgttcaaacaaatccatatactgaaaatgcaacagctttgcatgttaaatttccagagaataaaaaacaaccttattattaccctcccttcgataagattattgaaaaggcagctgagattgcaagcagtgatagtgctaatgtgtcaagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcagcttcaggcgctgcttcagatttggcctaaactgcccccccgggaggccctagagcttctggatttcaactatccagaccagtacgttcgagaatatgctgtaggctgcctgcgacagatgagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtcagaagtgcacattcctgctgtctcagtacaatttggtgtcatccttgaagcatactgccggggaagtgtggggcacatgaaagtgctttctaagcaggttgaagcactcaataagttaaaaactttaaatagtttaatcaaactgaatgccgtgaagttaaacagagccaaagggaaggaggccatgcatacctgtttaaaacagagtgcttaccgggaagccctctctgacctgcagtcacccctgaacccatgtgttatcctctcagaactctatgttgaaaagtgcaaatacatggattccaaaatgaagcctttgtggctggtatacaataacaaggtatttggtgaggattcagttggagtgatttttaaaaatggtgatgatttacgacaggatatgttgacactccaaatgttgcgcttgatggatttactctggaaagaagctggtttggatcttcggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctggggatgacctggaccgagccattgaggaatttacactgtcctgtgctggctactgtgtagcttcttatgtccttgggattggtgacagacatagtgacaacatcatggtcaaaaaaactggccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggttccgccagtgttgtgaggatgcatatctgattttacgacggcatgggaatctcttcatcactctctttgcgctgatgttgactgcagggcttcctgaactcacatcagtcaaagatatacagtatcttaaggactctcttgcattagggaagagtgaagaagaagcactcaaacagtttaagcaaaaatttgatgaggcgctcagggaaagctggactactaaagtgaactggatggcccacacagttcggaaagactacagatcttaacgatcagccttcgctcctaatgtatttgttggtttcatttcattttcattttgcacttgcactaaattgaacatgaccctgttagagatgttataaagggaatgaaatcctggaactcagagttaaattaagaacaaggcatcccacagaacctaatctgaacaatccccgatgattccctctgctttttgaatgcttccaagacttatcatgaaaactgtcaatggataatcatttcctgctgactttgcacgccaaggaatgctactagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaatgtgtaactgcaatatatatattgattatgattatttccagagaanctggaacgggataccatactttggaattttccagtgaatttccgcgagtgaatatgggggaaaattagggcaattaacaggggcacggggggcacggaaaacaatagggagcacaaaattacaaggtaagaaatattaagagattgg

SEQ ID NO: 410447 - DNA, 4768 bp, Homo sapiens
gggaggtgatcgagagaggcagggatgggggcgccggagtggagcggttgcggcggcctgggctgctgactgcgcacttggaatagtagcaggcggcggcggcggaacgccaggcagtgtatgttttaactggaaaaagtcttccatgaaaacgtcacttttaaaaaataagtaatgccatctgttttcctaaaagactgaaatgggggcgaccattcttagggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaatcagactgctgtatatgaggagcttgaagatgaaacacgaagactctgtgatgtcagaccttttcttccagttctcaaattagtgacaagaagttgtgacccaggggaaaaattagactcaaaaattggagtccttataggaaaaggtctgcatgaatttgattccttgaaggatcctgaagtaaatgaatttcgaagaaaaatgcgcaaattcagcgaggaaaaaatcctgtcacttgtgggattgtcttggatggactggctaaaacaaacatatccaccagagcatgaaccatccatccctgaaaacttagaagataaactttatgggggaaagctcatcgtagctgttcattttgaaaactgccaggacgtgtttagctttcaagtgtctcctaatatgaatcctatcaaagtaaatgaattggcaatccaaaaacgtttgactattcatgggaaggaagatgaagttagcccctatgattatgtgttgcaagtcagcgggagagtagaatatgtttttggtgatcatccactaattcagttccagtatatccggaactgtgtgatgaacagagccctgccccattttatacttgtggaatgctgcaagatcaagaaaatgtatgaacaagaaatgattgccatagaggctgccataaatcgaaattcatctaatcttcctcttccattaccaccaaagaaaacacgaattatttctcatgtttgggaaaataacaaccctttccaaattgtcttggttaagggaaataaacttaacacagaggaaactgtaaaagttcatgtcagggctggtctttttcatggtactgagctcctgtgtaaaaccatcgtaagctcagaggtatcagggaaaaatgatcatatttggaatgaaccactggaatttgatattaatatttgtgacttaccaagaatggctcgattatgttttgctgtttatgcagttttggataaagtaaaaacgaagaaatcaacgaaaactattaatccctctaaatatcagaccatcaggaaagctggaaaagtgcattatcctgtagcgtgggtaaatacgatggtttttgactttaaaggacaattgagaactggagacataatattacacagctggtcttcatttcctgatgaactcgaagaaatgttgaatccaatgggaactgttcaaacaaatccatatactgaaaatgcaacagctttgcatgttaaatttccagagaataaaaaacaaccttattattaccctcccttcgataagagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcagcttcaggcgctgcttcagatttggcctaaactgcccccccgggaggccctagagcttctggatttcaactatccagaccagtacgttcgagaatatgctgtaggctgcctgcgacagatgagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtcagaagtgcacattcctgctgtctcagtacaatttggtgtcatccttgaagcatactgccggggaagtgtggggcacatgaaagtgctttctaagcaggttgaagcactcaataagttaaaaactttaaatagtttaatcaaactgaatgccgtgaagttaaacagagccaaagggaaggaggccatgcatacctgtttaaaacagagtgcttaccgggaagccctctctgacctgcagtcacccctgaacccatgtgttatcctctcagaactctatgttgaaaagtgcaaatacatggattccaaaatgaagcctttgtggctggtatacaataacaaggtatttggtgaggattcagttggagtgatttttaaaaatggtgatgatttacgacaggatatgttgacactccaaatgttgcgcttgatggatttactctggaaagaagctggtttggatcttcggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctggggatgacctggaccgagccattgaggaatttacactgtcctgtgctggctactgtgtagcttcttatgtccttgggattggtgacagacatagtgacaacatcatggtcaaaaaaactggccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggttccgccagtgttgtgaggatgcatatctgattttacgacggcatgggaatctcttcatcactctctttgcgctgatgttgactgcagggcttcctgaactcacatcagtcaaagatatacagtatcttaaggactctcttgcattagggaagagtgaagaagaagcactcaaacagtttaagcaaaaatttgatgaggcgctcagggaaagctggactactaaagtgaactggatggcccacacagttcggaaagactacagatcttaacgatcagccttcgctcctaatgtatttgttggtttcatttcattttcattttgcacttgcactaaattgaacatgaccctgttagagatgttataaagggaatgaaatcctggaactcagagttaaattaagaacaaggcatcccacagaacctaatctgaacaatccccgatgattccctctgctttttgaatgcttccaagacttatcatgaaaactgtcaatggataatcatttcctgctgactttgcacgccaaggaatgctactagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataacatatataaatatgctacatatatatttataaaatttctagtgggagttctatataaatgtttctttggtattcttcagcctgtgatttaaagttttacaaaaagcagagctttttcctaagttacttttcagttaggtaactgtgtgatccagttcttccagctgcttctataatgaggcacatattactaccagtttttatatggtatctatgaaagagttcacttcatagagaataatacttgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgccacacggaaatctttaagttatttgttgaggtaccatatatttagggtgctaggggcaagtaatgttaatatgtgcaataggaactactggtttgaatgtgtaaatgggtgatctctctgagtcctggcaacatccagcaaaactactgcttattctccaaagaatattgggagctctcaatcctcggtgatatgggaaagagaactgagtatttgccctatgactgagctttctataggaattttattaaagaatgtttaattttgttgtccttcttaatgttctcagtcaaataaatgagtgagctggtttcggctgctcttgg

SEQ ID NO: 410448 - DNA, 4736 bp, Homo sapiens
gggaggtgatcgagagaggcagggatgggggcgccggagtggagcggttgcggcggcctgggctgctgactgcgcacttggaatagtagcaggcggcggcggcggaacgccaggcagtgtatgttttaactggaaaaagtcttccatgaaaacgtcacttttaaaaaataagtaatgccatctgttttcctaaaagactgaaatgggggcgaccattcttagggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaatcagactgctgtatatgaggagcttgaagatgaaacacgaagactctgtgatgtcagaccttttcttccagttctcaaattagtgacaagaagttgtgacccaggggaaaaattagactcaaaaattggagtccttataggaaaaggtctgcatgaatttgattccttgaaggatcctgaagtaaatgaatttcgaagaaaaatgcgcaaattcagcgaggaaaaaatcctgtcacttgtgggattgtcttggatggactggctaaaacaaacatatccaccagagcatgaaccatccatccctgaaaacttagaagataaactttatgggggaaagctcatcgtagctgttcattttgaaaactgccaggacgtgtttagctttcaagtgtctcctaatatgaatcctatcaaagtaaatgaattggcaatccaaaaacgtttgactattcatgggaaggaagatgaagttagcccctatgattatgtgttgcaagtcagcgggagagtagaatatgtttttggtgatcatccactaattcagttccagtatatccggaactgtgtgatgaacagagccctgccccattttatacttgtggaatgctgcaagatcaagaaaatgtatgaacaagaaatgattgccatagaggctgccataaatcgaaattcatctaatcttcctcttccattaccaccaaagaaaacacgaattatttctcatgtttgggaaaataacaaccctttccaaattgtcttggttaagggaaataaacttaacacagaggaaactgtaaaagttcatgtcagggctggtctttttcatggtactgagctcctgtgtaaaaccatcgtaagctcagaggtatcagggaaaaatgatcatatttggaatgaaccactggaatttgatattaatatttgtgacttaccaagaatggctcgattatgttttgctgtttatgcagttttggataaagtaaaaacgaagaaatcaacgaaaactattaatccctctaaatatcagaccatcaggaaagctggaaaagtgcattatcctgtagcgtgggtaaatacgatggtttttgactttaaaggacaattgagaactggagacataatattacacagctggtcttcatttcctgatgaactcgaagaaatgttgaatccaatgggaactgttcaaacaaatccatatactgaaaatgcaacagctttgcatgttaaatttccagagaataaaaaacaaccttattattaccctcccttcgataagattattgaaaaggcagctgagattgcaagcagtgatagtgctaatgtgtcaagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcagcttcaggcgctgcttcagatttggcctaaactgcccccccgggaggccctagagcttctggatttcaactatccagaccagtacgttcgagaatatgctgtaggctgcctgcgacagatgagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtcagaagtgcacattcctgctgtctcagtacaatttggtgtcatccttgaagcatactgccggggaagtgtggggcacatgaaagtgctttctaagcaggttgaagcactcaataagttaaaaactttaaatagtttaatcaaactgaatgccgtgaagttaaacagagccaaagggaaggaggccatgcatacctgtttaaaacagagtgcttaccgggaagccctctctgacctgcagtcacccctgaacccatgtgttatcctctcagaactctatgttgaaaagtgcaaatacatggattccaaaatgaagcctttgtggctggtatacaataacaaggtatttggtgaggattcagttggagtgatttttaaaaatggtgatgatttacgacaggatatgttgacactccaaatgttgcgcttgatggatttactctggaaagaagctggtttggatcttcggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctggggatgacctggaccgagccattgaggaatttacactgtcctgtgctggctactgtgtagcttcttatgtccttgggattggtgacagacatagtgacaacatcatggtcaaaaaaactggccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggttccgccagtgttgtgaggatgcatatctgattttacgacggcatgggaatctcttcatcactctctttgcgctgatgttgactgcagggcttcctgaactcacatcagtcaaagatatacagtatcttaaggactactaaagtgaactggatggcccacacagttcggaaagactacagatcttaacgatcagccttcgctcctaatgtatttgttggtttcatttcattttcattttgcacttgcactaaattgaacatgaccctgttagagatgttataaagggaatgaaatcctggaactcagagttaaattaagaacaaggcatcccacagaacctaatctgaacaatccccgatgattccctctgctttttgaatgcttccaagacttatcatgaaaactgtcaatggataatcatttcctgctgactttgcacgccaaggaatgctactagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataacatatataaatatgctacatatatatttataaaatttctagtgggagttctatataaatgtttctttggtattcttcagcctgtgatttaaagttttacaaaaagcagagctttttcctaagttacttttcagttaggtaactgtgtgatccagttcttccagctgcttctataatgaggcacatattactaccagtttttatatggtatctatgaaagagttcacttcatagagaataatacttgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgccacacggaaatctttaagttatttgttgaggtaccatatatttagggtgctaggggcaagtaatgttaatatgtgcaataggaactactggtttgaatgtgtaaatgggtgatctctctgagtcctggcaacatccagcaaaactactgcttattctccaaagaatattgggagctctcaatcctcggtgatatgggaaagagaactgagtatttgccctatgactgagctttctataggaattttattaaagaatgtttaattttgttgtccttcttaatgttctcagtcaaataaatgagtgagctggtttcggctgctcttgg

SEQ ID NO: 410449 - DNA, 3588 bp, Homo sapiens
gggaggtgatcgagagaggcagggatgggggcgccggagtggagcggttgcggcggcctgggctgctgactgcgcacttggaatagtagcaggcggcggcggcggaacgccaggcagtgtatgttttaactggaaaaagtcttccatgaaaacgtcacttttaaaaaataagtaatgccatctgttttcctaaaagactgaaatgggggcgaccattcttagggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaatcagactgctgtatatgaggagcttgaagatgaaacacgaagactctgtgatgtcagaccttttcttccagttctcaaattagtgacaagaagttgtgacccaggggaaaaattagactcaaaaattggagtccttataggaaaaggtctgcatgaatttgattccttgaaggatcctgaagtaaatgaatttcgaagaaaaatgcgcaaattcagcgaggaaaaaatcctgtcacttgtgggattgtcttggatggactggctaaaacaaacatatccaccagagcatgaaccatccatccctgaaaacttagaagataaactttatgggggaaagctcatcgtagctgttcattttgaaaactgccaggacgtgtttagctttcaagtgtctcctaatatgaatcctatcaaagtaaatgaattggcaatccaaaaacgtttgactattcatgggaaggaagatgaagttagcccctatgattatgtgttgcaagtcagcgggagagtagaatatgtttttggtgatcatccactaattcagttccagtatatccggaactgtgtgatgaacagagccctgccccattttatacttgtggaatgctgcaagatcaagaaaatgtatgaacaagaaatgattgccatagaggctgccataaatcgaaattcatctaatcttcctcttccattaccaccaaagaaaacacgaattatttctcatgtttgggaaaataacaaccctttccaaattgtcttggttaagggaaataaacttaacacagaggaaactgtaaaagttcatgtcagggctggtctttttcatggtactgagctcctgtgtaaaaccatcgtaagctcagaggtatcagggaaaaatgatcatatttggaatgaaccactggaatttgatattaatatttgtgacttaccaagaatggctcgattatgttttgctgtttatgcagttttggataaagtaaaaacgaagaaatcaacgaaaactattaatccctctaaatatcagaccatcaggaaagctggaaaagtgcattatcctgtagcgtgggtaaatacgatggtttttgactttaaaggacaattgagaactggagacataatattacacagctggtcttcatttcctgatgaactcgaagaaatgttgaatccaatgggaactgttcaaacaaatccatatactgaaaatgcaacagctttgcatgttaaatttccagagaataaaaaacaaccttattattaccctcccttcgataagattattgaaaaggcagctgagattgcaagcagtgatagtgctaatgtgtcaagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcagcttcaggcgctgcttcagatttggcctaaactgcccccccgggaggccctagagcttctggatttcaactatccagaccagtacgttcgagaatatgctgtaggctgcctgcgacagatgagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtcagaagtgcacattcctgctgtctcagtacaatttggtgtcatccttgaagcatactgccggggaagtgtggggcacatgaaagtgctttctaagcaggttgaagcactcaataagttaaaaactttaaatagtttaatcaaactgaatgccgtgaagttaaacagagccaaagggaaggaggccatgcatacctgtttaaaacagagtgcttaccgggaagccctctctgacctgcagtcacccctgaacccatgtgttatcctctcagaactctatgttgaaaagtgcaaatacatggattccaaaatgaagcctttgtggctggtatacaataacaaggtatttggtgaggattcagttggagtgatttttaaaaatggtgatgatttacgacaggatatgttgacactccaaatgttgcgcttgatggatttactctggaaagaagctggtttggatcttcggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctggggatgacctggaccgagccattgaggaatttacactgtcctgtgctggctactgtgtagcttcttatgtccttgggattggtgacagacatagtgacaacatcatggtcaaaaaaactggccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggtgagtactgcccttgtgccaaggctgaacacttctaacattttcttatctgaccaggtggaccagcatttcttagctgagatatatttggatctgggagatattcagtctgattataggaagcttttgggggaatttgcctgtcagattattgtgctggttcagaaattcccagataggagaaacagaatgctagaaatttaaaatagttattatattttattccaataatatactaccttttacctgtttcagaacattctctgaaactattaagacagttgataggaagatgctgaaaagacatctgctgtcattgtgtatggagtacagtaagggaactagaattcagggcaaattttttaatctctgatctattactggctacctacatgttcccaagcataa

SEQ ID NO: 410450 - DNA, 2907 bp, Homo sapiens
gggaggtgatcgagagaggcagggatgggggcgccggagtggagcggttgcggcggcctgggctgctgactgcgcacttggaatagtagcaggcggcggcggcggaacgccaggcagtgtatgttttaactggaaaaagtcttccatgaaaacgtcacttttaaaaaataagtaatgccatctgttttcctaaaagactgaaatgggggcgaccattcttagggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaatcagactgctgtatatgaggagcttgaagatgaaacacgaagactctgtgatgtcagaccttttcttccagttctcaaattagtgacaagaagttgtgacccaggggaaaaattagactcaaaaattggagtccttataggaaaaggtctgcatgaatttgattccttgaaggatcctgaagtaaatgaatttcgaagaaaaatgcgcaaattcagcgaggaaaaaatcctgtcacttgtgggattgtcttggatggactggctaaaacaaacatatccaccagagcatgaaccatccatccctgaaaacttagaagataaactttatgggggaaagctcatcgtagctgttcattttgaaaactgccaggacgtgtttagctttcaagtgtctcctaatatgaatcctatcaaagtaaatgaattggcaatccaaaaacgtttgactattcatgggaaggaagatgaagttagcccctatgattatgtgttgcaagtcagcgggagagtagaatatgtttttggtgatcatccactaattcagttccagtatatccggaactgtgtgatgaacagagccctgccccattttatacttgtggaatgctgcaagatcaagaaaatgtatgaacaagaaatgattgccatagaggctgccataaatcgaaattcatctaatcttcctcttccattaccaccaaagaaaacacgaattatttctcatgtttgggaaaataacaaccctttccaaattgtcttggttaagggaaataaacttaacacagaggaaactgtaaaagttcatgtcagggctggtctttttcatggtactgagctcctgtgtaaaaccatcgtaagctcagaggtatcagggaaaaatgatcatatttggaatgaaccactggaatttgatattaatatttgtgacttaccaagaatggctcgattatgttttgctgtttatgcagttttggataaagtaaaaacgaagaaatcaacgaaaactattaatccctctaaatatcagaccatcaggaaagctggaaaagtgcattatcctgtagcgtgggtaaatacgatggtttttgactttaaaggacaattgagaactggagacataatattacacagctggtcttcatttcctgatgaactcgaagaaatgttgaatccaatgggaactgttcaaacaaatccatatactgaaaatgcaacagctttgcatgttaaatttccagagaataaaaaacaaccttattattaccctcccttcgataagattattgaaaaggcagctgagattgcaagcagtgatagtgctaatgtgtcaagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcagcttcaggcgctgcttcagatttggcctaaactgcccccccgggaggccctagagcttctggatttcaactatccagaccagtacgttcgagaatatgctgtaggctgcctgcgacagatgagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtcagaagtgcacattcctgctgtctcagtacaatttggtgtcatccttgaagcatactgccggggaagtgtggggcacatgaaagtgctttctaagcaggttgaagcactcaataagttaaaaactttaaatagtttaatcaaactgaatgccgtgaagttaaacagagccaaagggaaggaggccatgcatacctgtttaaaacagagtgcttaccgggaagccctctctgacctgcagtcacccctgaacccatgtgttatcctctcagaactctatgttgaaaagtgcaaatacatggattccaaaatgaagcctttgtggctggtatacaataacaaggtatttggtgaggattcagttggagtgatttttaaaaatggtgatgatttacgacaggatatgttgacactccaaatgttgcgcttgatggatttactctggaaagaagctggtttggatcttcgctggatacagtggctcttgcttgtaatcctaatattttggaaggccaaggtgagaggatcgcttgaacccgggagttcaagactatcctgggcaacagagcaagaccctagctcagtaaataaatagataaataaataaataaaatttaatttccaaaggcatac

SEQ ID NO: 410451 - DNA, 1774 bp, Homo sapiens
cttactggatttgggtggtagtggcaagcagctgtgcatcctgcagtaattataaattattttcatcttcaaaaaccttttggaagaagtcatattatctccctatcttggggttctgcctcctgcagatgatatttaaataagaacatgaagcatgctgcctgatggtggctggggaggcacaaccaatccagcctcctgcagactttgatatttgcacatctctactaaagttatataaaatcatattttcccccttccattttaggactctcttgcattagggaagagtgaagaagaagcactcaaacagtttaagcaaaaatttgatgaggcgctcagggaaagctggactactaaagtgaactggatggcccacacagttcggaaagactacagatcttaacgatcagccttcgctcctaatgtatttgttggtttcatttcattttcattttgcacttgcactaaattgaacatgaccctgttagagatgttataaagggaatgaaatcctggaactcagagttaaattaagaacaaggcatcccacagaacctaatctgaacaatccccgatgattccctctgctttttgaatgcttccaagacttatcatgaaaactgtcaatggataatcatttcctgctgactttgcacgccaaggaatgctactagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataacatatataaatatgctacatatatatttataaaatttctagtgggagttctatataaatgtttctttggtattcttcagcctgtgatttaaagttttacaaaaagcagagctttttcctaagttacttttcagttaggtaactgtgtgatccagttcttccagctgcttctataatgaggcacatattactaccagtttttatatggtatctatgaaagagttcacttcatagagaataatacttgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgccacacggaaatctttaagttatttgttgaggtaccatatatttagggtgctaggggcaagtaatgttaatatgtgcaataggaactactggtttgaatgtgtaaatgggtgatctctctgagtcctggcaacatccagcaaaactactgcttattctccaaagaatattgggagctctcaatcctcggtgatatgggaaagagaactgagtatttgccctatgactgagctttctataggaattttattaaagaatgtttaattttgttgtccttcttaatgttctcagtcaaataaatgagtgagctggtttcggctgctcttgg

SEQ ID NO: 410452 - DNA, 2000 bp, Homo sapiens
gggaggtgatcgagagaggcagggatgggggcgccggagtggagcggttgcggcggcctgggctgctgactgcgcacttggaatagtagcaggcggcggcggcggaacgccaggcagtgtatgttttaactggaaaaagtcttccatgaaaacgtcacttttaaaaaataagtaatgccatctgttttcctaaaagactgaaatgggggcgaccattcttagggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaatcagactgctgtatatgaggagcttgaagatgaaacacgaagactctgtgatgtcagaccttttcttccagttctcaaattagtgacaagaagttgtgacccaggggaaaaattagactcaaaaattggagtccttataggaaaaggtctgcatgaatttgattccttgaaggatcctgaagtaaatgaatttcgaagaaaaatgcgcaaattcagcgaggaaaaaatcctgtcacttgtgggattgtcttggatggactggctaaaacaaacatatccaccagagcatgaaccatccatccctgaaaacttagaagataaactttatgggggaaagctcatcgtagctgttcattttgaaaactgccaggacgtgtttagctttcaagtgtctcctaatatgaatcctatcaaagtaaatgaattggcaatccaaaaacgtttgactattcatgggaaggaagatgaagttagcccctatgattatgtgttgcaagtcagcgggagagtagaatatgtttttggtgatcatccactaattcagttccagtatatccggaactgtgtgatgaacagagccctgccccattttatacttgtggaatgctgcaagatcaagaaaatgtatgaacaagaaatgattgccatagaggctgccataaatcgaaattcatctaatcttcctcttccattaccaccaaagaaaacacgaattatttctcatgtttgggaaaataacaaccctttccaaattgtcttggttaagggaaataaacttaacacagaggaaactgtaaaagttcatgtcagggctggtctttttcatggtactgagctcctgtgtaaaaccatcgtaagctcagaggtatcagggaaaaatgatcatatttggaatgaaccactggaatttgatattaatatttgtgacttaccaagaatggctcgattatgttttgctgtttatgcagttttggataaagtaaaaacgaagaaatcaacgaaaactattaatccctctaaatatcagaccatcaggaaagctggaaaagtgcattatcctgtagcgtgggtaaatacgatggtttttgactttaaaggacaattgagaactggagacataatattacacagctggtcttcatttcctgatgaactcgaagaaatgttgaatccaatgggaactgttcaaacaaatccatatactgaaaatgcaacagctttgcatgttaaatttccagagaataaaaaacaaccttattattaccctcccttcgataagagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcaggtaacaaaagatcgtttctataactttttttgggtgtatggta

SEQ ID NO: 410453 - DNA, 4819 bp, Homo sapiens
gggaggtgatcgagagaggcagggatgggggcgccggagtggagcggttgcggcggcctgggctgctgactgcgcacttggaatagtagcaggcggcggcggcggaacgccaggcagtgtatgttttaactggaaaaagtcttccatgaaaacgtcacttttaaaaaataagtaatgccatctgttttcctaaaagactgaaatgggggcgaccattcttagggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaatcagactgctgtatatgaggagcttgaagatgaaacacgaagactctgtgatgtcagaccttttcttccagttctcaaattagtgacaagaagttgtgacccaggggaaaaattagactcaaaaattggagtccttataggaaaaggtctgcatgaatttgattccttgaaggatcctgaagtaaatgaatttcgaagaaaaatgcgcaaattcagcgaggaaaaaatcctgtcacttgtgggattgtcttggatggactggctaaaacaaacatatccaccagagcatgaaccatccatccctgaaaacttagaagataaactttatgggggaaagctcatcgtagctgttcattttgaaaactgccaggacgtgtttagctttcaagtgtctcctaatatgaatcctatcaaagtaaatgaattggcaatccaaaaacgtttgactattcatgggaaggaagatgaagttagcccctatgattatgtgttgcaagtcagcgggagagtagaatatgtttttggtgatcatccactaattcagttccagtatatccggaactgtgtgatgaacagagccctgccccattttatacttgtggaatgctgcaagatcaagaaaatgtatgaacaagaaatgattgccatagaggctgccataaatcgaaattcatctaatcttcctcttccattaccaccaaagaaaacacgaattatttctcatgtttgggaaaataacaaccctttccaaattgtcttggttaagggaaataaacttaacacagaggaaactgtaaaagttcatgtcagggctggtctttttcatggtactgagctcctgtgtaaaaccatcgtaagctcagaggtatcagggaaaaatgatcatatttggaatgaaccactggaatttgatattaatatttgtgacttaccaagaatggctcgattatgttttgctgtttatgcagttttggataaagtaaaaacgaagaaatcaacgaaaactattaatccctctaaatatcagaccatcaggaaagctggaaaagtgcattatcctgtagcgtgggtaaatacgatggtttttgactttaaaggacaattgagaactggagacataatattacacagctggtcttcatttcctgatgaactcgaagaaatgttgaatccaatgggaactgttcaaacaaatccatatactgaaaatgcaacagctttgcatgttaaatttccagagaataaaaaacaaccttattattaccctcccttcgataagattattgaaaaggcagctgagattgcaagcagtgatagtgctaatgtgtcaagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcagcttcaggcgctgcttcagatttggcctaaactgcccccccgggaggccctagagcttctggatttcaactatccagaccagtacgttcgagaatatgctgtaggctgcctgcgacagatgagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtcagaagtgcacattcctgctgtctcagtacaatttggtgtcatccttgaagcatactgccggggaagtgtggggcacatgaaagtgctttctaagcaggttgaagcactcaataagttaaaaactttaaatagtttaatcaaactgaatgccgtgaagttaaacagagccaaagggaaggaggccatgcatacctgtttaaaacagagtgcttaccgggaagccctctctgacctgcagtcacccctgaacccatgtgttatcctctcagaactctatgttgaaaagtgcaaatacatggattccaaaatgaagcctttgtggctggtatacaataacaaggtatttggtgaggattcagttggagtgatttttaaaaatggtgatgatttacgacaggatatgttgacactccaaatgttgcgcttgatggatttactctggaaagaagctggtttggatcttcggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctggggatgacctggaccgagccattgaggaatttacactgtcctgtgctggctactgtgtagcttcttatgtccttgggattggtgacagacatagtgacaacatcatggtcaaaaaaactggccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggttccgccagtgttgtgaggatgcatatctgattttacgacggcatgggaatctcttcatcactctctttgcgctgatgttgactgcagggcttcctgaactcacatcagtcaaagatatacagtatcttaaggactctcttgcattagggaagagtgaagaagaagcactcaaacagtttaagcaaaaatttgatgaggcgctcagggaaagctggactactaaagtgaactggatggcccacacagttcggaaagactacagatcttaacgatcagccttcgctcctaatgtatttgttggtttcatttcattttcattttgcacttgcactaaattgaacatgaccctgttagagatgttataaagggaatgaaatcctggaactcagagttaaattaagaacaaggcatcccacagaacctaatctgaacaatccccgatgattccctctgctttttgaatgcttccaagacttatcatgaaaactgtcaatggataatcatttcctgctgactttgcacgccaaggaatgctactagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataacatatataaatatgctacatatatatttataaaatttctagtgggagttctatataaatgtttctttggtattcttcagcctgtgatttaaagttttacaaaaagcagagctttttcctaagttacttttcagttaggtaactgtgtgatccagttcttccagctgcttctataatgaggcacatattactaccagtttttatatggtatctatgaaagagttcacttcatagagaataatacttgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgccacacggaaatctttaagttatttgttgaggtaccatatatttagggtgctaggggcaagtaatgttaatatgtgcaataggaactactggtttgaatgtgtaaatgggtgatctctctgagtcctggcaacatccagcaaaactactgcttattctccaaagaatattgggagctctcaatcctcggtgatatgggaaagagaactgagtatttgccctatgactgagctttctataggaattttattaaagaatgtttaattttgttgtccttcttaatgttctcagtcaaataaatgagtgagctggtttcggctgctcttgg

SEQ ID NO: 410454 - DNA, 4765 bp, Homo sapiens
gggaggtgatcgagagaggcagggatgggggcgccggagtggagcggttgcggcggcctgggctgctgactgcgcacttggaatagtagcaggcggcggcggcggaacgccaggcagtgtatgttttaactggaaaaagtcttccatgaaaacgtcacttttaaaaaataagtaatgccatctgttttcctaaaagactgaaatgggggcgaccattcttagggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaatcagactgctgtatatgaggagcttgaagatgaaacacgaagactctgtgatgtcagaccttttcttccagttctcaaattagtgacaagaagttgtgacccaggggaaaaattagactcaaaaattggagtccttataggaaaaggtctgcatgaatttgattccttgaaggatcctgaagtaaatgaatttcgaagaaaaatgcgcaaattcagcgaggaaaaaatcctgtcacttgtgggattgtcttggatggactggctaaaacaaacatatccaccagagcatgaaccatccatccctgaaaacttagaagataaactttatgggggaaagctcatcgtagctgttcattttgaaaactgccaggacgtgtttagctttcaagtgtctcctaatatgaatcctatcaaagtaaatgaattggcaatccaaaaacgtttgactattcatgggaaggaagatgaagttagcccctatgattatgtgttgcaagtcagcgggagagtagaatatgtttttggtgatcatccactaattcagttccagtatatccggaactgtgtgatgaacagagccctgccccattttatacttgtggaatgctgcaagatcaagaaaatgtatgaacaagaaatgattgccatagaggctgccataaatcgaaattcatctaatcttcctcttccattaccaccaaagaaaacacgaattatttctcatgtttgggaaaataacaaccctttccaaattgtcttggttaagggaaataaacttaacacagaggaaactgtaaaagttcatgtcagggctggtctttttcatggtactgagctcctgtgtaaaaccatcgtaagctcagaggtatcagggaaaaatgatcatatttggaatgaaccactggaatttgatattaatatttgtgacttaccaagaatggctcgattatgttttgctgtttatgcagttttggataaagtaaaaacgaagaaatcaacgaaaactattaatccctctaaatatcagaccatcaggaaagctggaaaagtgcattatcctgtagcgtgggtaaatacgatggtttttgactttaaaggacaattgagaactggagacataatattacacagctggtcttcatttcctgatgaactcgaagaaatgttgaatccaatgggaactgttcaaacaaatccatatactgaaaatgcaacagctttgcatgttaaatttccagagaataaaaaacaaccttattattaccctcccttcgataagattattgaaaaggcagctgagattgcaagcagtgatagtgctaatgtgtcaagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcagcttcaggcgctgcttcagatttggcctaaactgcccccccgggaggccctagagcttctggatttcaactatccagaccagtacgttcgagaatatgctgtaggctgcctgcgacagatgagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtcagaagtgcacattcctgctgtctcagtacaatttggtgtcatccttgaagcatactgccggggaagtgtggggcacatgaaagtgctttctaagcaggttgaagcactcaataagttaaaaactttaaatagtttaatcaaactgaatgccgtgaagttaaacagagccaaagggaaggaggccatgcatacctgtttaaaacagagtgcttaccgggaagccctctctgacctgcagtcacccctgaacccatgtgttatcctctcagaactctatgttgaaaagtgcaaatacatggattccaaaatgaagcctttgtggctggtatacaataacaaggtatttggtgaggattcagttggagtgatttttaaaaatggtgatgatttacgacaggatatgttgacactccaaatgttgcgcttgatggatttactctggaaagaagctggtttggatcttcggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctggggatgacctggaccgagccattgaggaatttacactgtcctgtgctggctactgtgtagcttcttatgtccttgggattggtgacagacatagtgacaacatcatggtcaaaaaaactggccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggttccgccagtgttgtgaggatgcatatctgattttacgacggcatgggaatctcttcatcactctctttgcgctgatgttgactgcagggcttcctgaactcacatcagtcaaagatatacagtatcttaaggactctcttgcattagggaagagtgaagaagaagcactcaaacagtttaagcaaaaatttgatgaggcgctcagggaaagctggactactaaagtgaactggatggcccacacagttcggaaagactacagatcttaacgatcagccttcgctcctaatgtatttgttggtttcatttcattttcattttgcacttgcactaaattgaacatgaccctgttagagatgttataaagggaatgaaatcctggaactcagagttaaattaagaacaaggcatcccacagaacctaatctgaacaatccccgatgattccctctgctttttgaatgcttccaagacttatcatgctagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataacatatataaatatgctacatatatatttataaaatttctagtgggagttctatataaatgtttctttggtattcttcagcctgtgatttaaagttttacaaaaagcagagctttttcctaagttacttttcagttaggtaactgtgtgatccagttcttccagctgcttctataatgaggcacatattactaccagtttttatatggtatctatgaaagagttcacttcatagagaataatacttgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgccacacggaaatctttaagttatttgttgaggtaccatatatttagggtgctaggggcaagtaatgttaatatgtgcaataggaactactggtttgaatgtgtaaatgggtgatctctctgagtcctggcaacatccagcaaaactactgcttattctccaaagaatattgggagctctcaatcctcggtgatatgggaaagagaactgagtatttgccctatgactgagctttctataggaattttattaaagaatgtttaattttgttgtccttcttaatgttctcagtcaaataaatgagtgagctggtttcggctgctcttgg

SEQ ID NO: 410455 - DNA, 2654 bp, Homo sapiens
ccccaaatggaatcccttgttaagaaatcaagaatggtctcaaaatagttctaattttaatccaatgatttgttctaattttttattcactaaatgtaataatgtaaagttaagcaaataaaaggaaacgagagaaggaatgttaagtggagaaggtgagaagggccaatcttaggttttgagtccagcctatctggcattagtatatgccacccaaggctgtcctcatggttgcttttctaccaagtgggactcttctaagtctgactcttctgcagacctgacaggaataggtgaggagttttcccaagcctagtatatagtggtaaaattataatcttctgtatcattacactgaagttgactaattttccccacttgatttcagtgttgaaaagtgcaaatacatggattccaaaatgaagcctttgtggctggtatacaataacaaggtatttggtgaggattcagttggagtgatttttaaaaatggtgatgatttacgacaggatatgttgacactccaaatgttgcgcttgatggatttactctggaaagaagctggtttggatcttcggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctggggatgacctggaccgagccattgaggaatttacactgtcctgtgctggctactgtgtagcttcttatgtccttgggattggtgacagacatagtgacaacatcatggtcaaaaaaactggccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggttccgccagtgttgtgaggatgcatatctgattttacgacggcatgggaatctcttcatcactctctttgcgctgatgttgactgcagggcttcctgaactcacatcagtcaaagatatacagtatcttaaggactctcttgcattagggaagagtgaagaagaagcactcaaacagtttaagcaaaaatttgatgaggcgctcagggaaagctggactactaaagtgaactggatggcccacacagttcggaaagactacagatcttaacgatcagccttcgctcctaatgtatttgttggtttcatttcattttcattttgcacttgcactaaattgaacatgaccctgttagagatgttataaagggaatgaaatcctggaactcagagttaaattaagaacaaggcatcccacagaacctaatctgaacaatccccgatgattccctctgctttttgaatgcttccaagacttatcatgaaaactgtcaatggataatcatttcctgctgactttgcacgccaaggaatgctactagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataacatatataaatatgctacatatatatttataaaatttctagtgggagttctatataaatgtttctttggtattcttcagcctgtgatttaaagttttacaaaaagcagagctttttcctaagttacttttcagttaggtaactgtgtgatccagttcttccagctgcttctataatgaggcacatattactaccagtttttatatggtatctatgaaagagttcacttcatagagaataatacttgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgccacacggaaatctttaagttatttgttgaggtaccatatatttagggtgctaggggcaagtaatgttaatatgtgcaataggaactactggtttgaatgtgtaaatgggtgatctctctgagtcctggcaacatccagcaaaactactgcttattctccaaagaatattgggagctctcaatcctcggtgatatgggaaagagaactgagtatttgccctatgactgagctttctataggaattttattaaagaatgtttaattttgttgtccttcttaatgttctcagtcaaataaatgagtgagctggtttcggctgctcttgg

SEQ ID NO: 410456 - DNA, 2403 bp, Homo sapiens
ccccaaaatgtagagtaagagtgaaagactttgatccaatgtacttctgtccacctacacaagcaaatagaatgtttcaccagaataattagacaaaaaattttatatgtaattggcacattggaatccttgtaaattactccttctgttggccaagagatttactcctttggtggaacttgtgtttttccatatgacaataatatagtaatggcaagtatatcaataataataaaactttttttaaaaagtaaagggaaaatcttaccaaattaatgtttcattttaaggaaaatatgactctatgcccatttttttccttccaggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctggggatgacctggaccgagccattgaggaatttacactgtcctgtgctggctactgtgtagcttcttatgtccttgggattggtgacagacatagtgacaacatcatggtcaaaaaaactggccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggttccgccagtgttgtgaggatgcatatctgattttacgacggcatgggaatctcttcatcactctctttgcgctgatgttgactgcagggcttcctgaactcacatcagtcaaagatatacagtatcttaaggactctcttgcattagggaagagtgaagaagaagcactcaaacagtttaagcaaaaatttgatgaggcgctcagggaaagctggactactaaagtgaactggatggcccacacagttcggaaagactacagatcttaacgatcagccttcgctcctaatgtatttgttggtttcatttcattttcattttgcacttgcactaaattgaacatgaccctgttagagatgttataaagggaatgaaatcctggaactcagagttaaattaagaacaaggcatcccacagaacctaatctgaacaatccccgatgattccctctgctttttgaatgcttccaagacttatcatgaaaactgtcaatggataatcatttcctgctgactttgcacgccaaggaatgctactagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataacatatataaatatgctacatatatatttataaaatttctagtgggagttctatataaatgtttctttggtattcttcagcctgtgatttaaagttttacaaaaagcagagctttttcctaagttacttttcagttaggtaactgtgtgatccagttcttccagctgcttctataatgaggcacatattactaccagtttttatatggtatctatgaaagagttcacttcatagagaataatacttgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgccacacggaaatctttaagttatttgttgaggtaccatatatttagggtgctaggggcaagtaatgttaatatgtgcaataggaactactggtttgaatgtgtaaatgggtgatctctctgagtcctggcaacatccagcaaaactactgcttattctccaaagaatattgggagctctcaatcctcggtgatatgggaaagagaactgagtatttgccctatgactgagctttctataggaattttattaaagaatgtttaattttgttgtccttcttaatgttctcagtcaaataaatgagtgagctggtttcggctgctcttgg

SEQ ID NO: 410457 - DNA, 819 bp, Homo sapiens
gggaggtgatcgagagaggcagggatgggggcgccggagtggagcggttgcggcggcctgggctgctgactgcgcacttggaatagtagcaggcggcggcggcggaacgccaggcagtgtatgttttaactggaaaaagtcttccatgaaaacgtcacttttaaaaaataagtaatgccatctgttttcctaaaagactgaaatgggggcgaccattcttagggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaatcagactgctgtatatgaggagcttgaagatgaaacacgaagactctgtgatgtcagaccttttcttccagttctcaaattagtgacaagaagttgtgacccaggggaaaaattagactcaaaaattggagtccttataggaaaagagatggaatcttactgtgttacccaggatgtgggccaagtttcttcaaggcattggtatctctctgaaatttacctccttcccaacatttaccaaaacatggattcattggccaccattacctcttcctatgcctgccaaatgtggcaaataaaaatattgaagattgaaatattaaaaaaaaa

SEQ ID NO: 410458 - DNA, 903 bp, Homo sapiens
attaatcaagtctacatgtttcgtttagagtaacaggaagatggtaatacgcccagggaactatctggaagtgtagaaattgggatgaacaccgtggttatacttgttttgatctgcctgtggtgctatgatgacttattttctctcattattgcatagaaactcaattcagtgatgttattcagatgttattcataagttattgccatgattcatcacttttatgtcatcagagttgggatggctacccagaataggggatcctggagatttccctgtagacgctttgcatttataaataatcctttatcaagggcagagggatttctgtaggacttctcccttagaagaactcagcctgggtagaaatacgaggattaacatcagcacatattcatctccaaaaaattttcctccccattactcacacttgccaataaataacttgctttgggtaaatattcagcactcagtcttagtccaaagcatttgctcagcaatcactgtgtagagtacagagtaagggggataccaacaaatagaagtttgctctattttcttaagaagcttgttgtctggccaggcacggtgcctcacgccaccttcctatcttcctaggagatagatgccacaaagaagcttgttgtctgataggcagctcagcagtgatattaatttgtaatatataacaaagatatggaaaaacttgagtgccaagaaatatttaattgtaaaaaccatgaagagatcgacacatttagagtgcaataggatttcaagtccaggtgtgatggcttacgcctgtaatcctagcactgtgagaggctgaggtaggtggatcacttgagcccaggagttcgagaccagcttggccacatagcaaaaccctgcgtctactaaaaa

SEQ ID NO: 410459 - DNA, 270 bp, Homo sapiens
agcctgggcaacatagtgagactctgtctcacaaaaaaaaaaaaaaaaaaaaaggatagtatactagtagaggacttcactttattttcctattttctggaaatttcatttctttgaattcgggcataagagatttagaagcttcactcaaatattaagctttatttaaaaagatgatttccagtatttcattttatattcacattaatcaagtctacatgtttcgtttagagtaacaggaagatggtaatacgcccagggaactatctg

SEQ ID NO: 410460 - DNA, 567 bp, Homo sapiens
gaagtgaggtcgttcacatggcgtctgtaggtcccacagtagtgtggctcttggcacgactctgcccagcgcgttctcttatgtgatgtatgtgggttataccatttaatactcataatactcctgcagagtaggtattgttttttccattttaaggtgagaagactgcagcgtagaaagttgaattgcttgacccaaaccacacggctggtaggaaacagaggcaggcttcaggcccagacctgatgaccccaaacttattctccttccctttacgatgttgcctcctggcaggtctttcacatcccaaaaatgactagacaggaaaatgtctagatacctttcctgactgaccttcccccaactcaattgattaacaagaaattgactaacagattaaaaagaataaatactgataaactaacaaatcaaaccagttggtggtttggtgccttgttccatagccatatccaacatgaaagatccagatgcagctcccaggcagtatctggtgctcggcccttgctcatgagcctacccattccctgtgtgtgcctcaacttcatg

SEQ ID NO: 410461 - DNA, 562 bp, Homo sapiens
ccaatataaccctttgtccaaagtaggcaaagagagaagaaattacttcttcacgtccctgccgtttcagaccatgatggatttacgtgggttataccatttaatactcataatactcctgcagagtaggtattgttttttccattttaaggtgagaagactgcagcgtagaaagttgaattgcttgacccaaaccacacggctggtaggaaacagaggcaggcttcaggcccagacctgatgaccccaaacttattctccttccctttacgatgttgcctcctggcaggtctttcacatcccaaaaatgactagacaggaaaatgtctagatacctttcctgactgaccttcccccaactcaattgattaacaagaaattgactaacagattaaaaagaataaatactgataaactaacaaatcaaaccagttggtggtttggtgccttgttccatagccatatccaacatgaaagatccagatgcagctcccaggcagtatctggtgctcggcccttgctcatgagcctacccattccctgtgtgtgcctcaacttcatg

SEQ ID NO: 410462 - DNA, 569 bp, Homo sapiens
tccagcctgggtaacaaagtgagacccagtctcacaaaaagaaaacaagatgaggaatttattctggattatataggtgggccttaaatgccatcccaagtgtccttgctagagaggcaggaggagattgaaaacacaaagagaaggtgttgtgaagagttaggcagagtttggagtgatagggccgtaagacaaggaactgtggcagccaccagaagcaggaagaggcaaggaacagattatcccccagagcctctgaagggagcacagccctgccaacacctagatctcagacttctggcctccagaactgtgagagaacaaattcctattttgagtcaccaaggttatgggaatttgttacagctcccagaggaaggtaatacacgtaccaatagccatttggctctactgccttataaaaagcatgcagagaatgctatagaaagtgtatttcaaaaattagctgggtgcgttggtgcatgcctgtaatcccagctacttgagaggctgaggcatgagaatcgcttgaacccaggaggtggaggttgcagtgagccgagatcatg

SEQ ID NO: 410463 - DNA, 401 bp, Homo sapiens
actttctcaacttttaatcagccttttccttgctacaagtagggtgcattttccttggcggtgaggaaatatgaaaaataaatgctacgtaaaagtgaataattcagggccaggcatagtggctcacgcttgtaatcccatcattttgggagggcgaggcaggtggatcacttgaggtcaggagttcaagagcagtctggtcaacatggtgaaaccccatctctactttttaaaaagaaaacaaaacaaaacaaaactagccaggcatggtggcatatacctgtaattccagctttgggaggctggggcatgagaattgcttgaacccaggaggcagtgatttaagatcacagcactgtactccagcctaggtgacggagtgagactctgtctcaaaaaaa

SEQ ID NO: 410464 - DNA, 180 bp, Homo sapiens
ggcccatgcccaataatgagaatgagaagaaatcattttatcagttttgctggtagatttttttctcaattagaagaataagagaatgttggagaattcagcaggacttagaatgctggttcattggggaacatagatacagcagagtaagaaaaattggaagaaataagaactgggact

SEQ ID NO: 410465 - DNA, 293 bp, Homo sapiens
gagtcactttggatttgatcgatgataatccacagtcatgctccaagactcatctcttttgctctggccaaacagacccatgaaataagaatgtcataattatcaccattccttttttttttttgagacagtctcgctctgtcgccaggctggagtgccgtggtgcagtcttagctcactgcaatctccgcctcccggagaatcacttgatcctgggaggtggaggttgcagtgagctgagatcatgccactgcactccagtccgggtgacagagcaagactctatctaaaaa

SEQ ID NO: 410466 - DNA, 775 bp, Homo sapiens
cctgaggctgaagagggaggaagctggaaactccgtgcgggtaactgaatgctaaggctgcttcctggcctccagcggtgtctgaggaaaggagcatagctgcaaatccaaggatacacaaaggagccatgctgccaagtaagagcccgtcttccatccattgctctcaagcactatctaccagatcgcagcccaaactacaacaacaacaaaaaagtcactctgccacttctccctgctgataaaccaagggcaagaattcaaccacaaagacccttacagagccttagccctctgaaaacttccggatacaaagccaactgactatgctagattaccatcacagttaaaggaacccagccttctcagatgggaaaaaaatcagaataagaactctggcaattcagaaagccagtgtcccctcacctccaaacaggcccactaggttcccagcaatggttaatcagtctgaaatgtctgaaatggcagtcatagaattcagaatctggatggctaggaagcttatcaagaccaagagaaagttgaaactcaatccaaggatgcaaagcaattcagtaaaatgattcaagagttgaaagactaagaagccgttttaagaaagacccaaaattgaacttcttgaactgaaaaattcgctacgagaatttcaaactacaagcagaactattaacagcagaatagaccaagcagagaaaagaacctcagggcttgaagacagttaattaagtcaactcagtcaggcaaaaataaagag

SEQ ID NO: 410467 - DNA, 710 bp, Homo sapiens
cagccctgtctttgacatcttatctgacaatctccccctccttctccaacacttggttaggtggcttttctatgttctcctataacacactacacttctcccagcacagaacttaccacactgcacaatggtctgtttgccaatcagagaagcaacatgccagcatggcagggaatccaggctttgggggcggacagttctgggtttgaaaatatccccacctctcactagctgtatgactatcagcaagttactaaatctctaggctttgaactcctcatctgtaacacgggctagaaacacctacctcacatggttgctgcaaagactaaatcagacaaggcaggaagaacatggtacaagcacctaagaagcactcagtaagtggtagttattttttattattttttgagacgaggtctgtcatgcaggctggagtacagcggcatgatcatggctcactgcagtctcaaccacccagactcaagcgatcctcccacctcagcctccagagtagctgggaccacagatgtgtaccatcacactcagctaattttaaaattatgaatatttgtagaggtgaggtctcactacgttgcccaggatggtctcgagctcctgacctcaagtgatctgcccacattggcctcccaaagtgctggaattacaggctaagccaccacacccggcctattatttccctattataa

SEQ ID NO: 410468 - DNA, 619 bp, Homo sapiens
aattaaaaaacttagccttcggactcataaaaggttcatttacttgtgtttgttctttagtacccgaagctgtgacaaatgcctcaaggatcaaatgtctggggctgggcgtggtgtttcaatcagtcctttatagagtagcagatgcctcaagagggaaaaacaaacagaaacaacagaagagatggtggacatgtgcaggcatcaagttaaatcagtgttaggttctgagaatatagatttccaatgaggaaatatttgcagctatacaaccaaccaatagaaaaaaaaaaaaggaaaaaaggaattagacaagaagtctatgactgatttgaacttgcagtgtcttaatttttaaagtacttttattttaagtgcttacttaatcctcacaactcttaagtaggtactactattattcttattttactgacgaggaaagagggctcaaaaagtccagtaagttgactgtggatatccagctggtaaatgagagtaagggttcaaatcccagacactctgatttcaaagcccattctcttagtaacttatacctcatactgataaataaatcataattaagtctatttgcatccaaagcttcacagtgattcttcct

SEQ ID NO: 410469 - DNA, 427 bp, Homo sapiens
ttttttttttttttcagatagagtcccattctatcacccaggttggagtgcagtagagtggagtgatcagctaactgcagcctgcagccttgaactcctaggctcaagcaatcctttcaccttagcctcccaaagtgctgggattacaggcatgtgccactgtgcctggccctcttttctttatacaattttttaaaaaaggaaaatttggactctatcctaagcaaaatgggagaaaaaagcagactagggatataaacggtatgagggtcctactgggagctcagctaatgttataaatcaaggggtggtgccaattcacaagtccgtaaaaatctccagcagcactctgtactgtggctgtaggaatggagaaaatggatggctggatttgactagacctaagatttataggacaaatgaagta

SEQ ID NO: 410470 - DNA, 400 bp, Homo sapiens
gcggccctactactactaaatttgcgaccgccctcctggagtctcggccgtcacagcagcttccggagagcgctgtgtgcctctggccttcctggcatgggaaagaggtcagctacctgtgttcggtcaacaagatgtccagcgcttagtttggtctcacctggatgctcctttctcctctagagatggaaaactgttgtcctgaaagcgtcaccaaacaaaacctgtggaaaggtaatggggggacccacgagcaagagctgacagaaaaatgaccacgggccgggtgcagtggctcacgcctgtaatcccagcactttgggaggccaaggcgggcggatcatctgagttcaggggttcaagaccaacctggccaacatggtgaaacctcgtccctact

SEQ ID NO: 410471 - DNA, 517 bp, Homo sapiens
ctgtaggtccagtgtaagagttccgctattcggtctcacacctacagtggactacccgatttttcgcttctcttcagggatgagtcatgtggtggtgaaaaatgaccctgaactggaccagcagcttgctaatctggacctgaactctgaaaaacagagtggaggagcaagtacagcgagcaaagggcgctatatacctcctcacttaaggaacagagaagcatctaaaggtacgtctttaaggcaactttgtagacctaacctttagcagctaatcaaagcctagggaagaaagtaactttaggaggtctataaatgttttttgtcccctcctgtgcctctttcagactgtctttaagaactagcactttctgtttttggaacagtttgtataatgttgaatgatggatagttgtttcctttggcaaactgagcccaaagaatctgagttttgtatagtggtttatctgtttgtaaacatttatgttttgaaatttgaaaccagtgtatttgtgga

SEQ ID NO: 410472 - DNA, 4652 bp, Homo sapiens
ctgtaggtccagtgtaagagttccgctattcggtctcacacctacagtggactacccgatttttcgcttctcttcagggatgagtcatgtggtggtgaaaaatgaccctgaactggaccagcagcttgctaatctggacctgaactctgaaaaacagagtggaggagcaagtacagcgagcaaagggcgctatatacctcctcacttaaggaacagagaagcatctaaaggattccatgataaagacagttcaggttggagttgcagcaaagataaggatgcatatagcagttttgggtctcgagattctagaggaaagcctggttatttcagtgaacgtggaagtggatcaaggggaagatttgatgatcgtggacggagtgactatgatggtattggcaatcgtgaaagacctggctttggcagatttgaacggagtggacatagtcgttggtgtgacaagtcagttgaagatgattggtcaaaaccacttccaccaagtgaacgcttggagcaagaactgttttctggaggaaacacggggattaactttgagaaatatgatgatataccagtagaggcaaccggcagtaactgtcctccacatattgagaattttagcgatattgacatgggagaaattatcatggggaacattgaacttactcgctatactcgtcctactccagtgcaaaaacatgccattcctattattaagggaaaaagagacttaatggcttgtgcccaaacaggatctgggaaaactgcagcatttcttttacccatactgagtcagatatatacagatggtccaggagaagctttgaaggctgtgaaggtaaaggttttgttataaaatcagacatttttgttttaaaaagctttgcaaagccctgttgacttttctaacggatgccagatacaccttattttcatttttttttttttacccctttcacccactgaaaataagtttgtagatgtaatctgcaaattataaagagaaagtgatgaatttttaaaaacaattgaagttttgggttatgaatttaaaattatatttatgttttaggaaaatggaaggtatgggcgccgcaaacaatatccaatatccttggttttagccccaacaagagaattggctgtacagatctatgaggaagccagaaaattttcctaccgatctagagttcgtccttgtgtagtttatggtggtgctgatattggtcagcagattcgggacttagaacgtggatgccacttgttagtagccactccaggacgtctagtggatatgatggaaagaggaaagattggattagacttctgcaagtacttagtgttggatgaagctgataggatgctggatatgggatttgaacctcagatacgtcgtatagttgaacaagatactatgccaccaaagggcgttcgtcacaccatgatgtttagtgctacttttcctaaggaaatacagatgcttgctcgtgactttttggatgaatatatctttttggctgtaggcagagtaggctctacctctgagaacatcacacagaaagtagtttgggtggaagacttagataaacggtcatttctactggacattttaggtgcaacagggagtgattcacttactttagtgtttgtggagaccaaaaagggagcagattccctggaggatttcttataccatgaaggatatgcttgtactagtattcatggagaccggtcacagagagatcgagaggaggcccttcaccagtttcgctcaggaaaaagcccaattctagtggctacagctgtggcagcacgaggactagacatttcaaatgtgagacatgttatcaattttgatttgccaagtgatattgaagaatatgtgcatcgtattggccgtacaggacgtgtaggaaacctgggccttgccacctcattctttaatgaaaaaaatatgaatattacaaaggatttgttggatcttcttgtagaagctaaacaagaagtgccttcttggttggaaaatatggcttatgaacaccactacaagggtggcagtcgtggacgatctaaaagtaatagattcagtggaggatttggtgccagagactatcgacaaagtagtggttccagcagttctggctttggtgctagtcgcggaagcagcagccgcagtggtggaggtggttacggcaacagcagaggatttggtggaggtggctatggaggcttctacaatagtgatggatatggaggaaattataactcccagggggttgactggtggggcaactgaatctgctttgcagcaaagtcacccttacaaagaagctaatatggaaaccacatgtaacttagccagactatattgtgtagcttcaagaacttgcagtacattaccagctgtgattctcctgataattcaagggagctcaaagtcacaagaagaaaaatgaaaggaaaaaacagcagccctattcagaaattggtttgaagatgtaattgctctagtttggattaaactcttcccctcctgctttagtgccaccccaaactgcatttataattttgtgactgaggatcgtttgtttgttaacgtactgtgactttaactttagacaacttactactttgatgtcctgttggctcagtaatgctcacgataccaattgttttgacaaaataaatttactaaacttggcctaaaatcaaaccttggcacagaggtatgatacaactttaacaggagtcatcaattcatccataaatataaaaagggaaaaaaacttaaggcagtagtctgcattaggactgtttgagttttgcagacttggggttgggagaacatcttaaagcattaaagcatagttttttgtatggccaaccttactaaattaagttctgacttgctcactctatcctggataggcacttgggaacttacactctttaagccattccagtcatgatgaggtggaatgtatcagtataccaattaatatttttgaaagagctcttttaggttaatttaagtacagcaatttctcatgtaatgtttagggagtttattctaacctaggcaaacggcatgctatcacaagaaaggtttaaagctttgataaaatgggggagatttaatcagtttttttaatgcctgctataaaaatttgaaatattagaatggccgaccatggcagtgaccaggcctcactacaggcctggttggattctggtctttaatgcatgctagtgttgatgttttttggtcaagaacggtttaaacaggaaggattgtgcagcaggctttaatttaatgtagattcatactgctctgttaaagctgcattgaaatgttaaaatggcttacacttgcagactttgcaaatcttaagactaacaaatccttgaaatcacacagcttgcaaatacgtactaaactgcacaaggtgtgtgttctatatgtgcagttttagcgtattttagttgcataggtttccatggtatttatagtctcttgtgctaaatttggccaaagatgattgtccaccactaaaaatgcctctcccacttggaattctgtactgattttgtggccagatgcaatgatctttaaaaacaaatcttttcaatggcataagaagttgacaaaaatttcttaaagtgcaatagattttcaagtgtattgtgccttgttctaaaacttttaagtaggtgcacttgacagtattgaggtcatttgttaaggtgctatttcaattagtgtaggtttagactcttgtacatttctcccataactttttacaaagtattttgttgcacattcagagaattttatatatatatgtcttgtgtgggtgtcctcgaccttccaatcttatttcgtctcttggagattgttgaatgcagccagtgaagaagtagattcctaaattttattggggaccatggaatggtagttgagaagaaaactatttgcacacaacagattttagatactttttgctgctagttgtgtaatatttattgaacattttgacaaatatttatttttgtaagcctaaaaatgattctttgaaagtttaaagaaacttgaccaaaagacagtacaaaaaacactggcacttgaatgttgaatgtcaccgtatgtgaaataatatattttggggtagtgtgagcttttaatgttaagtctgttaaacttgagtcaaattaagcagacccggcattggcaatgtagctgtaattttctgacaaaatttaagacaaaattgtcaacttgaaactaaaacatgccaaggttttgatatacttgtcttaagatattaatgaaacacttctgaacactgataggaagtgtccacatccacaaagtttctcttgagttttgttatgtgttttgttgtgtttgattttcagtgattgtctggtatatttacagtcctcaaacatggttatttctgtcagtgacttaacattcggttttatcagccagcagtattcttcagtaaataaagaatggaattgctgaatgtaatcattgaacctcgagtcactgtaaaagttcagtaattgcttattgtattagttttagatgctggcactgcatgtgctctgtttattctgattttactaaaataaaaagttcaaaagtc

SEQ ID NO: 410473 - DNA, 4110 bp, Homo sapiens
ttcagaaaaatggttgtgttttgtacaaattgaaatacattgtttaaaaataaagcacagtactcactttaggtttgccatataaatttactgtaacttcctagaaaattggaaataaagtaagaaaaattttcttacaattcaagggcatttagaacactttgtcatctgttaatattcagaaatgataagccagtgttttgttttcaggatctgggaaaactgcagcatttcttttacccatactgagtcagatatatacagatggtccaggagaagctttgaaggctgtgaaggtaaaggttttgttataaaatcagacatttttgttttaaaaagctttgcaaagccctgttgacttttctaacggatgccagatacaccttattttcatttttttttttttacccctttcacccactgaaaataagtttgtagatgtaatctgcaaattataaagagaaagtgatgaatttttaaaaacaattgaagttttgggttatgaatttaaaattatatttatgttttaggaaaatggaaggtatgggcgccgcaaacaatatccaatatccttggttttagccccaacaagagaattggctgtacagatctatgaggaagccagaaaattttcctaccgatctagagttcgtccttgtgtagtttatggtggtgctgatattggtcagcagattcgggacttagaacgtggatgccacttgttagtagccactccaggacgtctagtggatatgatggaaagaggaaagattggattagacttctgcaagtacttagtgttggatgaagctgataggatgctggatatgggatttgaacctcagatacgtcgtatagttgaacaagatactatgccaccaaagggcgttcgtcacaccatgatgtttagtgctacttttcctaaggaaatacagatgcttgctcgtgactttttggatgaatatatctttttggctgtaggcagagtaggctctacctctgagaacatcacacagaaagtagtttgggtggaagacttagataaacggtcatttctactggacattttaggtgcaacagggagtgattcacttactttagtgtttgtggagaccaaaaagggagcagattccctggaggatttcttataccatgaaggatatgcttgtactagtattcatggagaccggtcacagagagatcgagaggaggcccttcaccagtttcgctcaggaaaaagcccaattctagtggctacagctgtggcagcacgaggactagacatttcaaatgtgagacatgttatcaattttgatttgccaagtgatattgaagaatatgtgcatcgtattggccgtacaggacgtgtaggaaacctgggccttgccacctcattctttaatgaaaaaaatatgaatattacaaaggatttgttggatcttcttgtagaagctaaacaagaagtgccttcttggttggaaaatatggcttatgaacaccactacaagggtggcagtcgtggacgatctaaaagtaatagattcagtggaggatttggtgccagagactatcgacaaagtagtggttccagcagttctggctttggtgctagtcgcggaagcagcagccgcagtggtggaggtggttacggcaacagcagaggatttggtggaggtggctatggaggcttctacaatagtgatggatatggaggaaattataactcccagggggttgactggtggggcaactgaatctgctttgcagcaaagtcacccttacaaagaagctaatatggaaaccacatgtaacttagccagactatattgtgtagcttcaagaacttgcagtacattaccagctgtgattctcctgataattcaagggagctcaaagtcacaagaagaaaaatgaaaggaaaaaacagcagccctattcagaaattggtttgaagatgtaattgctctagtttggattaaactcttcccctcctgctttagtgccaccccaaactgcatttataattttgtgactgaggatcgtttgtttgttaacgtactgtgactttaactttagacaacttactactttgatgtcctgttggctcagtaatgctcacgataccaattgttttgacaaaataaatttactaaacttggcctaaaatcaaaccttggcacagaggtatgatacaactttaacaggagtcatcaattcatccataaatataaaaagggaaaaaaacttaaggcagtagtctgcattaggactgtttgagttttgcagacttggggttgggagaacatcttaaagcattaaagcatagttttttgtatggccaaccttactaaattaagttctgacttgctcactctatcctggataggcacttgggaacttacactctttaagccattccagtcatgatgaggtggaatgtatcagtataccaattaatatttttgaaagagctcttttaggttaatttaagtacagcaatttctcatgtaatgtttagggagtttattctaacctaggcaaacggcatgctatcacaagaaaggtttaaagctttgataaaatgggggagatttaatcagtttttttaatgcctgctataaaaatttgaaatattagaatggccgaccatggcagtgaccaggcctcactacaggcctggttggattctggtctttaatgcatgctagtgttgatgttttttggtcaagaacggtttaaacaggaaggattgtgcagcaggctttaatttaatgtagattcatactgctctgttaaagctgcattgaaatgttaaaatggcttacacttgcagactttgcaaatcttaagactaacaaatccttgaaatcacacagcttgcaaatacgtactaaactgcacaaggtgtgtgttctatatgtgcagttttagcgtattttagttgcataggtttccatggtatttatagtctcttgtgctaaatttggccaaagatgattgtccaccactaaaaatgcctctcccacttggaattctgtactgattttgtggccagatgcaatgatctttaaaaacaaatcttttcaatggcataagaagttgacaaaaatttcttaaagtgcaatagattttcaagtgtattgtgccttgttctaaaacttttaagtaggtgcacttgacagtattgaggtcatttgttaaggtgctatttcaattagtgtaggtttagactcttgtacatttctcccataactttttacaaagtattttgttgcacattcagagaattttatatatatatgtcttgtgtgggtgtcctcgaccttccaatcttatttcgtctcttggagattgttgaatgcagccagtgaagaagtagattcctaaattttattggggaccatggaatggtagttgagaagaaaactatttgcacacaacagattttagatactttttgctgctagttgtgtaatatttattgaacattttgacaaatatttatttttgtaagcctaaaaatgattctttgaaagtttaaagaaacttgaccaaaagacagtacaaaaaacactggcacttgaatgttgaatgtcaccgtatgtgaaataatatattttggggtagtgtgagcttttaatgttaagtctgttaaacttgagtcaaattaagcagacccggcattggcaatgtagctgtaattttctgacaaaatttaagacaaaattgtcaacttgaaactaaaacatgccaaggttttgatatacttgtcttaagatattaatgaaacacttctgaacactgataggaagtgtccacatccacaaagtttctcttgagttttgttatgtgttttgttgtgtttgattttcagtgattgtctggtatatttacagtcctcaaacatggttatttctgtcagtgacttaacattcggttttatcagccagcagtattcttcagtaaataaagaatggaattgctgaatgtaatcattgaacctcgagtcactgtaaaagttcagtaattgcttattgtattagttttagatgctggcactgcatgtgctctgtttattctgattttactaaaataaaaagttcaaaagtc

SEQ ID NO: 410474 - DNA, 4598 bp, Homo sapiens
ctgtaggtccagtgtaagagttccgctattcggtctcacacctacagtggactacccgatttttcgcttctcttcagggatgagtcatgtggtggtgaaaaatgaccctgaactggaccagcagcttgctaatctggacctgaactctgaaaaacagagtggaggagcaagtacagcgagcaaagggcgctatatacctcctcacttaaggaacagagaagcatctaaaggattccatgataaagacagttcaggttggagttgcagcaaagataaggatgcatatagcagttttgggtctcgagattctagaggaaagcctggttatttcagtgaacgtggaagtggatcaaggggaagatttgatgatcgtggacggagtgactatgatggtattggcaatcgtgaaagacctggctttggcagatttgaacggagtggacatagtcgttggtgtgacaagtcagttgaagatgattggtcaaaaccacttccaccaagtgaacgcttggagcaagaactgttttctggaggaaacacggggattaactttgagaaatatgatgatataccagtagaggcaaccggcagtaactgtcctccacatattgagaattttagcgatattgacatgggagaaattatcatggggaacattgaacttactcgctatactcgtcctactccagtgcaaaaacatgccattcctattattaagggaaaaagagacttaatggcttgtgcccaaacaggatctgggaaaactgcagcatttcttttacccatactgagtcagatatatacagatggtccaggagaagctttgaaggctgtgaaggtaaaggttttgttataaaatcagacatttttgttttaaaaagctttgcaaagccctgttgacttttctaacggatgccagatacaccttattttcatttttttttttttacccctttcacccactgaaaataagtttgtagatgtaatctgcaaattataaagagaaagtgatgaatttttaaaaacaattgaagttttgggttatgaatttaaaattatatttatgttttaggaaaatggaaggtatgggcgccgcaaacaatatccaatatccttggttttagccccaacaagagaattggctgtacagatctatgaggaagccagaaaattttcctaccgatctagagttcgtccttgtgtagtttatggtggtgctgatattggtcagcagattcgggacttagaacgtggatgccacttgttagtagccactccaggacgtctagtggatatgatggaaagaggaaagattggattagacttctgcaagtacttagtgttggatgaagctgataggatgctggatatgggatttgaacctcagatacgtcgtatagttgaacaagatactatgccaccaaagggcgttcgtcacaccatgatgtttagtgctacttttcctaaggaaatacagatgcttgctcgtgactttttggatgaatatatctttttggctgtaggcagagtaggctctacctctgagaacatcacacagaaagtagtttgggtggaagacttagataaacggtcatttctactggacattttaggtgcaacagggagtgattcacttactttagtgtttgtggagaccaaaaagggagcagattccctggaggatttcttataccatgaaggatatgcttgtactagtattcatggagaccggtcacagagagatcgagaggaggcccttcaccagtttcgctcaggaaaaagcccaattctagtggctacagctgtggcagcacgaggactagacatttcaaatgtgagacatgttatcaattttgatttgccaagtgatattgaagaatatgtgcatcgtattggccgtacaggacgtgtaggaaacctgggccttgccacctcattctttaatgaaaaaaatatgaatattacaaaggatttgttggatcttcttgtagaagctaaacaagaagtgccttcttggttggaaaatatggcttatgaacaccactacaagggtggcagtcgtggacgatctaaaagtaatagattcagtggaggatttggtgccagagactatcgacaaagtagtggttccagcagttctggctttggtgctagtcgcggaagcagcagccgcagtggtggaggtggttacggcaacagcagaggatttggtggaggtggctatggaggcttctacaatagtgatggatatggaggaaattataactcccagggggttgactggtggggcaactgaatctgctttgcagcaaagtcacccttacaaagaagctaatatggaaaccacatgtaacttagccagactatattgtgtagcttcaagaacttgcagtacattaccagctgtgattctcctgataattcaagggagctcaaagtcacaagaagaaaaatgaaaggaaattaaactcttcccctcctgctttagtgccaccccaaactgcatttataattttgtgactgaggatcgtttgtttgttaacgtactgtgactttaactttagacaacttactactttgatgtcctgttggctcagtaatgctcacgataccaattgttttgacaaaataaatttactaaacttggcctaaaatcaaaccttggcacagaggtatgatacaactttaacaggagtcatcaattcatccataaatataaaaagggaaaaaaacttaaggcagtagtctgcattaggactgtttgagttttgcagacttggggttgggagaacatcttaaagcattaaagcatagttttttgtatggccaaccttactaaattaagttctgacttgctcactctatcctggataggcacttgggaacttacactctttaagccattccagtcatgatgaggtggaatgtatcagtataccaattaatatttttgaaagagctcttttaggttaatttaagtacagcaatttctcatgtaatgtttagggagtttattctaacctaggcaaacggcatgctatcacaagaaaggtttaaagctttgataaaatgggggagatttaatcagtttttttaatgcctgctataaaaatttgaaatattagaatggccgaccatggcagtgaccaggcctcactacaggcctggttggattctggtctttaatgcatgctagtgttgatgttttttggtcaagaacggtttaaacaggaaggattgtgcagcaggctttaatttaatgtagattcatactgctctgttaaagctgcattgaaatgttaaaatggcttacacttgcagactttgcaaatcttaagactaacaaatccttgaaatcacacagcttgcaaatacgtactaaactgcacaaggtgtgtgttctatatgtgcagttttagcgtattttagttgcataggtttccatggtatttatagtctcttgtgctaaatttggccaaagatgattgtccaccactaaaaatgcctctcccacttggaattctgtactgattttgtggccagatgcaatgatctttaaaaacaaatcttttcaatggcataagaagttgacaaaaatttcttaaagtgcaatagattttcaagtgtattgtgccttgttctaaaacttttaagtaggtgcacttgacagtattgaggtcatttgttaaggtgctatttcaattagtgtaggtttagactcttgtacatttctcccataactttttacaaagtattttgttgcacattcagagaattttatatatatatgtcttgtgtgggtgtcctcgaccttccaatcttatttcgtctcttggagattgttgaatgcagccagtgaagaagtagattcctaaattttattggggaccatggaatggtagttgagaagaaaactatttgcacacaacagattttagatactttttgctgctagttgtgtaatatttattgaacattttgacaaatatttatttttgtaagcctaaaaatgattctttgaaagtttaaagaaacttgaccaaaagacagtacaaaaaacactggcacttgaatgttgaatgtcaccgtatgtgaaataatatattttggggtagtgtgagcttttaatgttaagtctgttaaacttgagtcaaattaagcagacccggcattggcaatgtagctgtaattttctgacaaaatttaagacaaaattgtcaacttgaaactaaaacatgccaaggttttgatatacttgtcttaagatattaatgaaacacttctgaacactgataggaagtgtccacatccacaaagtttctcttgagttttgttatgtgttttgttgtgtttgattttcagtgattgtctggtatatttacagtcctcaaacatggttatttctgtcagtgacttaacattcggttttatcagccagcagtattcttcagtaaataaagaatggaattgctgaatgtaatcattgaacctcgagtcactgtaaaagttcagtaattgcttattgtattagttttagatgctggcactgcatgtgctctgtttattctgattttactaaaataaaaagttcaaaagtc

SEQ ID NO: 410475 - DNA, 476 bp, Homo sapiens
tttatggaaacttcatgtactttttttgaacactttaggccttgccacctcattctttaatgaaaaaaatatgaatattacaaaggatttgttggatcttcttgtagaagctaaacaagaagtgccttcttggttggaaaatatggcttatgaacaccactacaagggtggcagtcgtggacgatctaaaaggtacacactgtttcgagccttcactcttgttattgcttactaggggcaagaagctttcagagttaacttaaaagtgttaaacagttattttcaacaataataaacattttgggcaagggatgattattagagagggtgacaaggaattaagtgttaggtccttactcctgagtcctttagaaacactgttagaacacattgggacattaatgggatggttcccattggaacataatggaattgaactgaaaaatcaaattgggaattgcagggtttaagcagta

SEQ ID NO: 410476 - DNA, 4418 bp, Homo sapiens
ctgtaggtccagtgtaagagttccgctattcggtctcacacctacagtggactacccgatttttcgcttctcttcagggatgagtcatgtggtggtgaaaaatgaccctgaactggaccagcagcttgctaatctggacctgaactctgaaaaacagagtggaggagcaagtacagcgagcaaagggcgctatatacctcctcacttaaggaacagagaagcatctaaaggattccatgataaagacagttcaggttggagttgcagcaaagataaggatgcatatagcagttttgggtctcgagattctagaggaaagcctggttatttcagtgaacgtggaagtggatcaaggggaagatttgatgatcgtggacggagtgactatgatggtattggcaatcgtgaaagacctggctttggcagatttgaacggagtggacatagtcgttggtgtgacaagtcagttgaagatgattggtcaaaaccacttccaccaagtgaacgcttggagcaagaactgttttctggaggaaacacggggattaactttgagaaatatgatgatataccagtagaggcaaccggcagtaactgtcctccacatattgagaattttagcgatattgacatgggagaaattatcatggggaacattgaacttactcgctatactcgtcctactccagtgcaaaaacatgccattcctattattaagggaaaaagagacttaatggcttgtgcccaaacaggatctgggaaaactgcagcatttcttttacccatactgagtcagatatatacagatggtccaggagaagctttgaaggctgtgaaggaaaatggaaggtatgggcgccgcaaacaatatccaatatccttggttttagccccaacaagagaattggctgtacagatctatgaggaagccagaaaattttcctaccgatctagagttcgtccttgtgtagtttatggtggtgctgatattggtcagcagattcgggacttagaacgtggatgccacttgttagtagccactccaggacgtctagtggatatgatggaaagaggaaagattggattagacttctgcaagtacttagtgttggatgaagctgataggatgctggatatgggatttgaacctcagatacgtcgtatagttgaacaagatactatgccaccaaagggcgttcgtcacaccatgatgtttagtgctacttttcctaaggaaatacagatgcttgctcgtgactttttggatgaatatatctttttggctgtaggcagagtaggctctacctctgagaacatcacacagaaagtagtttgggtggaagacttagataaacggtcatttctactggacattttaggtgcaacagggagtgattcacttactttagtgtttgtggagaccaaaaagggagcagattccctggaggatttcttataccatgaaggatatgcttgtactagtattcatggagaccggtcacagagagatcgagaggaggcccttcaccagtttcgctcaggaaaaagcccaattctagtggctacagctgtggcagcacgaggactagacatttcaaatgtgagacatgttatcaattttgatttgccaagtgatattgaagaatatgtgcatcgtattggccgtacaggacgtgtaggaaacctgggccttgccacctcattctttaatgaaaaaaatatgaatattacaaaggatttgttggatcttcttgtagaagctaaacaagaagtgccttcttggttggaaaatatggcttatgaacaccactacaagggtggcagtcgtggacgatctaaaagtaatagattcagtggaggatttggtgccagagactatcgacaaagtagtggttccagcagttctggctttggtgctagtcgcggaagcagcagccgcagtggtggaggtggttacggcaacagcagaggatttggtggaggtggctatggaggcttctacaatagtgatggatatggaggaaattataactcccagggggttgactggtggggcaactgaatctgctttgcagcaaagtcacccttacaaagaagctaatatggaaaccacatgtaacttagccagactatattgtgtagcttcaagaacttgcagtacattaccagctgtgattctcctgataattcaagggagctcaaagtcacaagaagaaaaatgaaaggaaaaaacagcagccctattcagaaattggtttgaagatgtaattgctctagtttggattaaactcttcccctcctgctttagtgccaccccaaactgcatttataattttgtgactgaggatcgtttgtttgttaacgtactgtgactttaactttagacaacttactactttgatgtcctgttggctcagtaatgctcacgataccaattgttttgacaaaataaatttactaaacttggcctaaaatcaaaccttggcacagaggtatgatacaactttaacaggagtcatcaattcatccataaatataaaaagggaaaaaaacttaaggcagtagtctgcattaggactgtttgagttttgcagacttggggttgggagaacatcttaaagcattaaagcatagttttttgtatggccaaccttactaaattaagttctgacttgctcactctatcctggataggcacttgggaacttacactctttaagccattccagtcatgatgaggtggaatgtatcagtataccaattaatatttttgaaagagctcttttaggttaatttaagtacagcaatttctcatgtaatgtttagggagtttattctaacctaggcaaacggcatgctatcacaagaaaggtttaaagctttgataaaatgggggagatttaatcagtttttttaatgcctgctataaaaatttgaaatattagaatggccgaccatggcagtgaccaggcctcactacaggcctggttggattctggtctttaatgcatgctagtgttgatgttttttggtcaagaacggtttaaacaggaaggattgtgcagcaggctttaatttaatgtagattcatactgctctgttaaagctgcattgaaatgttaaaatggcttacacttgcagactttgcaaatcttaagactaacaaatccttgaaatcacacagcttgcaaatacgtactaaactgcacaaggtgtgtgttctatatgtgcagttttagcgtattttagttgcataggtttccatggtatttatagtctcttgtgctaaatttggccaaagatgattgtccaccactaaaaatgcctctcccacttggaattctgtactgattttgtggccagatgcaatgatctttaaaaacaaatcttttcaatggcataagaagttgacaaaaatttcttaaagtgcaatagattttcaagtgtattgtgccttgttctaaaacttttaagtaggtgcacttgacagtattgaggtcatttgttaaggtgctatttcaattagtgtaggtttagactcttgtacatttctcccataactttttacaaagtattttgttgcacattcagagaattttatatatatatgtcttgtgtgggtgtcctcgaccttccaatcttatttcgtctcttggagattgttgaatgcagccagtgaagaagtagattcctaaattttattggggaccatggaatggtagttgagaagaaaactatttgcacacaacagattttagatactttttgctgctagttgtgtaatatttattgaacattttgacaaatatttatttttgtaagcctaaaaatgattctttgaaagtttaaagaaacttgaccaaaagacagtacaaaaaacactggcacttgaatgttgaatgtcaccgtatgtgaaataatatattttggggtagtgtgagcttttaatgttaagtctgttaaacttgagtcaaattaagcagacccggcattggcaatgtagctgtaattttctgacaaaatttaagacaaaattgtcaacttgaaactaaaacatgccaaggttttgatatacttgtcttaagatattaatgaaacacttctgaacactgataggaagtgtccacatccacaaagtttctcttgagttttgttatgtgttttgttgtgtttgattttcagtgattgtctggtatatttacagtcctcaaacatggttatttctgtcagtgacttaacattcggttttatcagccagcagtattcttcagtaaataaagaatggaattgctgaatgtaatcattgaacctcgagtcactgtaaaagttcagtaattgcttattgtattagttttagatgctggcactgcatgtgctctgtttattctgattttactaaaataaaaagttcaaaagtc

SEQ ID NO: 410477 - DNA, 4887 bp, Homo sapiens
agcggagaggggtctggagttcctaggtgaaccccagcagcctaaccctgtcaagtctgtcgagcctctggctggtcacacgtgctgcggaatccactcagctttcctcaggtgcagtcaggtccatcctgcagagggaccttctgcggacctgttctttcacctccctaacctgaagattgtattcaaaccaccgtggatcgctcacgtaaaatggtcactgcgcctaacacctgggatcccgtaacccttatctatcttggcttcagagagttttttgactagttccaactttgctgaagcttgtcaaagggatgagtcatgtggtggtgaaaaatgaccctgaactggaccagcagcttgctaatctggacctgaactctgaaaaacagagtggaggagcaagtacagcgagcaaagggcgctatatacctcctcacttaaggaacagagaagcatctaaaggattccatgataaagacagttcaggttggagttgcagcaaagataaggatgcatatagcagttttgggtctcgagattctagaggaaagcctggttatttcagtgaacgtggaagtggatcaaggggaagatttgatgatcgtggacggagtgactatgatggtattggcaatcgtgaaagacctggctttggcagatttgaacggagtggacatagtcgttggtgtgacaagtcagttgaagatgattggtcaaaaccacttccaccaagtgaacgcttggagcaagaactgttttctggaggaaacacggggattaactttgagaaatatgatgatataccagtagaggcaaccggcagtaactgtcctccacatattgagaattttagcgatattgacatgggagaaattatcatggggaacattgaacttactcgctatactcgtcctactccagtgcaaaaacatgccattcctattattaagggaaaaagagacttaatggcttgtgcccaaacaggatctgggaaaactgcagcatttcttttacccatactgagtcagatatatacagatggtccaggagaagctttgaaggctgtgaaggtaaaggttttgttataaaatcagacatttttgttttaaaaagctttgcaaagccctgttgacttttctaacggatgccagatacaccttattttcatttttttttttttacccctttcacccactgaaaataagtttgtagatgtaatctgcaaattataaagagaaagtgatgaatttttaaaaacaattgaagttttgggttatgaatttaaaattatatttatgttttaggaaaatggaaggtatgggcgccgcaaacaatatccaatatccttggttttagccccaacaagagaattggctgtacagatctatgaggaagccagaaaattttcctaccgatctagagttcgtccttgtgtagtttatggtggtgctgatattggtcagcagattcgggacttagaacgtggatgccacttgttagtagccactccaggacgtctagtggatatgatggaaagaggaaagattggattagacttctgcaagtacttagtgttggatgaagctgataggatgctggatatgggatttgaacctcagatacgtcgtatagttgaacaagatactatgccaccaaagggcgttcgtcacaccatgatgtttagtgctacttttcctaaggaaatacagatgcttgctcgtgactttttggatgaatatatctttttggctgtaggcagagtaggctctacctctgagaacatcacacagaaagtagtttgggtggaagacttagataaacggtcatttctactggacattttaggtgcaacagggagtgattcacttactttagtgtttgtggagaccaaaaagggagcagattccctggaggatttcttataccatgaaggatatgcttgtactagtattcatggagaccggtcacagagagatcgagaggaggcccttcaccagtttcgctcaggaaaaagcccaattctagtggctacagctgtggcagcacgaggactagacatttcaaatgtgagacatgttatcaattttgatttgccaagtgatattgaagaatatgtgcatcgtattggccgtacaggacgtgtaggaaacctgggccttgccacctcattctttaatgaaaaaaatatgaatattacaaaggatttgttggatcttcttgtagaagctaaacaagaagtgccttcttggttggaaaatatggcttatgaacaccactacaagggtggcagtcgtggacgatctaaaagtaatagattcagtggaggatttggtgccagagactatcgacaaagtagtggttccagcagttctggctttggtgctagtcgcggaagcagcagccgcagtggtggaggtggttacggcaacagcagaggatttggtggaggtggctatggaggcttctacaatagtgatggatatggaggaaattataactcccagggggttgactggtggggcaactgaatctgctttgcagcaaagtcacccttacaaagaagctaatatggaaaccacatgtaacttagccagactatattgtgtagcttcaagaacttgcagtacattaccagctgtgattctcctgataattcaagggagctcaaagtcacaagaagaaaaatgaaaggaaaaaacagcagccctattcagaaattggtttgaagatgtaattgctctagtttggattaaactcttcccctcctgctttagtgccaccccaaactgcatttataattttgtgactgaggatcgtttgtttgttaacgtactgtgactttaactttagacaacttactactttgatgtcctgttggctcagtaatgctcacgataccaattgttttgacaaaataaatttactaaacttggcctaaaatcaaaccttggcacagaggtatgatacaactttaacaggagtcatcaattcatccataaatataaaaagggaaaaaaacttaaggcagtagtctgcattaggactgtttgagttttgcagacttggggttgggagaacatcttaaagcattaaagcatagttttttgtatggccaaccttactaaattaagttctgacttgctcactctatcctggataggcacttgggaacttacactctttaagccattccagtcatgatgaggtggaatgtatcagtataccaattaatatttttgaaagagctcttttaggttaatttaagtacagcaatttctcatgtaatgtttagggagtttattctaacctaggcaaacggcatgctatcacaagaaaggtttaaagctttgataaaatgggggagatttaatcagtttttttaatgcctgctataaaaatttgaaatattagaatggccgaccatggcagtgaccaggcctcactacaggcctggttggattctggtctttaatgcatgctagtgttgatgttttttggtcaagaacggtttaaacaggaaggattgtgcagcaggctttaatttaatgtagattcatactgctctgttaaagctgcattgaaatgttaaaatggcttacacttgcagactttgcaaatcttaagactaacaaatccttgaaatcacacagcttgcaaatacgtactaaactgcacaaggtgtgtgttctatatgtgcagttttagcgtattttagttgcataggtttccatggtatttatagtctcttgtgctaaatttggccaaagatgattgtccaccactaaaaatgcctctcccacttggaattctgtactgattttgtggccagatgcaatgatctttaaaaacaaatcttttcaatggcataagaagttgacaaaaatttcttaaagtgcaatagattttcaagtgtattgtgccttgttctaaaacttttaagtaggtgcacttgacagtattgaggtcatttgttaaggtgctatttcaattagtgtaggtttagactcttgtacatttctcccataactttttacaaagtattttgttgcacattcagagaattttatatatatatgtcttgtgtgggtgtcctcgaccttccaatcttatttcgtctcttggagattgttgaatgcagccagtgaagaagtagattcctaaattttattggggaccatggaatggtagttgagaagaaaactatttgcacacaacagattttagatactttttgctgctagttgtgtaatatttattgaacattttgacaaatatttatttttgtaagcctaaaaatgattctttgaaagtttaaagaaacttgaccaaaagacagtacaaaaaacactggcacttgaatgttgaatgtcaccgtatgtgaaataatatattttggggtagtgtgagcttttaatgttaagtctgttaaacttgagtcaaattaagcagacccggcattggcaatgtagctgtaattttctgacaaaatttaagacaaaattgtcaacttgaaactaaaacatgccaaggttttgatatacttgtcttaagatattaatgaaacacttctgaacactgataggaagtgtccacatccacaaagtttctcttgagttttgttatgtgttttgttgtgtttgattttcagtgattgtctggtatatttacagtcctcaaacatggttatttctgtcagtgacttaacattcggttttatcagccagcagtattcttcagtaaataaagaatggaattgctgaatgtaatcattgaacctcgagtcactgtaaaagttcagtaattgcttattgtattagttttagatgctggcactgcatgtgctctgtttattctgattttactaaaataaaaagttcaaaagtc

SEQ ID NO: 410478 - DNA, 2381 bp, Homo sapiens
  misc_feature (2370)..(2370): n is a, c, g, or t
ctgtaggtccagtgtaagagttccgctattcggtctcacacctacagtggactacccgatttttcgcttctcttcagggatgagtcatgtggtggtgaaaaatgaccctgaactggaccagcagcttgctaatctggacctgaactctgaaaaacagagtggaggagcaagtacagcgagcaaagggcgctatatacctcctcacttaaggaacagagaagcatctaaaggattccatgataaagacagttcaggttggagttgcagcaaagataaggatgcatatagcagttttgggtctcgagattctagaggaaagcctggttatttcagtgaacgtggaagtggatcaaggggaagatttgatgatcgtggacggagtgactatgatggtattggcaatcgtgaaagacctggctttggcagatttgaacggagtggacatagtcgttggtgtgacaagtcagttgaagatgattggtcaaaaccacttccaccaagtgaacgcttggagcaagaactgttttctggaggaaacacggggattaactttgagaaatatgatgatataccagtagaggcaaccggcagtaactgtcctccacatattgagaattttagcgatattgacatgggagaaattatcatggggaacattgaacttactcgctatactcgtcctactccagtgcaaaaacatgccattcctattattaagggaaaaagagacttaatggcttgtgcccaaacaggatctgggaaaactgcagcatttcttttacccatactgagtcagatatatacagatggtccaggagaagctttgaaggctgtgaaggtaaaggttttgttataaaatcagacatttttgttttaaaaagctttgcaaagccctgttgacttttctaacggatgccagatacaccttattttcatttttttttttttacccctttcacccactgaaaataagtttgtagatgtaatctgcaaattataaagagaaagtgatgaatttttaaaaacaattgaagttttgggttatgaatttaaaattatatttatgttttaggaaaatggaaggtatgggcgccgcaaacaatatccaatatccttggttttagccccaacaagagaattggctgtacagatctatgaggaagccagaaaattttcctaccgatctagagttcgtccttgtgtagtttatggtggtgctgatattggtcagcagattcgggacttagaacgtggatgccacttgttagtagccactccaggacgtctagtggatatgatggaaagaggaaagattggattagacttctgcaagtacttagtgttggatgaagctgataggatgctggatatgggatttgaacctcagatacgtcgtatagttgaacaagatactatgccaccaaagggcgttcgtcacaccatgatgtttagtgctacttttcctaaggaaatacagatgcttgctcgtgactttttggatgaatatatctttttggctgtaggcagagtaggctctacctctgagaacatcacacagaaagtagtttgggtggaagacttagataaacggtcatttctactggacattttaggtgcaacagggagtgattcacttactttagtgtttgtggagaccaaaaagggagcagattccctggaggatttcttataccatgaaggatatgcttgtactagtattcatggagaccggtcacagagagatcgagaggaggcccttcaccagtttcgctcaggaaaaagcccaattctagtggctacagctgtggcagcacgaggactagacatttcaaatgtgagacatgttatcaattttgatttgccaagtgatattgaagaatatgtgcatcgtattggccgtacaggacgtgtaggaaacctgggccttgccacctcattctttaatgaaaaaaatatgaatattacaaaggatttgttggatcttcttgtagaagctaaacaagaagtgccttcttggttggaaaatatggcttatgaacaccactacaagggtggcagtcgtggacgatctaaaagtaatagattcagtggaggatttggtgccagagactatcgacaaagtagtggttccagcagttctggctttggtgctagtcgcggaagcagcagccgcagtggtggaggtggttacggcaacagcagaggatttggtggaggtggctatggaggcttctacaatagtgatggatatggaggaaattataactcccagggggttgactggtggggcaactgaatctgcatcatagaaagttctagaaaacaggaccactgtcacttcatgactacagttcttctccttccacttgngaccgaatatt

SEQ ID NO: 410479 - DNA, 502 bp, Homo sapiens
cattcatgttcagcaccagcatgaacctggcacagaggagatgctccttaaaacttcactcattcaaaccgaatcactgggaagtttgaaggagtcattgcttccaggcttttttcttgaatctcattagaaaaaaaaaaaaaatctctttggtatttggttgccacattcttgtatcaacaccaaggttcgtcggaagaaagatggtcatggcgggcaggaaaggtgatggtgagcaagtggtgttattgccattacaataacttaaaaggagaaagtatttttaaaaattacatatatatatatttgagatggagtctcactctgtcacccaggctggagtgcagtggcaccgtgtcggctcattgcaacctccgtctcccgggttcacgcaattctcctgcctcagcctcctgagtagctgggattacaggcgcccgccaccaagccctgctagtttttatatttttagtagagatgaggtttcaccatgttggccagg

SEQ ID NO: 410480 - DNA, 334 bp, Homo sapiens
gtgaaaagcaatcatgccttcattcattcaacaaagaactataatgaacatctatttcctgaggactccactttacgtctttaaattttatgttcctggtgaactacagagttgggatttttatccatctcttcctgatttctaaaatgtgtgctttcaactacatccctctgaataaatagtatacaatatataatacaaattataaaagaggcacaaagaagcatatagaaacactgaagtgggagaagtgattttttcctggagggtttagtaaaggcttcacagaagaggtgacatttgagtttagcgacagtgcgacagaaaaaataac

SEQ ID NO: 410481 - DNA, 329 bp, Homo sapiens
ttcttttttctgtggtgcttttgccttctaacatagtataaattttacatatttattatgtttattttcttctcactatgatataagctccatgagggtagaaatatttgcttgttttgttcactgtctccaagcatttagaacaacagctggcatatagcaatcatacaaaaaatatttgtaattgaaggtgaagagtcttctggtctttatcctaggaggttacttatgtctgggctgcctctgaaggagagattaccatcatgatttgaagttaatccacaagtcatgaggagataataaatacaacacacaggaaaacaaaacaa

SEQ ID NO: 410482 - DNA, 277 bp, Homo sapiens
ctgtaatctcagcactttagaaggccaaggagggaggatcgcttgaggccaggagtttgagaccagcctgagcaacatagcaagaccctgtctctacaaaaaatttaaaaattagggcatggtggcgtgcacctatgtggccccagctacttgggaggctaaggtggaaggatcagttgagcctgggaggttaaattgtagtgagctgtgattgtgctgctgcactccagcctgacacagcgatgagactctgtgtcaaaaaaatatatatataaag

SEQ ID NO: 410483 - DNA, 536 bp, Homo sapiens
gacatactgattacatatctaattttctgtcactatctgcatgacatcacatatgtcactgtggttttccagattactctcgaccctgtaaagaaatattttccctgatgactcagtttgaattttttgttggcacgggtttcacttccttacttcctgttggtctcactccttagatctttgttggggtcttcagtgcctcccaaacccccaatctacaggaatttttccagactgcagagtcttctggcatttctccctcctgatcactcaaaatgatataaagcctcaccaaatgatctggcattgctgcttctggagatagctatagccgagctccccacaccgcaaccccttgatctttttcactgtgttcaaaactaggctgaagtgaaatcatcacaactgctctttcaagcttaaggaatttgataaatgaagttgtgtggggtcctggcaggcaatacacttgagcaaagcacagtgatcatctgcggaccactctttatccctttattgtagacatgtattcaagt

SEQ ID NO: 410484 - DNA, 848 bp, Homo sapiens
  misc_feature (32)..(32): n is a, c, g, or t
  misc_feature (34)..(34): n is a, c, g, or t
  misc_feature (37)..(37): n is a, c, g, or t
ggctgtactagaggaccccgaagcgcacgaangngcnctcgtagaccaggtacctgcggcaacaccagtcgctgcttttaaataaggggaggctggtgacggtgatgccacttagcaagatggagtcctgatctggggatgggggctgtgtctaaccttgctgtgccctgaggggcttaactgctttttctgggagatgttagtaggggaagctcctagcccttaggaccacacataccctaggcagggggtgtggagctggccgtgccagaaggggccaggcagcctgcactctgggtggtgtctcggcttgcgtgggtgagggctcccattggcccacctgcctgcaatgaagggcctcgtcacacccgtgaggccccccaggggctccggttccctgccctgaagctgtgctccgggacggtcaaggttcggccaccaaggctcaggctgctcctcgtggatggaggtggccccagaaagggcctgtgcagactctgtctccccggggcctactaactccctggggtgctccacgaaggcctagacccccctacacctacctcagtctgttccctgactgccaccgcctagaaaggaaagcaatgccctgtggaccttgcagtgctagagaaggtggccgtggcaagggaggagctgctcccatggcagagcattcctgcagatttgcctggatttgcccttcctggggttccctctaggcttcctccccacccggccttcctgggaacaagtcccgcccacctggcttctcactcagcttcctcagcctggctcatgggcgctaggttgaactccaaagagaatgctgagaaagaaagttaaaa

SEQ ID NO: 410485 - DNA, 899 bp, Homo sapiens
ctttctagggagatggaaccctagaagctaagcggccagagcttcctgcccttcagctggaaggagccggaaggagctggaaggaagggccaggccctcgccctggctgcagccagatcccctgagagccgacagccccgttcctgctgcccccacaagcgtgcacccaggcgactgtgctgtcagcggcccccggggaggtggacggtgggagagggatgcctgcgtcttcgtagaccaggtacctgcggcaacaccagtcgctgcttttaaataaggggaggctggtgacggtgatgccacttagcaagatggagtcctgatctggggatgggggctgtgtctaaccttgctgtgccctgaggggcttaactgctttttctgggagatgttagtaggggaagctcctagcccttaggaccacacataccctaggcagggggtgtggagctggccgtgccagaaggggccaggcagcctgcactctgggtggtgtctcggcttgcgtgggtgagggctcccattggcccacctgcctgcaatgaagggcctcgtcacacccgtgaggccccccaggggctccggttccctgccctgaagctgtgctccgggacggtcaaggttcggccaccaaggctcaggctgctcctcgtggatggaggtggccccagaaagggcctgtgcagactctgtctccccggggcctactaactccctggggtgctccacgaaggcctagacccccctacacctacctcagtctgttccctgactgccaccgcctagaaaggaaagcaatgccctgtggaccttgcagtgctagagaaggtggccgtggcaagggaggagctgctcccatggcagagcattcctgcagatttgcctggatttgcccttcc

SEQ ID NO: 410486 - DNA, 432 bp, Homo sapiens
atcctatcactcttaaatatggaagtttgcaaacttgtgctttttttttttagtcagtcatctctatattttccataagtgatattaataaatttccaaaataatgtattacaaccattgatatttaaatataaattctatttcctcacttcaaatccttaggatacaacgttcttcaggttaattgatttcaatctctgtcttcttttacacacacacacacacacacacacacacactatatatatatatatatatatattaaaatgctctcaggaaagcaaaagaggaaattttccatcaaacacatgtaaggcttcaaggaaaccttgaagttggaattttgatgttatctctgcattgtttccatttaggaacttcagtgatttaatttaattaatttatttatttttgagatggagtctcacactg

SEQ ID NO: 410487 - DNA, 2735 bp, Homo sapiens
tgaacaacctcagtaaaattcatcagtgctggtaaatagtttgctgtagtggaaagctcataacctttggattcaaatgatcctagtttctgtaccatttattagcgttgtgacctaggacaagtacctcacttctctgagcctgtttcctcctctgtaaaataatgtctacttcacaaggctgtttcaaaggttaaaaaagatagcatatgtaaactgtcttagctcagcgcttgacatttcctaagtgtgccataaatattaatctctttccttactcccagctccaatacagcgtaacagtgctttaaaatgtatgtccttcatttctccttcatttctcagtcacctttgtctcttccctagggcatatccccaaattcttaaacaaaaaaaaatgatttttttccccttcatcaaacttttcactggctcccttagcacccagtagaaggtcccaactccttacagagtctgggttttcatgtccctgtttgcttacacagcttaatcttttgccactttccccctcacattgattaaggtagccaagtttaactatttacacaactattcacacaagttattctctgggcctgcagcagaaacatgattaacaattttaatgcccagagtaaacaacagaaatttttcttaaattaaaggaatagtgtgaaaatgctgtaagtacagaaaatgcaacctccattccagtagaacaatttcctttgccttgtccttggctctccaaaactgttcatttattgtggtgtcttttagattttagtgccctgggacaaagatctaatttccccaccctacttttgactctatcctggactacctttcctcacctctatctctctcaaccagactaactctttattccttagacttgatgatgcatccctctttagagatccaaagacaccccaagcatccccctctctcagcaataatcacattgtatagcagtgtttttcaaagtgtggtcctcacaccgcctgtgttagaatcacctttagtgtttgttaaaagaattgattttgggttcccactcctgacctaaccagaatatctgagaacataggcaggaatttacatttttgacaagctcctcatgattctgatgcaccaaaaattttaatgaataatcatcttccctactagactgaacaccttgagaggaaggactgtgtcttttattgttgttatattgttaatacctggcacagtgcttggaacattagcttggctaatgtttattgaatgaatgtatgaatgaaaaaatgcattatgaaagtttcctcttgtactctcatgttcgtagtgatgtttgttacttcctgggcagaaaagcttggttactactccatttgagctgtattaattctattttgcagagatatcaaggctcctacataataaatgatcattgtcctcctcaaaaactctttggcagttatcttggggaaatgtctttggagcatatggcaccattgttttcagtaacatttcagtcttgtcaaactttgttgtttgaaggtggatttacatttcggttatagccaaaaatcactcaaagctaagcctacttaaaaaagtggggaattaaactgggtttggagtaagcaatgaagtttgactctgaagtcccaaattctgagtcaaacagtgacaaatgacttctaagatacaacatggtgacaaagtacttagtgggggtgcgatgggccccagatatttacttcagttaacttggcttttatagaatcctggcaatgccatggaccttaagagaagtaattggctacctctagctaaacccagctggacaaagagaataggacttgtatttaacattttcaaagaaggtgactgcataagcttttgttgttgttgctctactcaacctgttctccacaactgtttctaccagaagattattttatgtctgcaatttatgcttgtttccactttttatattgtcttattgaagaaagcacaaaaataatcaaaaataaagtaaaacctgttttgagagtatgaaagaaattttaatgccacattgaggttctggctacttgtaagtaagagtaactgcatctggatgtgtttttattatacaattctatgtgtatctttagatgcagtgaaattcagattgcagcaaaatcacttatctgttcttttcggctaaaacactctaggtgaattttctaaacttccatggtttacatatttatatatgactaccaagatggagcaatccacggatggacttttgaataaactcaaatatttgatactgcttcctccaaggaatggagagtgtcaggcaggtaggtaagaaccactcctacacttatttctagctcctgaagccaactgcagccttggagccaatggctgtatttggctgtgtgttacaggttggccaaactgattgccatcaggtcagacaaaactgccttttatggtgtagtctgccagcttcagacatatgctgtattgttgttattggctagactatttattagactattgttggactattttttatcaaatgctttaccccacgcctgtttgtattgggagctctggaccaatagtgtctctcctagtgacagaaatatgagcatctgtggattacacagcctcatccctctctacaatattccagcccatccaaaatgctatattatgaattaaataaatatatatgtattcatgaa

SEQ ID NO: 410488 - DNA, 420 bp, Homo sapiens
tttttttttttgagatggaatcttactctgttgcccaggctggagtgtagtggcacaatctcagctcactgcaacctctcccgcccaggttcaagtgattccctgcctcagcctcccgagtagctgggattacagggacacaccaccatgcccggcaaatttttgtgtttttagtagagacaaggtttcaccatgttggcctggatggtctcaatctcctaacctcgtgatccgcctgccttggccccctaaaatgctgggattacaggcatgagccagcgcgcccagccttgctggcttttataattttcttttcgtctttggtttttagcaattttactatgatgtgcctcgatgtagctttcttcgtatttatcctttcggggtttgcagtacttctaacatacgtgacttgatgtc

SEQ ID NO: 410489 - DNA, 682 bp, Homo sapiens
tcacagtatgagctttagtccagctcaaaggagaaaaagaactccttgtgttaaggatttctttttttaagtatattgattaacggttttctccatgttggatgccaagagaaatgtgagcaaagacatttttctccaacttggcaaaggtactacaaaaatggtcaggttgactgaagatgaccccaagtccatcctgccaatcactatcataaatacaaccacagattcacaaaataaattatcagattatttccatacaaaccttaagcccacttcagaattgcctgagttgctggtgtacagctggtctcatgacccaactccccgcagtcctagaactcggctcaaaaggaaggtggctgctggttttactcccctgttgaccatcctgggttgctgacatgctcagccaaccccaccctgcctgctaaggactatgcaaaccacagtctgaagctggggggctcctgatgttaattcaaatttaaaactaaagtcagttaaaggaagaaaggcagtagcctgccttttcttctgacaaagctcaaaatcaatgtgatgaaagctcactggaaatttcaattgcctagtctaagtatttacttaaacttaaaacccagaaatttggacttaagtgtaaccaaaagaaaaaagtatttggttgggttggagaatgaaa

SEQ ID NO: 410490 - DNA, 660 bp, Homo sapiens
gcctgcgtttcctggcttgaatggagagtgtctcttgactgtgctgactttcggggattcttttcttaacagcagatagcagtggggtcagaaagggtgacctgcagtccacgttgctggaagggcatggcacagctccacctgacctggatctctctgctattaatgacaaaagcatcgtcaaaaagacgccacagttagcaaaaacaatatcaaagaaacctgagtcaacatcattttctgcccctcggaaaaagagcccggatttatctgaagcaatggaaatgatggagtctcagacactactgctgacgctactatccgtaaagatggagaacaatcttgctgagtttgaaagaagggcagaaaagaatttattaataatgtgtaaggagaaggagaagctacagaaaaaggcccacgagctgaagcgcaggcttctcctctctcagaggaagcgggagctggcagatgtcctggatgcccagatcgagatgctcagccccttcgaggcagtggccacacgcttcaaggagcaatacaggacattcgccacggccctggacactaccaggcacgagctgcccgtgaggtccatccacctggagggagatgggcagcagctcttaggtaggaaacggggcgtcccagtgcgtgtgc

SEQ ID NO: 410491 - DNA, 1414 bp, Homo sapiens
gcgagaccaagtgcgaggggaggacaggcgaagcgcgcgtctggggccgcgctctccacacttagccggcgctgcctcacgcctcgcagccacccctcctgcgtctccacaaatggtccgacccgcaagcaagggggcgggtccggctttgaaaagccggcgggtcgggccttgaggtggaaggcgggaaaatggcggattcctcggggcgaggcgctgggaagcctgcaaccggccccacaaattctagcagtgccaagaagaaggataaaagagttcaaggtggaagagtgattgagtcccggtatctgcagtatgaaaagaagacaacccaaaaggctcctgcaggagatgggtcacagacccgagggaagatgtctgaaggtggaaggaaatccagcctgctccagaaaagcaaagcagatagcagtggggtcagaaagggtgacctgcagtccacgttgctggaagggcatggcacagctccacctgacctggatctctctgctattaatgacaaaagcatcgtcaaaaagacgccacagttagcaaaaacaatatcaaagaaacctgagtcaacatcattttctgcccctcggaaaaagagcccggatttatctgaagcaatggaaatgatggagtctcagacactactgctgacgctactatccgtaaagatggagaacaatcttgctgagtttgaaagaagggcagaaaagaatttattaataatgtgtaaggagaaggagaagctacagaaaaaggcccacgagctgaagcgcaggcttctcctctctcagaggaagcgggagctggcagatgtcctggatgcccaggtcagttgtaagtgacactctacgccctgcagcatgaactggtgaccactcagcgcctcctgggagaacttgatgttggtgattcggaagaaaatgtgcaggtgctggacttactgagcgaactcaaggacgtgacggcgaaaaaggaccttgagctccgaaggagctttgcccaggtgctggaactctccgcagaggcaagcaaagaggcagccttggcaaaccaggaagtctgggaagagacccagggcatggcgccccccagccggtggtatttcaatcaagacagtgcctgcagagaatctgggggagcacccaagaacacgcccctgtctgaggacgacaacccgggtgcctcgtcagcccccgctcaggccacgttcatcagcccaagcgaagatttttcttcaagcagccaggcagaagtcccgccctctctctctcgttcagggagggacttgtcatgactcatggttacattcaggatacttgagcactttatatactaccgtagcactgtagctattttttatgtgataatcttgtttgataaaaaagtaaacctgttttgcaattga

SEQ ID NO: 410492 - DNA, 320 bp, Homo sapiens
catcatgacagaagtctgtcggccgctccacttgtgtgtgccttgcgtggggcaccttgccatccatcgcccaccatccctcttcccctccacgccctgcagcatgaactggtgaccactcagcgcctcctgggagaacttgatgttggtgattcggaagaaaatgtgcaggtgctggacttactgagcgaactcaaggacgtgacggcgaaaaaggaccttgagctccgaaggtacctcggaaaatgctttaagaaagaggtggcaccctgtttgctcagggctgttggtggctgcactgttggggtggtgccgagttc

SEQ ID NO: 410493 - DNA, 1566 bp, Homo sapiens
gcgagaccaagtgcgaggggaggacaggcgaagcgcgcgtctggggccgcgctctccacacttagccggcgctgcctcacgcctcgcagccacccctcctgcgtctccacaaatggtccgacccgcaagcaagggggcgggtccggctttgaaaagccggcgggtcgggccttgaggtggaaggcgggaaaatggcggattcctcggggcgaggcgctgggaagcctgcaaccggccccacaaattctagcagtgccaagaagaaggataaaagagttcaaggtggaagagtgattgagtcccggtatctgcagtatgaaaagaagacaacccaaaaggctcctgcaggagatgggtcacagacccgagggaagatgtctgaaggtggaaggaaatccagcctgctccagaaaagcaaagcagatagcagtggggtcagaaagggtgacctgcagtccacgttgctggaagggcatggcacagctccacctgacctggatctctctgctattaatgacaaaagcatcgtcaaaaagacgccacagttagcaaaaacaatatcaaagaaacctgagtcaacatcattttctgcccctcggaaaaagagcccggatttatctgaagcaatggaaatgatggagtctcagacactactgctgacgctactatccgtaaagatggagaacaatcttgctgagtttgaaagaagggcagaaaagaatttattaataatgtgtaaggagaaggagaagctacagaaaaaggcccacgagctgaagcgcaggcttctcctctctcagaggaagcgggagctggcagatgtcctggatgcccagatcgagatgctcagccccttcgaggcagtggccacacgcttcaaggagcaatacaggacattcgccacggccctggacactaccaggcacgagctgcccgtgaggtccatccacctggagggagatgggcagcagctcttagacgccctgcagcatgaactggtgaccactcagcgcctcctgggagaacttgatgttggtgattcggaagaaaatgtgcaggtgctggacttactgagcgaactcaaggacgtgacggcgaaaaaggaccttgagctccgaaggagctttgcccaggtgctggaactctccgcagaggcaagcaaagaggcagccttggcaaaccaggaagtctgggaagagacccagggcatggcgccccccagccggtggtatttcaatcaagacagtgcctgcagagaatctgggggagcacccaagaacacgcccctgtctgaggacgacaacccgggtgcctcgtcagcccccgctcaggccacgttcatcagcccaagcgaagatttttcttcaagcagccaggcagaagtcccgccctctctctctcgttcagggagggacttgtcatgactcatggttacattcaggatacttgagcactttatatactaccgtagcactgtagctattttttatgtgataatcttgtttgataaaaaagtaaacctgttttgcaattgaagcctccattttctatgaaggggccagttgg

SEQ ID NO: 410494 - DNA, 1535 bp, Homo sapiens
gcgagaccaagtgcgaggggaggacaggcgaagcgcgcgtctggggccgcgctctccacacttagccggcgctgcctcacgcctcgcagccacccctcctgcgtctccacaaatggtccgacccgcaagcaagggggcgggtccggctttgaaaagccggcgggtcgggccttgaggtggaaggcgggaaaatggcggattcctcggggcgaggcgctgggaagcctgcaaccggccccacaaattctagcagtgccaagaagaaggataaaagagttcaaggtggaagagtgattgagtcccggtatctgcagtatgaaaagaagacaacccaaaaggctcctgcaggagatgggtcacagacccgagggaagatgtctgaaggtggaaggaaatccagcctgctccagaaaagcaaagcagatagcagtggggtcagaaagggtgacctgcagtccacgttgctggaagggcatggcacagctccacctgacctggatctctctgctattaatgacaaaagcatcgtcaaaaagacgccacagttagcaaaaacaatatcaaagaaacctgagtcaacatcattttctgcccctcggaaaaagagcccggatttatctgaagcaatggaaatgatggagtctcagacactactgctgacgctactatccgtaaagatggagaacaatcttgctgagtttgaaagaagggcagaaaagaatttattaataatgtgtaaggagaaggagaagctacagaaaaaggcccacgagctgaagcgcaggcttctcctctctcagaggaagcgggagctggcagatgtcctggatgcccagatcgagatgctcagccccttcgaggcagtggccacacgcttcaaggagcaatacaggacattcgccacggccctggacactaccaggcacgagctgcccgtgaggtccatccacctggagggagatgggcagcagctcttagacgccctgcagcatgaactggtgaccactcagcgcctcctgggagaacttgatgttggtgattcggaagaaaatgtgcaggtgctggacttactgagcgaactcaaggacgtgacggcgaaaaaggaccttgagctccgaaggagctttgcccaggtgctggaactctccgcagaggcaagcaaagaggcagccttggcaaaccaggaagtctgggaagagacccagggcatggcgccccccagccggtggtatttcaatcaagacagtgcctgcagagaatctgggggagcacccaagaacacgcccctgtctgaggacgacaacccgggtgcctcgtcagcccccgctcaggccacgttcatcagcccaagcgaagatttttcttcaagcagccaggcagaagtcccgccctctctctctcgttcagggagggacttgtcatgactcatggttacattcaggatacttgagcactttatatactaccgtagcactgtagctattttttatgtgataatcttgtttgataaaaaagtaaacctgttttgcaattga

SEQ ID NO: 410495 - DNA, 918 bp, Homo sapiens
aaaggtgagcctgctggaccggggagctttcctcaaggcctccgcctggctatgatggcgttagggttgaggggaagcttcatccaaaatgcacagtacttggatgtcaagatgatgttgctgctctcaggatgagtcactctccaccactgacttcctttgatgttctgagctcagcctggagtctgacctgggactatagcacttgttctcccaaggtaaggctggcggccaaacccagctgcgcacacctgaacctgctccttggcagagatgaagggcgtcatgtttcgtagccactcaacacccatggacaatttggctccttgtaaagacttagtcatgcctttgaactgacttacttgaaatataattgctcctattttgctccaaagaccagtggcatgatgggttagagttatttgtatttattgagattgttgtaattagcaatctcagggctcagtctaactgcattatccatgctggaaaacttaaaaaaaaaatacagtccttcatcttcagttttccaatggtcgccagttatacacagctaatctttgcagtgaaagttgtctttggagaatgtgctttcttggtcccgggtggtcctggtcttgggctggaatctacgtgagctgctttgaagtaagctgacaatacacaattattaaggctattttgacctgcaagtatggtttcttaaaaaggaacaattaaataccatgtagcagttatttagactttagcattgactaaggaaaggagaaaatggaagaagaaccccctcctgcttagatgcagtcattttttaaaaaaataatcttttggggaataaacttaaccaaggaggtgagggacttgtaaacaaaatgttaaaactgcactgaagactagaaaatgttgatgaaagctgtt

SEQ ID NO: 410496 - DNA, 371 bp, Homo sapiens
ttttttttttttttttgaggcagagtctcactctgtcacccaggctggagtgcagtggcgtgatcttggcttactgcaagctctacctcccagttcatgccattttcctgcctcagcctcccgagtagctgggactacaggcacccgccaccatgcccagctaattttttgtattcttagtagagacggggtttcaccatgttaggatggtctcgatctcctggcctcgtgatctgccctccttagcctcccaaagtgctgggattacaggcgtgagccaccatctttttaatctccactgtgaactcatagttttttttttcaacttaatgcattataatcaacatcatttgtcccaaatttgggaaatg

SEQ ID NO: 410497 - DNA, 1088 bp, Homo sapiens
gcgacaggagatcctgtaggctatggcaaagactttagatttttctgaagtctctacaaaaatcctcaacaaaatattggcaaattgaatgcaacaatatgtaaaaggataatataaccaaatggagtgtaccctgggaatgcaaggctagttcaattagttcaccatattaacagactaaagaagaaaaggccacaccatcatctcaacagatatagacaaatattaagcagccataataaaaactctcagcaaattggaacagaagggaatttccttaacctcatgaacagaaaccacataaaaacctacatctaacatcaaacttaagggtgaaaggctgaattccttccccctcagattgtaaaacaggcaagaatgcccactctcctgactccttttcaacattgtactaaaagttctgggcactgccttaaggcaagaaaatgaaatagcatacagattgaaaaagaagaaataaaattgtccctattcacagatgacatgagtgtcaatgtagaaaatcccatggcatctgtaaaaacaatttcacagaactagctaatgactttagcaaggtcataggatacaaagtcagtgtataaaaatcaactgaaaagtgaaatatgtgcaggattttatgctgaaaattatgaaatactgatgaagtaaatcacagaagatctaagcacatggacagacctactgagttcattcatgggttggaagactcaacattgttaaatgatgtcagtccccacaaaattgatctctagattcaatgcagtccccgtaggaattctttaggtatcaggagtcttatttgaaaacttacatggaaatgcaaagaacaagaataagaatagctaaaacaattttgaaaaagaagaaccaagttggagggctaacacttgctgattttaagatataaacctgtaataccacagtgtggcattggccagacccacacagatatagttaattgatttttgacaaacatgcaaaggcagttcagtggagaaaagactgtcttttcaataaatggtactgcactccagcctgggtaacagagtgagactcttgtctca

SEQ ID NO: 410498 - DNA, 1126 bp, Homo sapiens
gcgacaggagatcctgtaggctatggcaaagactttagatttttctgaagtctctacaaaaatcctcaacaaaatattggcaaattgaatgcaacaatatgtaaaaggataatataaccaaatggagtgtaccctgggaatgcaaggctagttcaattagttcaccatattaacagactaaagaagaaaaggccacaccatcatctcaacagatatagacaaatattaagcagccataataaaaactctcagcaaattggaacagaagggaatttccttaacctcatgaacagaaaccacataaaaacctacatctaacatcaaacttaagggtgaaaggctgaattccttccccctcagattgtaaaacaggcaagaatgcccactctcctgactccttttcaacattgtactaaaagttctgggcactgccttaaggcaagaaaatgaaatagcatacagattgaaaaagaagaaataaaattgtccctattcacagatgacatgagtgtcaatgtagaaaatcccatggcatctgtaaaaacaatttcacagaactagctaatgactttagcaaggtcataggatacaaagtcagtgtataaaaatcaactgaaaagtgaaatatgtgcaggattttatgctgaaaattatgaaatactgatgaagtaaatcacagaagatctaagcacatggacagacctactgagttcattcatgggttggaagactcaacattgttaaatgatgtcagtccccacaaaattgatctctagattcaatgcagtccccgtaggaattctttaggtatcaggagtcttatttgaaaacttacatggaaatgcaaagaacaagaataagaatagctaaaacaattttgaaaaagaagaaccaagttggagggctaacacttgctgattttaagatataaacctgtaataccacagtgtggcattggccagacccacacagatatagttaattgatttttgacaaacatgcaaaggcagttcagtggagaaaagactgtcttttcaataaatggtactgcagtcattagacagtttttttttttttttttagagtcttgctgtgccacccactgcacaccaccaccaccctaggt

SEQ ID NO: 410499 - DNA, 891 bp, Homo sapiens
  misc_feature (163)..(163): n is a, c, g, or t
cgggccaagaggtacaggcctgacattattgttcgaaattgtggaagatacaaaaagatgtagtgaaagcaaggaaagagcttggggcggttaatttaagaacggggtttgggggaatttaaaaggaaaccctttccaaaggaaaagaatgtggaccgggttnaagttgctcttaaaagaaaaaactccactggaaaccattcaccatgtgtgattgtcttctgttatcatttgtcttacaggcggctattgcagacggctaatttatgcttaacttaggaagagataaggcaagagctagatttttttcatgtgatcttttccaagcttcaacttaacttaactacatttctctgtatgatgatgtctcttacttctacaggttccttgagcaccaaagatgattcataactctgtataggtgacagctgcttataaaagcatcttagcagataagcctattaaaattgtgcttttgtaacaatgttgtggttgctagaataaataccattaacaaatgccttttgagtatgcttgatagtgcttttgttttggattcactttttatgctttaaccttcatttgcctctagaaacccaaaacacaataaagtacagaataagaccttagtaataaaattcagaattttcttaaattgcatgtctgagtgttctaaaaatttttcaacatttccctttcacaagtgacttattcccccagttaagttattcacggtttcaccccacagcgtgaggggcagatagaaaaaaaaaaaaggaaacatcactaccgaattgaaagtagggtataatactaagttcacaggaaatcaagaaaaaatgacataactgaaatctctcttttggtaaaatctatttcaggtgcatacca

SEQ ID NO: 410500 - DNA, 474 bp, Homo sapiens
ctcttttccatggttttattaatttatttttttcatcacagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggtgaatgagacatttggggcttttcttccaggatctcttcagcccccacatcttctctgctgattataattttggggggttggtagagtttggttctttcctggctgccactggcaaggcaggacacctttattgctgtaccttgtgttggccaatcaagtcccctatgaggaaccaagaactgtacacattactcttggatttgaatagcgttaggtcta

SEQ ID NO: 410501 - DNA, 434 bp, Homo sapiens
cgagctcggtacccccacctgggccaggcccaggaatccaagcctcccaagctcttggggaccaggcctgggggccaccacggctgggcaaggttcattcctggccaccagctactctagaggggctgggcccccacccaggagacctctcacacaccgtgaaggctgggacagagctgcacgcttgggggtgcctgaaggtccagaaagagctgccggcgtggggtaggaggtccccccggataaacaactttgttgtcaactattgatttttcccccccgagctcaggaatggttatagctttctttcatctccagtttttttttctttttttgaaacagggtctcattctgttgcccaagagaaatgaagcacatgtccacagagactggtacacaatgttcacagcatctttatccgtaacggccaccac

SEQ ID NO: 410502 - DNA, 326 bp, Homo sapiens
tgatctcaggatcccaagtacccagcagagaaggctggccttcaagatggagacagagttcttaggatcaatggtgtctttgtggacaaagaagaacatatgcaggtgaatgagacatttggggcttttcttccaggatctcttcagcccccacatcttctctgctgattataattttggggggttggtagagtttggttctttcctggctgccactggcaaggcaggacacctttattgctgtaccttgtgttggccaatcaagtcccctatgaggaaccaagaactgtacacattactcttggatttgaatagcgttaggtcta

SEQ ID NO: 410503 - DNA, 2227 bp, Homo sapiens
gcaaggcagcaggatggaggggtttgtaaaaatgccttccacctaccctgctgggcttgccgaggaggctctgagtgtgtgaaggggaagacaattatcgctaggctggagaatagaaagagcaccatcagtccagtgagttgcaagcctaatgctcacctgcagagacagaattcctgagtgaacgaacagagcagctcctcttccatctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcccacagtacagcctcacattcttcttccaattctgaagatacagagatgtgatgaaaacaagtaatagctttggctgtttatttgatagctgtttctgggtatttaataggaatcctttctcaaggaatgagttgtgacctgtttactgtctctttagaagaaaaactccactggaaaccattcaccatgtgtgattgtcttctgttatcatttgtcttacaggcggctattgcagacggctaatttatgcttaacttaggaagagataaggcaagagctagatttttttcatgtgatcttttccaagcttcaacttaacttaactacatttctctgtatgatgatgtctcttacttctacaggttccttgagcaccaaagatgattcataactctgtataggtgacagctgcttataaaagcatcttagcagataagcctattaaaattgtgcttttgtaacaatgttgtggttgctagaataaataccattaacaaatgc

SEQ ID NO: 410504 - DNA, 2863 bp, Homo sapiens
gcaaggcagcaggatggaggggtttgtaaaaatgccttccacctaccctgctgggcttgccgaggaggctctgagtgtgtgaaggggaagacaattatcgctaggctggagaatagaaagagcaccatcagtccagtgagttgcaagcctaatgctcacctgcagagacagaattcctgagtgaacgaacagagcagctcctcttccatctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtatggtaatctggttccagcagcccaacaaacacagccacaattaggatagtctcagcttttcccacccattgatggcttagtagagaggttccattgaaggcacacactgaggggtctcacttgggttcagataaatgttgtcatggtcccacaccctttaggttagctaccagtacatcataagctcacgtttgtttgtttcccaaacatctgttccaaacagtgtgagttgactgaactctagttgacagtcactatcaaccctgattggcagtcatatttgtttgcttctgtgcatttggcataatgccccttaccctgtagggactgataagaatccctaaagctttcaagttgggagtgaagaagggggacctatttatcccccttcatcccagaagacatatgatgctgaaccactatttataataccactaatcatgtgaatatggaagttatagccttcataaatataaaagcattagaacacctttctcaacttctatacctcaaggagaaataataacatgattaaaaataaattcttgagctcctcatctattctcttaaggagagctagtctgatgtccccttctctgtttgaaattgataactcagaacttctgttcacaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcccacagtacagcctcacattcttcttccaattctgaagatacagagatgtgatgaaaacaagtaatagctttggctgtttatttgatagctgtttctgggtatttaataggaatcctttctcaaggaatgagttgtgacctgtttactgtctctttagaagaaaaactccactggaaaccattcaccatgtgtgattgtcttctgttatcatttgtcttacaggcggctattgcagacggctaatttatgcttaacttaggaagagataaggcaagagctagatttttttcatgtgatcttttccaagcttcaacttaacttaactacatttctctgtatgatgatgtctcttacttctacaggttccttgagcaccaaagatgattcataactctgtataggtgacagctgcttataaaagcatcttagcagataagcctattaaaattgtgcttttgtaacaatgttgtggttgctagaataaataccattaacaaatgc

SEQ ID NO: 410505 - DNA, 2597 bp, Homo sapiens
gcaaggcagcaggatggaggggtttgtaaaaatgccttccacctaccctgctgggcttgccgaggaggctctgagtgtgtgaaggggaagacaattatcgctaggctggagaatagaaagagcaccatcagtccagtgagttgcaagcctaatgctcacctgcagagacagaattcctgagtgaacgaacagagcagctcctcttccatctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcccacagtacagcctcacattcttcttccaattctgaagatacagagatgtgatgaaaacaagtaatagctttggctgtttatttgatagctgtttctgggtatttaataggaatcctttctcaaggaatgagttgtgacctgtttactgtctctttagaagaaaaactccactggaaaccattcaccatgtgtgattgtcttctgttatcatttgtcttacaggcggctattgcagacggctaatttatgcttaacttaggaagagataaggcaagagctagatttttttcatgtgatcttttccaagcttcaacttaacttaactacatttctctgtatgatgatgtctcttacttctacaggttccttgagcaccaaagatgattcataactctgtataggtgacagctgcttataaaagcatcttagcagataagcctattaaaattgtgcttttgtaacaatgttgtggttgctagaataaataccattaacaaatgccttttgagtatgcttgatagtgcttttgttttggattcactttttatgctttaaccttcatttgcctctagaaacccaaaacacaataaagtacagaataagaccttagtaataaaattcagaattttcttaaattgcatgtctgagtgttctaaaaatttttcaacatttccctttcacaagtgacttattcccccagttaagttattcacggtttcaccccacagcgtgaggggcagatagaaaaaaaaaaaaggaaacatcactaccgaattgaaagtagggtataatactaagttcacaggaaatcaagaaaaaatgacataactgaaatctctcttttggtaaaatctatttcaggtgcatacca

SEQ ID NO: 410506 - DNA, 2809 bp, Homo sapiens
gcaaggcagcaggatggaggggtttgtaaaaatgccttccacctaccctgctgggcttgccgaggaggctctgagtgtgtgaaggggaagacaattatcgctaggctggagaatagaaagagcaccatcagtccagtgagttgcaagcctaatgctcacctgcagagacagaattcctgagtgaacgaacagagcagctcctcttccatctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtatggtaatctggttccagcagcccaacaaacacagccacaattaggatagtctcagcttttcccacccattgatggcttagtagagaggttccattgaaggcacacactgaggggtctcacttgggttcagataaatgttgtcatggtcccacaccctttaggttagctaccagtacatcataagctcacgtttgtttgtttcccaaacatctgttccaaacagtgtgagttgactgaactctagttgacagtcactatcaaccctgattggcagtcatatttgtttgcttctgtgcatttggcataatgccccttaccctgtagggactgataagaatccctaaagctttcaagttgggagtgaagaagggggacctatttatcccccttcatcccagaagacatatgatgctgaaccactatttataataccactaatcatgtgaatatggaagttatagccttcataaatataaaagcattagaacacctttctcaacttctatacctcaaggagaaataataacatgattaaaaataaattcttgagctcctcatctattctcttaaggagagctagtctgatgtccccttctctgtttgaaattgataactcagaacttctgttcacaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcccacagtacagcctcacattcttcttccaattctgaagatacagagatgtgatgaagaatcctttctcaaggaatgagttgtgacctgtttactgtctctttagaagaaaaactccactggaaaccattcaccatgtgtgattgtcttctgttatcatttgtcttacaggcggctattgcagacggctaatttatgcttaacttaggaagagataaggcaagagctagatttttttcatgtgatcttttccaagcttcaacttaacttaactacatttctctgtatgatgatgtctcttacttctacaggttccttgagcaccaaagatgattcataactctgtataggtgacagctgcttataaaagcatcttagcagataagcctattaaaattgtgcttttgtaacaatgttgtggttgctagaataaataccattaacaaatgc

SEQ ID NO: 410507 - DNA, 2549 bp, Homo sapiens
gcaaggcagcaggatggaggggtttgtaaaaatgccttccacctaccctgctgggcttgccgaggaggctctgagtgtgtgaaggggaagacaattatcgctaggctggagaatagaaagagcaccatcagtccagtgagttgcaagcctaatgctcacctgcagagacagaattcctgagtgaacgaacagagcagctcctcttccatctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtatggtaatctggttccagcagcccaacaaacacagccacaattaggatagtctcagcttttcccacccattgatggcttagtagagaggttccattgaaggcacacactgaggggtctcacttgggttcagataaatgttgtcatggtcccacaccctttaggttagctaccagtacatcataagctcacgtttgtttgtttcccaaacatctgttccaaacagtgtgagttgactgaactctagttgacagtcactatcaaccctgattggcagtcatatttgtttgcttctgtgcatttggcataatgccccttaccctgtagggactgataagaatccctaaagctttcaagttgggagtgaagaagggggacctatttatcccccttcatcccagaagacatatgatgctgaaccactatttataataccactaatcatgtgaatatggaagttatagccttcataaatataaaagcattagaacacctttctcaacttctatacctcaaggagaaataataacatgattaaaaataaattcttgagctcctcatctattctcttaaggagagctagtctgatgtccccttctctgtttgaaattgataactcagaacttctgttcacaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacggcaggcggctattgcagacggctaatttatgcttaacttaggaagagataaggttccttgagcaccaaagatgattcataactctgtataggtgacagctgcttataaaagcatcttagcagataagcctattaaaattgtgcttttgtaacaatgttgtggttgctagaataaataccattaacaaatgc

SEQ ID NO: 410508 - DNA, 2298 bp, Homo sapiens
gcaaggcagcaggatggaggggtttgtaaaaatgccttccacctaccctgctgggcttgccgaggaggctctgagtgtgtgaaggggaagacaattatcgctaggctggagaatagaaagagcaccatcagtccagtgagttgcaagcctaatgctcacctgcagagacagaattcctgagtgaacgaacagagcagctcctcttccatctccagggtctcattctgttgcccaggctggagtgcagtggtgcgatctcggctcacagcaacctctctgcctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcccacagtacagcctcacattcttcttccaattctgaagatacagagatgtgatgaaaacaagtaatagctttggctgtttatttgatagctgtttctgggtatttaataggaatcctttctcaaggaatgagttgtgacctgtttactgtctctttagaagaaaaactccactggaaaccattcaccatgtgtgattgtcttctgttatcatttgtcttacaggcggctattgcagacggctaatttatgcttaacttaggaagagataaggcaagagctagatttttttcatgtgatcttttccaagcttcaacttaacttaactacatttctctgtatgatgatgtctcttacttctacaggttccttgagcaccaaagatgattcataactctgtataggtgacagctgcttataaaagcatcttagcagataagcctattaaaattgtgcttttgtaacaatgttgtggttgctagaataaataccattaacaaatgc

SEQ ID NO: 410509 - DNA, 2168 bp, Homo sapiens
gcaaggcagcaggatggaggggtttgtaaaaatgccttccacctaccctgctgggcttgccgaggaggctctgagtgtgtgaaggggaagacaattatcgctaggctggagaatagaaagagcaccatcagtccagtgagttgcaagcctaatgctcacctgcagagacagaattcctgagtgaacgaacagagcagctcctcttccatctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcccacagtacagcctcacattcttcttccaattctgaagatacagagatgtgatgaaaacaagtaatagctttggctgtttatttgatagctgtttctgggtatttaataggaatcctttctcaaggaatgagttgtgacctgtttactgtctctttagaagcaggcggctattgcagacggctaatttatgcttaacttaggaagagataaggcaagagctagatttttttcatgtgatcttttccaagcttcaacttaacttaactacatttctctgtatgatgatgtctcttacttctacaggttccttgagcaccaaagatgattcataactctgtataggtgacagctgcttataaaagcatcttagcagataagcctattaaaattgtgcttttgtaacaatgttgtggttgctagaataaataccattaacaaatgc

SEQ ID NO: 410510 - DNA, 3011 bp, Homo sapiens
gcaaggcagcaggatggaggggtttgtaaaaatgccttccacctaccctgctgggcttgccgaggaggctctgagtgtgtgaaggggaagacaattatcgctaggctggagaatagaaagagcaccatcagtccagtgagttgcaagcctaatgctcacctgcagagacagaattcctgagtgaacgaacagagcagctcctcttccatctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtatggtaatctggttccagcagcccaacaaacacagccacaattaggatagtctcagcttttcccacccattgatggcttagtagagaggttccattgaaggcacacactgaggggtctcacttgggttcagataaatgttgtcatggtcccacaccctttaggttagctaccagtacatcataagctcacgtttgtttgtttcccaaacatctgttccaaacagtgtgagttgactgaactctagttgacagtcactatcaaccctgattggcagtcatatttgtttgcttctgtgcatttggcataatgccccttaccctgtagggactgataagaatccctaaagctttcaagttgggagtgaagaagggggacctatttatcccccttcatcccagaagacatatgatgctgaaccactatttataataccactaatcatgtgaatatggaagttatagccttcataaatataaaagcattagaacacctttctcaacttctatacctcaaggagaaataataacatgattaaaaataaattcttgagctcctcatctattctcttaaggagagctagtctgatgtccccttctctgtttgaaattgataactcagaacttctgttcacaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacggcaggcggctattgcagacggctaatttatgcttaacttaggaagagataaggcaagagctagatttttttcatgtgatcttttccaagcttcaacttaacttaactacatttctctgtatgatgatgtctcttacttctacaggttccttgagcaccaaagatgattcataactctgtataggtgacagctgcttataaaagcatcttagcagataagcctattaaaattgtgcttttgtaacaatgttgtggttgctagaataaataccattaacaaatgccttttgagtatgcttgatagtgcttttgttttggattcactttttatgctttaaccttcatttgcctctagaaacccaaaacacaataaagtacagaataagaccttagtaataaaattcagaattttcttaaattgcatgtctgagtgttctaaaaatttttcaacatttccctttcacaagtgacttattcccccagttaagttattcacggtttcaccccacagcgtgaggggcagatagaaaaaaaaaaaaggaaacatcactaccgaattgaaagtagggtataatactaagttcacaggaaatcaagaaaaaatgacataactgaaatctctcttttggtaaaatctatttcaggtgcatacca

SEQ ID NO: 410511 - DNA, 667 bp, Homo sapiens
caggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggtgagtgggggcctatttcttttcatgatctaatttactagagtatgggtacagtccctatgagtatatttaatgtctatgtttgccacagatttttttaaaactagaaaatgaaaatgtaaagataactaacaaatcaagttattgtagaggacaggaggcagtataagaacaacaaatttcttactttcatagcatgcagctgacagcaactgtctagagctaataaatcaagaagtaaaaagtttatcagtattgtaatgggaacccccaaaagagcctgaatcggatgatctagatatgaattctggttctgtcatttgtcagctgtggggaaatggatttatttgttctgttcctcagttttcccacc

SEQ ID NO: 410512 - DNA, 553 bp, Homo sapiens
ggagaaaggaaagaatagaaaaggtactgaactccaggtccaagtcaatcatctttgcttctctcacattgtcatcgacatttaccccagcattatcctcatcgcttcatcactactgccaccccaaccaatctgcctcctctgtataaggctggaagacagagatccaccaggctctcaattgaaagccctggagggctacaccctaagaacagaagtgaatcggaggtacacttagcaaaactgaaaccagcttctgattcagaataatctctgactcgattgaggtgatcaaaggctattctacctgcccaacagaagaaaaagggaacactttcggtggaaggcaatatcatctggaccctttatggttttattatacataatgtctaacattttttaaattactagatgtggaagatcaagttcatttgcccaataatcaagagaaaaaaacacacacaatagaaacacaattatagatgatcaagatattgtaatcagcaaatgagaatttacaaataatttttatgaatatgtttaagaaaataaa

SEQ ID NO: 410513 - DNA, 532 bp, Homo sapiens
cttcacagaagactatagagtgtcccaaacacattgccagtcttcctttcaagcgagttgctgaattttgaagctttatggagcaggaggttaaagagctaaactgaaaacttgctgttatcttttagggctggaagacagagatccaccaggctctcaattgaaagccctggagggctacaccctaagaacagaagtgaatcggaggtacacttagcaaaactgaaaccagcttctgattcagaataatctctgactcgattgaggtgatcaaaggctattctacctgcccaacagaagaaaaagggaacactttcggtggaaggcaatatcatctggaccctttatggttttattatacataatgtctaacattttttaaattactagatgtggaagatcaagttcatttgcccaataatcaagagaaaaaaacacacacaatagaaacacaattatagatgatcaagatattgtaatcagcaaatgagaatttacaaataatttttatgaatatgtttaagaaaataaa

SEQ ID NO: 410514 - DNA, 392 bp, Homo sapiens
ttctgaaatctaattttagtgatggtggcttcactctgtaattatcttgggaaacatttaatcacacaagttaaaggggagggtgacttaaaagtacgttcatctcaatagacctgtctttgaagaagaagaagtcttaaggttcttgttagtcatatgggtgattgccgatgccacacaatgggactcttagtgaggagagggagagcaggagacattgagaagtcaggtaatcccatagattattatgaaactcccacatggagttggataggctattgaatgccaactgaagatacaggtcataggttctgaacctatgggggtagactacctcaaccctggagaatgtataggggagtgagaagcgccatggatgaaatactcaaata

SEQ ID NO: 410515 - DNA, 424 bp, Homo sapiens
gttcaggtatcatggccttacatgatattcatctgaagcaggatgagacagagcaggcagaaaaggaaacatttctgacaatgttctgttatgaagaatccacctttcctagaagccccagcgaacctcccatcggactcataggtgcaaactggctgaaaggctcattccaagaccaagcacaggtacaagggccaaaactggctagaacaggcatgactcaccttttcagcttctcagtcatctcctctcaagggcacaggtctgtttggttggtttgtgaataaaactgggggactgttattatggaagaagcagtgataagaccctttccataaagaggagagacgtgaactggcatatatcaccaggaccacctccaagtaattgactaataaataaaagctctattagtaagaaaaaa

SEQ ID NO: 410516 - DNA, 417 bp, Homo sapiens
tcctaaacaaatttagttcgcttttttgtattttgccggaatactgacatctgattctgtactctgattttggggatatcctgttttaaaaaccagtaggactgactgtgttggccctgcatgaatctctttaaccacctatggagcaaacaaaacattttgaaaatggaaaatatatcacattcgcaacaagcacatttgaatatgttttttattatagacccatatgattgaatgcagtagccactgcctgcacgtggctagctagcacttgaagtgtgacaatttgggattgaaagatgctggaaatgtgaaatacacaccaagttccaaagatttcatatattgattacatgttgaaataacagtgttttcgttatattgagttaaaatattaaaatattgtaagatttgata

SEQ ID NO: 410517 - DNA, 313 bp, Homo sapiens
gtgagccgagattgcgccactgcactccagcctgggcgacagagcgagactccttctcaaaaaaaaaaaaatgcataaaataatatggatctatgttaataggcactaattgtttaaagacataatttgttaactataggtaggggacagagaaaggagcagagttaatgtatgctattgaagctgagttgctatcagtctgaactagactttgaactcagcatgttaaatgaaatcttcatagtagccactaaaaaaataacttttaaaatatacagaaaagaatttaagaaaggatcaaaatattacagga

SEQ ID NO: 410518 - DNA, 568 bp, Homo sapiens
caccccacaccccaaggcagtctgtccagtgctcctaaaggagagcagctccccttttccagttatgggagatgtgggcaataaagcattactgtcaatgccgtgatgttcactgcaacatatgcttgatgttttcataattttatccatctttttcagacatcttactgcagaacactgtatgttttccaattattatttttcagaaatgtggtttacagcttctatcaggattagcttcagcttcaagtgacaaaagtcacttgaaatatgagttgctgaaacaagatggcagtctctcccctcaacaggactgttacaacaccttatcttcagagaaccaggctctctgcaacatttcagggacgtcgttcagtaccttatgtggaattcaagcttagctgggcatcctatgttttaactggctaactcgtggaactctcaacttggatcaagtggtagtggagtcccagggactctgagcagccagtgtgtgatactgcagggcagcacaccctggggaggccaactgtacagaataaaattaatgctttctatctttagcaac

SEQ ID NO: 410519 - DNA, 246 bp, Homo sapiens
tgggtgtgctttcccgattgacccgctgtgaggtgagcgattttaacccacatccttactgacttcacagcacagtaggtgcttcgtggctgtccggtgcaaggatgtatatacacacacacctttgcaaaaaaagtttgcatctcttgcctggctgtttgttgcaataatctatcatttgtcttttcctttccagcattgcagatgatcccttgaaaagaagtctgatcacattcacactctgct

SEQ ID NO: 410520 - DNA, 429 bp, Homo sapiens
caggcatgcaccaccacacccagctatttttaaaacatttttgtagagacggggtcttgccatgttgcccaggctagtctcaaacttacagcgtcaagcaatcctcctgccttggcctcccagagtgctgggattacaggactcacccactgcacctggccagcaatctattttaatgactctaccatgtgattctgatgtgcaccaaaatttgagaaccactactcaaaggatttttatttgcagctgctgctttattcggctggacagaattttaaaatttggtatactaatggtagaaaatctaccattctctagataaatcagttacacatccattagtgtatagtatggtattttcaacaggctttttcttctttaaaagtagatataatttaggctgggtgcagtggctcacacctgtaatct

SEQ ID NO: 410521 - DNA, 409 bp, Homo sapiens
atttatgggtgtgaatatgtctgtgggggtgggagctggaggagggccaggtagctgaggccaggaaaaagagtcccaaacccaccagctgttgggatatttaactgtgattgtacgttaaagctgcctcggagtgtccgacagctaagaaaaaacagtagtatgatggattatatacttcatagtattgactaagataatatattcaggagacaccatctcttttcctagcattggaaatcttaaggtattttactgcaagagttcttacaaaagggaccctctcctgcataaaaagtggtgtttttggctggacgtgctggctcgtgcttgtaatcccagcactttgggaggctgagcggggaggattgcttgagctcagaagtttgagaccagcttgggcaacata

SEQ ID NO: 410522 - DNA, 195 bp, Homo sapiens
gaagttaaatagtttgcagtctttgtgttagaggcatgcagcatccagcctagcatgtgtaatttagcatgtgtgtaaacttaggatcaggcaaacttttttgtaaaaggccgaatagtaagtatttcaggccttgcagggcacatagaatctctgttacctgttcttctgggtgcatgatttttacaacccttt

SEQ ID NO: 410523 - DNA, 2941 bp, Homo sapiens
agacagatggagaagttagaagttttagaggaatggcagtctcacattgaaggctgggaggggtccaacatcactgacacctgcactgaaatgctaatgtgtggagtcttactgaaaatttcttctggaaatattcaagaacgggtgttttttcttttcgataatcttttggtgtactgcaaaagaaaacacagacggttgaagaacagcaaggcatctacagatggacatcggtacctttttcgtggccggatcaacacggaggtgatggaagtggagaatgtggatgatggcaccgctgatttccatagcagtggacacattgttgttaatggatggaagatacataacacagcaaaaaataaatggtttgtttgtatggcaaaaacacctgaagagaagcatgaatggtttgaagctattttgaaagaaagagaacggcggaaaggtttaaaattaggaatggagcaagatacctgggtcatgatctctgaacagggtgagaaactttataaaatgatgtgcagacaaggaaatctgatcaaagaccgaaagagaaaactgactacgttccctaaatgctttcttggaagcgaatttgtgtcatggctgttggaaattggagagattcacaggcctgaggaaggcgtgcacttgggacaagcattattagaaaatggaatcattcaccatgttactgataaacatcaattcaaaccagaacagatgttatatagatttcgctatgatgatggaacattttatccaagaaatgagatgcaggacgtgatttcaaagggtgtaagattatattgtcgtcttcatagcctttttactccagtgataagagataaagattaccatttaaggacctacaaatctgtggtcatggccaacaaactgatagactggttaattgcacagggagattgccgcaccagagaagaggcaatgatatttggcgttggactctgtgacaatggatttatgcaccatgtccttgaaaaaagcgaattcaaagatgaacccctacttttccgttttttttcggatgaggaaatggagggatcaaatatgaaacatcgacttatgaaacatgacttaaaagttgtggaaaatgttatagctaagtcattattgattaaatccaatgaaggcagctatggctttgggctagaagacaaaaataaagttccaataataaagttggtagaaaagggatctaatgctgagatggctggcatggaagtcgggaaaaagatttttgctattaatggtgacctagtttttatgagacctttcaatgaagtggattgcttcctgaaatcgtgtttaaacagcagaaaacctctaagagttcttgtgagcacaaagccaagagagacagtgaaaattccagattcagctgatggacttggcttccagatccggggatttggcccttctgttgtgcatgctgtaggaagaggaactgtggctgcagcagctggtcttcaccctggacagtgcattatcaaggtgaatggaatcaatgtcagcaaagagacacatgccagtgtcattgcacacgttacagcctgcaggaagtacaggcggccaacgaagcaagattccatacaatgggtttataatagcattgagagtgctcaagaagaccttcaaaaatctcactccaagccccctggagatgaagcaggggatgcttttgactgtaaagtagaagaggttattgacaaattcaacactatggccatcattgatgggaagaaggagcatgtgagtctgacagtggacaatgtccacctggaatatggtgtcgtgtatgagtacgacagcacagctggcatcaagtgcaatgtggtggaaaagatgattgagcccaaaggtttcttcagcttaactgccaagattcttgaagccctggctaaaagtgatgagcattttgtacaaaactgtaccagcctaaattctctaaatgaagtgattcctactgaccttcagagtaaattcagtgccctttgcagtgaaagaattgaacacctatgtcagagaatatccagttataaaaaggttcaagcttcagaaaggttttacaatttcacagcacggcatgctgtctgggagcacagttttgatcttcacagtgtaagcagcacatttccagtacctgtgactatggagttcctcctgctgcctcctcctctcttaggaatatcccaggatggaagacagcactgcattcctgaggaccttccttctcaagaaatgctcttagcagagagggcccctgtctgattcttaccctttggaacagttcaggcacccttagacacagtacacagcccttcctagcatgtgggcagggggacatcctgtattcacaggcatttgtattgagctacaagttggaaagccagtccccctagcaagagaatcttctgccagctctccccgattactccattaacacttcttgacatcaccctattcatttccttttcagcttgtaccaaaatttctaactatctggcttttacgtgcattatataattgtatatatacagtcatgcactgcataacatttcagtaaatgacagaccatatatatatggatatatatatatatatatatatggatatatatacacatatatatacacacacatatatgtatatatacatatatatgtatatatatataaaatggtggtcccataagattatactactacattttggctctactttttctatgttcagatagatgcacctattggtgtatttttcagaatacatccccgttgttaagcaatgcattactgtattatatatatggcacatgtattatatatatggcacattgccgttacttttaatggcaaaaaccgcaatcacttttgctccaacctagtaattgcaataaacaattgttgtatatagc

SEQ ID NO: 410524 - DNA, 4766 bp, Homo sapiens
  misc_feature (3157)..(3157): n is a, c, g, or t
  misc_feature (3237)..(3237): n is a, c, g, or t
agacagatggagaagttagaagttttagaggaatggcagtctcacattgaaggctgggaggggtccaacatcactgacacctgcactgaaatgctaatgtgtggagtcttactgaaaatttcttctggaaatattcaagaacgggtgttttttcttttcgataatcttttggtgtactgcaaaagaaaacacagacggttgaagaacagcaaggcatctacagatggacatcggtacctttttcgtggccggatcaacacggaggtgatggaagtggagaatgtggatgatggcaccgctgatttccatagcagtggacacattgttgttaatggatggaagatacataacacagcaaaaaataaatggtttgtttgtatggcaaaaacacctgaagagaagcatgaatggtttgaagctattttgaaagaaagagaacggcggaaaggtttaaaattaggaatggagcaagatacctgggtcatgatctctgaacagggtgagaaactttataaaatgatgtgcagacaaggaaatctgatcaaagaccgaaagagaaaactgactacgttccctaaatgctttcttggaagcgaatttgtgtcatggctgttggaaattggagagattcacaggcctgaggaaggcgtgcacttgggacaagcattattagaaaatggaatcattcaccatgttactgataaacatcaattcaaaccagaacagatgttatatagatttcgctatgatgatggaacattttatccaagaaatgagatgcaggacgtgatttcaaagggtgtaagattatattgtcgtcttcatagcctttttactccagtgataagagataaagattaccatttaaggacctacaaatctgtggtcatggccaacaaactgatagactggttaattgcacagggagattgccgcaccagagaagaggcaatgatatttggcgttggactctgtgacaatggatttatgcaccatgtccttgaaaaaagcgaattcaaagatgaacccctacttttccgttttttttcggatgaggaaatggagggatcaaatatgaaacatcgacttatgaaacatgacttaaaagttgtggaaaatgttatagctaagtcattattgattaaatccaatgaaggcagctatggctttgggctagaagacaaaaataaagttccaataataaagttggtagaaaagggatctaatgctgagatggctggcatggaagtcgggaaaaagatttttgctattaatggtgacctagtttttatgagacctttcaatgaagtggattgcttcctgaaatcgtgtttaaacagcagaaaacctctaagagttcttgtgagcacaaagccaagagagacagtgaaaattccagattcagctgatggacttggcttccagatccggggatttggcccttctgttgtgcatgctgtaggaagaggaactgtggctgcagcagctggtcttcaccctggacagtgcattatcaaggtgaatggaatcaatgtcagcaaagagacacatgccagtgtcattgcacacgttacagcctgcaggaagtacaggcggccaacgaagcaagattccatacaatgggtttataatagcattgagagtgctcaagaagaccttcaaaaatctcactccaagccccctggagatgaagcaggggatgcttttgactgtaaagtagaagaggttattgacaaattcaacactatggccatcattgatgggaagaaggagcatgtgagtctgacagtggacaatgtccacctggaatatggtgtcgtgtatgagtacgacagcacagctggcatcaagtgcaatgtggtggaaaagatgattgagcccaaaggtttcttcagcttaactgccaagattcttgaagccctggctaaaagtgatgagcattttgtacaaaactgtaccagcctaaattctctaaatgaagtgattcctactgaccttcagagtaaattcagtgccctttgcagtgaaagaattgaacacctatgtcagagaatatccagttataaaaagttttctcgtgtactgaagaatagggcctggcctacttttaaacaggccaaatctaaaatctccccactgcacagcagtgatttctgccctaccaactgccatgtcaatgtgatggaagtttcttatcccaaaacatcaacctctttgggaagtgcatttggtgttcagttggatagcaggaagcataattctcatgataaagaaaacaaatcttcggagcaagggaaactgagccctatggtgtacattcagcacaccatcacaaccatggcggccccttcaggtctgtctctgggacagcaggatggccatggtctcaggtatctgctaaaagaagaagacttagaaacccaagacatctatcagaaactgctgggcaaacttcagactgcactgaaagaggtggagatgtgtgtttgtcaaatagatgaccttctgtcttcaataacatattctcctaaattagaacgtaagacatcagagggcataataccaacagacagtgacaatgagaagggagaaagaaacagcaaacgggtatgttttaatgtagcaggagatgaacaggaagattctggtcatgacaccatcagcaacagagactcttacagtgactgcaacagcaataggaattccatcgcctccttcaccagcatctgcagcagccagtgcagctcgtatttccacagtgatgaaatggactcaggtgatgaacttcccttaagtgttcgcatatctcatgataaacaggacaagatacatagttgccttgagcatcttttcagccaggtggattcaattaccaatctcctaaaagggcaggctgttgtgagggcctttgaccaaaccaagtatctcactccaggccgaggattgcaagaatttcaacaggaaatggaaccaaagctgagttgtccaaaaaggctacggcttcatatcaagcaagatccttggaatcttcccagcagcgtccggactcttgctcagaacatcaggaaatttgttgaagaggtaaagtgtaggctactcctggctcttcttgaatattcagatagtgagacacagctccgtagagacatggttttcngccagactcttgtggccactgtctgtgccttctctgagcagctcatggcggccttgaaccagatgtttgacaacagcaangaaaatgagatggaaacttgggaagccagcaggaggtggctggaccagatagcgaatgcaggtgttctttttcactttcagtcacttctgtcaccaaacttgacagatgaacaagccatgttagaagatacactggttgcactatttgatttggaaaaggtttccttttactttaaaccatcagaagaggaacctctggttgcaaatgttcctcttacatatcaagcagaaggaagtcggcaagctctgaaagtttacttctacattgatagttatcattttgaacaacttcctcaacggctgaaaaatggaggagggtttaaaattcatcctgttctttttgcacaagcactagagagcatggaaggatattattacagagacaatgtttctgtggaagaatttcaagctcagataaatgcagcctcactggaaaaggtcaaacagtacaaccagaagctcagggcattctacttggacaagtcaaattcaccaccaaactccacatccaaagctgcctatgtagataagctaatgaggcctctcaacgctttggatgaactttaccgactggtagcctcgtttatcagatccaagcgcacagctgcctgtgcaaacacagcttgcagtgcttctggggttggactgctgtcagtttcctcggagctgtgcaacaggctgggcgcctgccacatcatcatgtgcagcagcggtgtgcatcggtgcaccctgagcgtgacgctggagcaagccatcattctggccagaagccacggactgccacctcgttacatcatgcaggctacagatgtgatgcggaagcagggagcaagagttcagaacacagcgaagaatttgggagtcagagaccggactccacagtctgcaccaaggctgtacaagctgtgcgagccacctcccccagctggagaagaatgaaaagaactcccaagaaaccaggcaggcagaagctcctgaatgctggactagacaaactacatgctggctaaacattctccactgaagatacatcaatgcttttttttttttttttctgtaaatctttcttcccattgcaaacaagtagtgatcagtttatactttgatatttatgctggaaatggatagaagttcaatcagacagttcagcttcacgaactgatgtctctctgtattgacattaagtattcacttttagagtaaaatccatccctgggacataaagaaaaaaatattagagatttaaaaattaaccaccatgcctcctctcccattcattaaaatggttttattatgcttgttttcatctttcccaagtggacacatgtaataatggagagttcctcttgaagaaggccattattgaagaaacctggcgacatcttgcaaatcatcatgagaaatgttaaggacaatatagactgtgtgctatacattttcagtcccccatttgcaagagagaaagtcattaatgtgtaaaaggtggaaaagcatgctttactctttctcctaagggcttatttcttatt

SEQ ID NO: 410525 - DNA, 4237 bp, Homo sapiens
  misc_feature (3157)..(3157): n is a, c, g, or t
  misc_feature (3237)..(3237): n is a, c, g, or t
agacagatggagaagttagaagttttagaggaatggcagtctcacattgaaggctgggaggggtccaacatcactgacacctgcactgaaatgctaatgtgtggagtcttactgaaaatttcttctggaaatattcaagaacgggtgttttttcttttcgataatcttttggtgtactgcaaaagaaaacacagacggttgaagaacagcaaggcatctacagatggacatcggtacctttttcgtggccggatcaacacggaggtgatggaagtggagaatgtggatgatggcaccgctgatttccatagcagtggacacattgttgttaatggatggaagatacataacacagcaaaaaataaatggtttgtttgtatggcaaaaacacctgaagagaagcatgaatggtttgaagctattttgaaagaaagagaacggcggaaaggtttaaaattaggaatggagcaagatacctgggtcatgatctctgaacagggtgagaaactttataaaatgatgtgcagacaaggaaatctgatcaaagaccgaaagagaaaactgactacgttccctaaatgctttcttggaagcgaatttgtgtcatggctgttggaaattggagagattcacaggcctgaggaaggcgtgcacttgggacaagcattattagaaaatggaatcattcaccatgttactgataaacatcaattcaaaccagaacagatgttatatagatttcgctatgatgatggaacattttatccaagaaatgagatgcaggacgtgatttcaaagggtgtaagattatattgtcgtcttcatagcctttttactccagtgataagagataaagattaccatttaaggacctacaaatctgtggtcatggccaacaaactgatagactggttaattgcacagggagattgccgcaccagagaagaggcaatgatatttggcgttggactctgtgacaatggatttatgcaccatgtccttgaaaaaagcgaattcaaagatgaacccctacttttccgttttttttcggatgaggaaatggagggatcaaatatgaaacatcgacttatgaaacatgacttaaaagttgtggaaaatgttatagctaagtcattattgattaaatccaatgaaggcagctatggctttgggctagaagacaaaaataaagttccaataataaagttggtagaaaagggatctaatgctgagatggctggcatggaagtcgggaaaaagatttttgctattaatggtgacctagtttttatgagacctttcaatgaagtggattgcttcctgaaatcgtgtttaaacagcagaaaacctctaagagttcttgtgagcacaaagccaagagagacagtgaaaattccagattcagctgatggacttggcttccagatccggggatttggcccttctgttgtgcatgctgtaggaagaggaactgtggctgcagcagctggtcttcaccctggacagtgcattatcaaggtgaatggaatcaatgtcagcaaagagacacatgccagtgtcattgcacacgttacagcctgcaggaagtacaggcggccaacgaagcaagattccatacaatgggtttataatagcattgagagtgctcaagaagaccttcaaaaatctcactccaagccccctggagatgaagcaggggatgcttttgactgtaaagtagaagaggttattgacaaattcaacactatggccatcattgatgggaagaaggagcatgtgagtctgacagtggacaatgtccacctggaatatggtgtcgtgtatgagtacgacagcacagctggcatcaagtgcaatgtggtggaaaagatgattgagcccaaaggtttcttcagcttaactgccaagattcttgaagccctggctaaaagtgatgagcattttgtacaaaactgtaccagcctaaattctctaaatgaagtgattcctactgaccttcagagtaaattcagtgccctttgcagtgaaagaattgaacacctatgtcagagaatatccagttataaaaagttttctcgtgtactgaagaatagggcctggcctacttttaaacaggccaaatctaaaatctccccactgcacagcagtgatttctgccctaccaactgccatgtcaatgtgatggaagtttcttatcccaaaacatcaacctctttgggaagtgcatttggtgttcagttggatagcaggaagcataattctcatgataaagaaaacaaatcttcggagcaagggaaactgagccctatggtgtacattcagcacaccatcacaaccatggcggccccttcaggtctgtctctgggacagcaggatggccatggtctcaggtatctgctaaaagaagaagacttagaaacccaagacatctatcagaaactgctgggcaaacttcagactgcactgaaagaggtggagatgtgtgtttgtcaaatagatgaccttctgtcttcaataacatattctcctaaattagaacgtaagacatcagagggcataataccaacagacagtgacaatgagaagggagaaagaaacagcaaacgggtatgttttaatgtagcaggagatgaacaggaagattctggtcatgacaccatcagcaacagagactcttacagtgactgcaacagcaataggaattccatcgcctccttcaccagcatctgcagcagccagtgcagctcgtatttccacagtgatgaaatggactcaggtgatgaacttcccttaagtgttcgcatatctcatgataaacaggacaagatacatagttgccttgagcatcttttcagccaggtggattcaattaccaatctcctaaaagggcaggctgttgtgagggcctttgaccaaaccaagtatctcactccaggccgaggattgcaagaatttcaacaggaaatggaaccaaagctgagttgtccaaaaaggctacggcttcatatcaagcaagatccttggaatcttcccagcagcgtccggactcttgctcagaacatcaggaaatttgttgaagaggtaaagtgtaggctactcctggctcttcttgaatattcagatagtgagacacagctccgtagagacatggttttcngccagactcttgtggccactgtctgtgccttctctgagcagctcatggcggccttgaaccagatgtttgacaacagcaangaaaatgagatggaaacttgggaagccagcaggaggtggctggaccagatagcgaatgcaggtgttctttttcactttcagtcacttctgtcaccaaacttgacagatgaacaagccatgttagaagatacactggttgcactatttgatttggaaaaggtttccttttactttaaaccatcagaagaggaacctctggttgcaaatgttcctcttacatatcaagcagaaggaagtcggcaagctctgaaagtttacttctacattgatagttatcattttgaacaacttcctcaacggctgaaaaatggaggagggtttaaaattcatcctgttctttttgcacaagcactagagagcatggaaggatattattacagagacaatgtttctgtggaagaatttcaagctcagataaatgcagcctcactggaaaaggtcaaacagtacaaccagaagctcagggcattctacttggacaagtcaaattcaccaccaaactccacatccaaagctgcctatgtagataagctaatgaggcctctcaacgctttggatgaactttaccgactggtagcctcgtttatcagatccaagcgcacagctgcctgtgcaaacacagcttgcagtgcttctggggttggactgctgtcagtttcctcggagctgtgcaacaggctgggcgcctgccacatcatcatgtgcagcagcggtgtgcatcggtgcaccctgagcgtgacgctggagcaagccatcattctggccagaagccacggactgccacctcgttacatcatgcaggctacagatgtgatgcggaagcagattttgtgtatatacttttcatacagttgttattttaattcactgcttgagtttgaaggaaagataaaagacagaagagaagggtactatgttttcatgatgttttgctaatgattgtaacaaccttgggcagcactttatgtaaccagctgatttgattaataaaaggcttgca

SEQ ID NO: 410526 - DNA, 267 bp, Homo sapiens
ttactgataaacatcaattcaaaccagaacagatgttatatagatttcgctatgatgatggaacattttatccaagaaatgagatgcaggacgtgatttcaaaggtaacgacctctcccacaacctctccaatagtagaatgcatgttgtcattcttcagaagataaaaggtagttgagaaacataaaagatttttctagtttagaaaattcttcgactatatatacaagcaagcctctttatttatttttggtatttcaagaattc

SEQ ID NO: 410527 - DNA, 389 bp, Homo sapiens
tacaagaaatgcaatcagggggagcagaatgacgcagaggagtctggaagctcaggattgcattaagcgactttcccatactgtgaggagatgtggtggggaccattaactgttggaaggattccttttaaggatgcattatatcaagagctagatatcagagccacttgggagaaataagaaacaggtgtagaaacagtcgcagattggcatgagctgtggagaaagagtctggattttgggttgctgtgtcacacacagcccacttgcaggatgacagtggaagaatgagtcatgatctctgcaagcgcccatcaagaacagcctgagaggtttggaaagtgctcaccccaggacccttcatgtccttattaaaattgtatggcaga

SEQ ID NO: 410528 - DNA, 549 bp, Homo sapiens
tacaagaaatgcaatcagggggagcagaatgacgcagaggagtctggaagctcaggattgcattaagcgactttcccatactgtgaggagatgtggtggggaccattaactgttggaaggattccttttaaggatgcattatatcaagagctagatatcagagccacttgggagaaataagaaacaggtgtagaaacaggattggtagacaacatgttcatgcaaatgatatgaagaagattggcacctggaaaatcaaggaagaggtggggccgtgtaggcagagacttaattttctcaagtgaatgaagaaaaaagcacatggtgaggctgattctgtggggatgtatttgagctagaagattcaggagggaaaattagttctaagacaaagatggagacatcaataagattgggaaatactcagacgtcagaagaatttgggtttgaatcagaattcctttacatactttctaagtttcaagttaagcagcaattcagtgtttcaaaccttacgattgataaacaaaaaataaaatgaaattcacc

SEQ ID NO: 410529 - DNA, 413 bp, Homo sapiens
aatctctgttgacacagcctctgccctcaagcctgagccttacctgcctccctagcctccgcacctgaagcttaacacaccctgcagcatgcccaaggcacagctaactataatcagcctctagccctataatggtggaggtcttgtgatttcctgcagctgtgccagttgttgagaatgccagcagctgaatcccttcatggaagatgctgagagagacagtatagtggaggaaaggatgtgagttttgcagtcagatcagtacttgaatcgagatctcaacttatcagttacttgactggacatgccctccctgagacgccatttctttattgcaaaaatgaaaataataaaacctacctcttggggccaagtgtggatcagcatgatgcacttggaaagtaactggaata

SEQ ID NO: 410530 - DNA, 299 bp, Homo sapiens
tgacttttaagcaggggaagcaaggctgccggagacagcgcgttgtgcctggggaacaggttcacaggctcacagacagaattgggttcagatgctggttctgatcactcctaggtgaccccaggcaaaatgctttcccagactgagactcaatgtcctcatctgtaaagtgaagttaaccccacccgcctcactggtgaatatgcatctgcaatgttaagcacttagcatagtgcctaccacatagtacgtgtttaatcaatgtttgttatgtatattaatgaaaaggttcaccaatt

SEQ ID NO: 410531 - DNA, 425 bp, Homo sapiens
tcaagtcccatttaatgcattcaacaaatatctatcgtgcctcgtgttctcactttgactcagcagaccctgtggatagagagtgagacagacaagtccctgtcctcatggggcacacactcaaggcttgggggcatggggagcagatcatcaataggatgacacagaaagaagcatattttaattttgataagcggtacgaaggaaataaaacaagttttcttcagggaggccttccttggccatctggtctaacctggccccctattctctaacacgttggtcaatttgtcagacccattgagcttaatccatgagaatgtcagctctctaagagcagagccctcatctgccttgcttatggccatgtccccagtgctgtggacacaatagctgttggacaaataaaagagattgtaaataaa

SEQ ID NO: 410532 - DNA, 503 bp, Homo sapiens
atttgaattacatacgcttatgtaattgaaaagaccaaagggagtgagggcccctggcatggtttgatgaagggtacaggctttggccctgtttttctataattctcttggctttaccctgtattagcttttttttctcaaacgggcttccccagtagtacaagatggctgcctttgtatgtttcctcattcctggagagaaagtagatgcttcctacaaatacagtgcaaaatcctaagcttgacactaattgaaccatcttgtgctccaaaggatcactgtcttaaaatctgggtagctttctgtgtctagaccagtggcttttaaacttgagtgtgcattagaactacctggaggacttgttaaattacagattgcagccaggcactgtggctcatgcctgtaatcccagcactgttggaggaccaggcgggaggattacgtgagtccaggaattcaagatcagcctgggcaacatggtgaaactctgtctctaccaaaa

SEQ ID NO: 410533 - DNA, 430 bp, Homo sapiens
attttttacctaaaattaaaattaatagagtaaatgaaattaccctaaagggtaaaaatgtattattactatggacagataaggtttctaaagtaattagtttcctaaatccaagatgcttttcctatcaaatatgaccatggtagcccaagttttgaatattaggaaatagctttatggcaaaaaaagttccattatagatctgtggctaaaaactggtgatgattacctccaaataaaaagaatctctggcattaacaaaatactaagcattattttctgtacagtgatgagggatagttgtcctagtttcccttgtattaagaaaggtcaggccaggcacggtggctcatgcctgtaatcccagcactttgggaggctgaggcaggcggatcacgaggtcaggagatcgagaccatcctggctaaca

SEQ ID NO: 410534 - DNA, 867 bp, Homo sapiens
tctacaaaaagtaagcaaattagctaggtgtggtggtgtgttcctgtagttccagctgcttgggtggctgaggcaggcagatcgcctgagcacaggagttgggggctgcagtgagctatgattacaccactgcacttgagccagggtgacagagtgagacctgtcttaaaaaaaaaaaaaagggggtcttcaaagacaagaacatctgtgctgtcacgttgggtggatgaggggctgccaggtttgcaatgaatgtttcccatttcttcttagtttatggacttaccataaactcaggatggcagtttggtgggttggagaaggatatggtgattgcgggagttacaagacattacttataggggaaaacagggttttgaaaggttaacacttaaaagtgagaatggaaaagggatgaatgaatgaacaagatgaggtgagatggaagaggtaaagggaaaaggagaacaagcagctcttctctgcgtggcgcctgggatgaatggtttctggggacatccctgatggcagttttgtggagaggcgcaaaactttatgtggtaagaaatgagctgtaggcccagcgcaggacccactcggcctgtaatcccagaactttgggaggccgaggagggcggatcacttgaggtcaggagttcaagaccagcctggccaacatggagaaaccttgtctctactaaaagtacaaaaattaggcaggcgtggtggcaagtgcctgtaatcccagttactcggaaggctaaggcatgagaatcgcttgaacccgggaggtggaggttgcggtgagggaagatcgcacctttgcactccagcctgggcaacaagagcaaaactctgttttaagaa

SEQ ID NO: 410535 - DNA, 496 bp, Homo sapiens
gaatcagcaaattattggaagaaatgatgcctgaaaatcaaatatttgatgaaaacattaatccaagatcaagttgtaagataacatagaaagatgcataccaaaactatagtgaaaacaatgaaagaaaaaaatcttgaaaacagaaaaaaaaactactcattgtgtataagaaaacccattggcccaatgctgtggctcactcctgtaatcccagcgctttggagcttgaggcaggagtgcttgaggccaggagttcaaaaccagcctgggcaatatagtgagaccccatctctacaaaaaatttttaaaaattagccaggtgtggtggcatccacctcataactacttgagaggctgaggcaagaggatcacttgagcccaggagtttgaggctacagtgagctatgattgcaccactatactccagcatgggcaacagaacaagaccttgtctctattttgttttttgtttttgtttttgttttttcatttt

SEQ ID NO: 410536 - DNA, 458 bp, Homo sapiens
tagctaattgccaagaaatcatacgactaccatgaaaaatgatttccatccatttttaagatgatcaataattcagtctttgctagtccaaattccaagttaattctatgtgttattcttgaagtgtgagtacagggacagatataatcagtattttatttccctacaagcctccaaaagaagggctaggcaaaaaatttagccatttttcacttaaaatatttatgctaacataaatgttacatagacatgtcacttttcaattacatttttaatttctgaagtggtaaatattagcagacatacctgccaacataaaagttctctgaggcccttactaatttgtgtgaagaggttctgagatttaaaaaatgaaaatattcaattagaaaacatttttgtaaagggggagaaaaaaggagcacattcataaatacaagaacattaaaacacattaa

SEQ ID NO: 410537 - DNA, 1387 bp, Homo sapiens
  misc_feature (1188)..(1188): n is a, c, g, or t
  misc_feature (1252)..(1252): n is a, c, g, or t
ttcagaatcataaaaacatttttaaaaggaattgagaaaaaaaaaacctcaaagaagataccatatgagtatggtagtaatacccaaagataaccaaagcaatggaacaaaataaattttataatgagaaattttaatccttgttatatttaacccatttgttcattcaatgctgttatacattccctttgttgtgggttgaatctaggaaaagggtcttgtccaatataattaaggatctcaagatgaagcatcctgtatcgtcacgggtacgtcctaaatccaatgacaagtgttcttataaaagacaagagaaggcacaaagacaaagaaaaagccacgtgaaacacaatagaaggcataaataaaaagccacgtgaaagcaaaggcagaaactagagcaatgcagctacaaagaatgctgacagctaccaaaagctgaaaaagacaagaaaccattctcctctcttgtcttcagagggattgtggccctgccaacaccttgattttgtacttctgtcctccagaaccatgacagaatgaatttctgttattttaagccaagtaggtggtacagcagccacgggaaactaatatatgtggtttgctttatatttatgttggacagcattctcttagatcctacaaccaattcacagaaaacacagggctgaggaaccagttaaacttcaccagggaatacagttcacaaaatttagcccatgggaaattccacagagtaaactatctaatctccacaaataaattgaaatggaagccttctatggatgaaaagagacttagacatatcaaccagtcacaaccagtttggaacctgattaaaacaaaatgtaaaaaaaaaactccaatttatgagaaaattgaaaatgtgaacactaaccatatgtttgatattaaggaatttattgagatttttttaaagtgtagtaatgatattgtactcttatgtatctttaaatcctttagagctgtatactgaaatatttatagataaaatgataggatatctaggatttgaaatagcacaggggaagcaggagaagcagatggagttaaaggtgtgacaggatggccatgggccaggcgtggtggctcacgcctgtaatcccagcacttttggaggctgaggctggtggataaccagaggtcaggagttcaagaccagcntggccaacatggtgaaaccctgtctctacttacaatacagaaaaaaaaattatctgggcatagnggcaggtgcctgtagtcccagctacttgggaggctgaggcatgagaatcacttgaacctgggaggcagaggttgcagtgagccaaaatagtgccattgcactctagcctgggcaacaagagcaaaactccatctc

SEQ ID NO: 410538 - DNA, 1220 bp, Homo sapiens
ttctgttaggacagtcttagcataagaaatatgtacaatgaatatcttggaccatggagtatttgtgtagtttatcacatttggaattttctgcccctgggtgacagagtgagacttggtctcgaaaatatatatatatatatgtttatttcagcaaattctggaattatgccctcccctcccccctttttatttttgctgattgatgtttaaaagtggaccattaaaaaatgtaattccaagattgccttgcatctgttttgaatgattgtgttttgctttacaaggggcagaatgacttttggggccaaatgctcagctgactttttgttcgctgttttctgcagggatcttgagaataatggttctttttaaggccaattgttactttctttctcacacaaaggaaaaaagagactatctttaggaaacactgctttaaatcatcttccttgaatattaattctctgttgcttcctccaaaaatggagaaaataatccctaccctcataggcttattataaggctcaattatgataatggtgtgaaaactttgaaaattagacttcagagaaattgagttaatctgggattatttatcaatgtcttagtaaccaaaagtttaaaatgtgttttgtttaccaactggttgcatgtacatggttaatccaaaaggctcagcttttcagcaaatggaaaaagattaacttctttatggatcacattatgagatgaaacacatttcattctagctgctgaaaaaatagcaacatgtttttgaaaccattgtgattttgtattgcagtcactaaaacatcaaatatatcatttttatgttaaagtgccctaatttgtgttgttacataaaacttggagtaccttgaccaaatagaagaaattaatgtgccgcgtgtctgttttaaagatgaaatctgagcccagtgtgaggctcatgcctgtaatcccagcactttgggaggctgaggcaggaagattgcttgagtccaggagttggagaccagcccgggcaacatagggagacctcatctctacaaaaaataaaaaatagacagacatggtggcacatgcgtgtagtcccagcttcttgggaggctgagctgggacaattgcttgagccagagaggtcaaggctgcagtgagctgtgatcacaccactgcactcctggtctgggcaacagagtgaaaccctatctttaaaa

SEQ ID NO: 410539 - DNA, 485 bp, Homo sapiens
atgttggccaggctggtcttgaactcttgacctcaggtaatctgcccacctcggccttccaaagtgctgggattacaggcgtgagccactgtgcccggcccgacagtatcctaatcaagcgatccaggcatgcatcaccagtaacgggacagacaagacagcacgcgcctcctggtatgaggagctgaggacagcaccgctcttgtggtattcctgccaaatattcataacctggatcgaatcttgagaagtatcagagaagcccgactgagaggctcaacaacataactggcctgcactcttccaaataccaaggtaatgagaggcaaagaaagactgttctagatgacaagagactacagagtcatgacagcaaaatgcaacgtgaaatcctggactggatgctggaacagaaaaatatgttttccctttcgttataacagttcacaactggcaagatctgaatgaggcctatagatagatat

SEQ ID NO: 410540 - DNA, 455 bp, Homo sapiens
gcatggatatatgaggcaaggtgacccatcagacaattatgttccacgggaaggcccaggggacccatccttcagcaaggctgctgggaatgcactgataagcgggcttgggcatcataaaggagctcagcggtggctctcctcggcaggctggggctggcaggaagggctgtgatggaacttcacttgctgagagcaatgtggatgatgatgagaccttgaagagcccaggtggcagtgccagccacagaagccagggtgccatcagtatcctgttaaccactaagctccaaatggcagccgaggggtcctgacctgtaaagtctcatggaaatagttggtagaacaaggcattcctagggacaaaagagctgactaatcaacaagggtaaggctttatatataatcaaaagtgagcaagaattgatgagcaggggactgagagagatcactcc

SEQ ID NO: 410541 - DNA, 402 bp, Homo sapiens
gagtcacaaaacatactcgctggctcagaaaactgcagaaaagcagtctaagttcttttcagcctggctttgatggctgaaaggtatacctcttggaactagtgagcatatcacagatgctgagcaggtgagctttaaaaaatggtgttccatctaaataatctgtcaggctactgacaacaaaaagctatttctgactgtagctggaatgagtgattactttgataccaaattaaaacaagctttgaaattggaaataaccagaattaagctatctccaatgaatgactgagctccccccttcagtacattttcttctatattagccgtaaacatgagctcttcattaatagaaattggctcattgctactagccacaaggggaatctataggatgtgtgg

SEQ ID NO: 410542 - DNA, 297 bp, Homo sapiens
aaaaaaaaaaaaaaaaaaaaaaaaaaaaaaagagtagaatttcagtgggttgaaaacaatggaggctgggaggacacaggctttggggtggacatactgagaatgtagggaggtggaaagtgcatgacacttctgggtactggaaagacaggagtgaacaagccatgcggctgggaggactgaatgaattactaaagtgatagaatcatcttaccagagagaaagcagctgatgaagtaggagaagaaactatatgtagacaagttattaggaagaagtgacattcagagtgggaag

SEQ ID NO: 410543 - DNA, 523 bp, Homo sapiens
gggtcgcaggtatgtaaagggctcagcacatcccaggcgcctggtaaatgggagctgttattcattgacctgggcaacagctattttttggagcaccaactgtgccttagatgggaaataaaataaaaatctctgcccttgtggtgctcacactctagatggggagccgggtaataaacagataagcaagcgaaatattaatatatagcaagtccggaaggtaagggctgcaggttaaataacgtgggcagggccaggcgcggtggctcacacctgtgatcccaatatcttaggaggccaaggcaggaggattgtttggggccaggagtttgagaacagcctggccaacatggcgaaactccttctctacaaaaaatacaaaaattagccggtcatagtggtatgcgcttgtaatcccagctactcaggaggctgaggcagagaattgcctgagcctgggaggcagaggttgcagtgagccaagatcgcaccactgcctgggagacagagcgatactctgtct

SEQ ID NO: 410544 - DNA, 505 bp, Homo sapiens
ttcatttgcgtgtttcactaagcacaaaagctcccctttaagccctcatctcatggtgaacagactattcctgcctgtctgagtcacatatctctgggcagccagaccttctgactcactggtggttgaaatctcagattcacaataccagagagttgctaaaaataggaatcatgtacctgggccccaaaataggacagagtcaaacacggctctttaaaaacctactgcccaatgtgtaacataaaaatcaaagaggggctatacttgtcttctttcatattatcttaaatgtaataaagccgtctctaattcctttggaaatcggcaaagtagatggaccaatacaatagaaagataggttggaataattgtgcctagtgcactctggttgtttttattagaaaattctatatccttaaattagcatagggtattttcacagcagtggtagggaaatgaagcttctccatccatgctttgccagtttctctcttgggaatca

SEQ ID NO: 410545 - DNA, 274 bp, Homo sapiens
tttgtttgtttgtttatgtatttttggtttacagattcaatttctattttcaattaaataaaattcccagaagcaagcaactgcaattgcaatttcagaatctagattgcctacatttacaagagacacttttaccttctggagcaaaacaaaatatgtctgatccttcctctacgtgacaaaagatatttgaagatttttttcctcccttcaaccactgtcaggttaaacataacccagttttctcagtcatatgacctggttgccagacctc

SEQ ID NO: 410546 - DNA, 842 bp, Homo sapiens
acccccatactccccccaccccaaaccctcagagcaccttcctgtggagccagtctgagatccaggctgggactgaaagaggaactggaagggagtccagggaaggagtacagggagggtccctgtgtgcagctgctcagggagttccgatctgtgcaccctcttgacctggctgtgcactgccaaggcaggggtggacggaaagccttgcagatattttccagcttctacagaacttgagggagtgcaactttgagggtatgggcacctccaaccctgagtctgggctcctgaaggggcttggcctacctggatgtcctgccttccaccccaggttgtccctactgcttccagcagctcttggaactcttgtttccaacacctttttttgagtctcaacataaacattagattaagccattgtggtctcttcctctgtgccttgtttgcccaggtcctcctaagggccaggagtggctccttgggaggaagagtgatgggagctatgggaggaaggatgggggctggatcatcaggcgggacctggttctttcaggactttgtgtatccctcatcctgattctacagggttcctccccttcagactccttctttgcccctgaggggtgggattaggtagtgattagggcatggctggagtcagctgccaaggttcaagtctgggctgtgccacttagcagcttagtgacctgggcagattacgctgcctctctgtgtctctgttcccttctctgataaccacagtaccatcgttataggtttgctgtgaggatgaaatgagctcatgcataagaagcacataatggtgcacaccccataga

SEQ ID NO: 410547 - DNA, 488 bp, Homo sapiens
gtgggttgaccgtggcttgtgggttgaccgtggcttgtgggttgagcgtggcttgggaatagaaacttgtggtctcttcctctgtgccttgtttgcccaggtcctcctaagggccaggagtggctccttgggaggaagagtgatgggagctatgggaggaaggatgggggctggatcatcaggcgggacctggttctttcaggactttgtgtatccctcatcctgattctacagggttcctccccttcagactccttctttgcccctgaggggtgggattaggtagtgattagggcatggctggagtcagctgccaaggttcaagtctgggctgtgccacttagcagcttagtgacctgggcagattacgctgcctctctgtgtctctgttcccttctctgataaccacagtaccatcgttataggtttgctgtgaggatgaaatgagctcatgcataagaagcacataatggtgcacaccccataga

SEQ ID NO: 410548 - DNA, 324 bp, Homo sapiens
aaaaaattagccgggcgtggttgcaggcgcctgtagtcccagctactcgggaggctgaggcaggagaatggcctgaacccaggaggcgaagcttgcaatgagctgagatcgcgccactgcactccagcctgggtgacagagcaagaatctgacaaaaaaaaaaaaagatttttaaaggaacaatttctagaaatgtagatacagtaattcaacaaataactaaagaaataactacatatatactatgtctatgtgtgtatgtgtatgtatatataatatatactgtgaaggaaaataaagggtgccatgaaaacatatcacaga

SEQ ID NO: 410549 - DNA, 928 bp, Homo sapiens
ccgtctcaaaaaaaaaaaaaaaaaaaaaaaaggaaagggtaaaccagtaaatacccaccttgaaaaaagagacagcaaggaaatgtccctactgcaatcttggctctgaatcaggggtggaagtcgaggattgtgaagacctcccctgagtattcacaggctagtcttcatgagtttatagtctaagtttatactacctgaatagacagaaacacttcaagcccagaattttatttatttatttatttacttacttacttacttatttacttacttactgagatggagtctccagtctgggtgacagagcaagactccatctcaaaacaaaacaaaaaagaagtatgtttaatatatataaaagcctgattcaagcaccggacagaaaaaataatgtatcactagggaataaatcactaaaaatgacaagacttccataaccattgcttggtttaaaaaaaaaaaaaaaaaaaaaaacaggccaggtgcggtggctcacacctgtaatcccggcactttgggagggcaaggcaggcagatcaggaggtcaggagttcgagagtagcctggccaacatggtgaaaccccgtctctactaaaaatacaaaaatcagctgggcgtgatggcacatgcctgtaatcccagctactcgggaggctgaggcaggagagctgcttgaactcgggaagcagaggttgcagtgagccgagatcacgccattacattacagcctgggtgacagagcaagaatctgacaaaaaaaaaaaaagatttttaaaggaacaatttctagaaatgtagatacagtaattcaacaaataactaaagaaataactacatatatactatgtctatgtgtgtatgtgtatgtatatataatatatactgtgaaggaaaataaagggtgccatgaaaacatatcacaga

SEQ ID NO: 410550 - DNA, 155 bp, Homo sapiens
tctaagtttatactacctgaatagacagaaacacttcaagcccagaattttatttatttatttatttacttacttacttacttatttacttacttactgagatggagtctccctctgttgcccaggctggagtgcaatggcgtgatcttggctca

SEQ ID NO: 410551 - DNA, 587 bp, Homo sapiens
ttttgcttacatgcaaacatgttaactttttatggcctccatctaagccaatacattaaaagaaagcaaagatcctctatattgtcagcctgttgaaccataaggaaatagtacagcaggatgatggcatccgattagccaagggttcaaatccttactctccactgctggcagggtgatcttgggaagaggatgtaacctctcaaacccctcatttcctcccctgcaaagtgaagataataataactacctccctcatagcattattgtgaggtgcttatcattagagtacatgatatagcaaggctcagaaatgtatgagcgcatgggggtgggcggggtgtctgtagacacagatataatttctatacttcactggaacacatcactattttatctggggaatatgggataattttgctgtttgtttttagtagtgcatgcttctgtggagggcagattttctgcaactaaaccacaactttaccagtctaatatcagagtcaaaaattaaaataagccatgaggatttttccatcccaaaattcatagtccaggctccttcctccttctcctttgtctttcat

SEQ ID NO: 410552 - DNA, 425 bp, Homo sapiens
actggtgagctccgactagaaatgtcaacgtggactcattagcatatagttggtactgaacaccaagaaagcggaagagatcccccaaggaaagagtgtagatgggaatgagaggtctgaggactaaagcctggagcattgtcacattcagagccacagcaatgaggtacaaccagtgaaaaagtctgaaatgctgtgccgggaatgaacaagacaagcaggaggatgtggtgtcctggaaagcaaatgaagaggagagggtggtgactggccacgtctgatgagggctgagaactgatgcaaagtcatggtcatgtgaccataccattggtggaaacagcaggcaggtaacactcctggcttcctcccacaggatcagtgtaaccgcatccctgaccaggtgatcacagtgactgtctcctgca

SEQ ID NO: 410553 - DNA, 742 bp, Homo sapiens
tcgtcctgtggaactgatccattctcggtcccattcccttctctctgggccaatctgcacctaggtttgtggcttcatgagtatggagggtcgtgcagaaaggggccaggtctgtaggaacctgggttcatgccctggaaatttgcccatttaagataagttagggccgggtgcggtggctcatgcctgtaatccccagcactttgcacttcgggagaccgaggcgggcggatcacctgaggtcaggagtttgactagcctggccaacacggtgaagccccgtctctgctgggaatacaagaattggccgggcgtagtggcgggcgctgtaatcccagctgctcgggaggctgaggcaagagaattgcttgagcctaagaggtgaaggttgccgtgagctgagatcgtaccattgcactccagcctgggcgacaagagtgaaactctgtctcaaaaaaaaaaagataagataggtgtcctgaataagataggtgaaatgggtgaggatgtactttatcttacacggtcttagggagtgtctcaggcggtgaacagaactctctcgcccctgagctggggcctggctgacccagagctatttgtgtgcccacctgtcaccctctttcaggaccacctgcttcaggttgccagatttagcaaataaaaataaggatgcccagctaaaattggatttcagacaagcaaggactaatgcaatatttgggatgaacttctagctaaa

SEQ ID NO: 410554 - DNA, 560 bp, Homo sapiens
tttttttttgagacagagtttcgctcttgttgcccaggctggagtgtagtggtgcaatctcggctcactgcaacctccacctcatgggttcaagcgatcctcctgcctcagtctactgagtagctgggattataggcatgcaccaccgtgtccagctaatttttgtatttttagtagagatggggttttgccatgttggtctggctggtcttgaactcctgaactcaggtaatccacctggctcgtcctcccaaagtgctgggattacaggtgtgagccaccaagcccagccccacacttcctctttaatgctgcacaaccaatgtcaccaggctccagacgaagaggcaagcctaggaaggtgatcccaagcacccacaaactgctccctaaaaagactaaatatgaccgggcgcactggctcatgcctacaatcccagtgctttgggaggctgagggaggagggtcacttgaggctagttcaacaccagcctgggcaacatagtgagacccccgtctctaaaaagaaaaaagaaaagaaaaaaattagcaatggtggt

SEQ ID NO: 410555 - DNA, 319 bp, Homo sapiens
tatcgcttgagcctgcggggtggaggttgcagtgagtcagattcactccactgcaccccagcctggacaacagagccagatcctgtctcaagaaaaaattttttttagatattcatgtgggatatggatggataacctcacagaataggaggtctggtaaaggaggaatggttattgggtcagtgggtcaccattcatatctgctccatgacagaagggcttagggggagtggtgagtgatgtcagatttgcattttgagaaaataactaactacaatatagagaatagataaaagggagaggcaagagttgaagtggg

SEQ ID NO: 410556 - DNA, 416 bp, Homo sapiens
tggtgagactgagtcttcctctgttgcccaggtttgagtgcagtggcgtgatctcagctcactgcaacctccacctcccaggctcagacaatcctcctgccacagcctctggaggagctgggattacaggcatgtgccaccatgcccggctaatttttgtatttttcgtagagacggggtttcaccatgttggccaggctggtcttgaactcctgacctctggtgatctgcccgcctcagcctcccaaagtgctgggattacaggtgtgaggcactgcacccggccagatttcactattcttgcatccacgtgattctcattgctactgctctagttcaggccttctttgcttctcagctggactagagtaatgacttttaaatacctccccctcctgttcctgatacttcgtttc

SEQ ID NO: 410557 - DNA, 671 bp, Homo sapiens
gactacttatgtaaaaacaaaaaacatagataagttttattctcatgttaattatttttaacgtcaggctcttactgtgttgcccaggctggagtgcagtggctattcaccggaacagtcatagctaaaaacagccttgaactcctgggttcaaacgatcctcccacctcagcctcccgagtagctgggaccacaggcacacaccaccatgcctggttttctcacatttataaatgcacagtatagggtccaaaaggataaaacagcacttttttttttttttaaactatggtaagctctgcagagaagggcagaattgggagggcggaaagaaggcttctcgctctaaatatatttggaatatttatgtattacatttgaatttttaaaacctacttttccatttttgaaattacgaccctcaaccttctcatttctattctaagtagaaataattctgctaaccttctgtgatcacactagttcttttcaatcaccatgtatgagtctggggttgaaaatcactgaagcgctcccacagagtgaacccattatttccaggattaatcatacctcctgctctcaggagggttaaaccagagtgaacagtgagtgctttccatatttctcaagagtggaactgtgataattccatagtaaacacggggagg

SEQ ID NO: 410558 - DNA, 600 bp, Homo sapiens
tcatcaagagttcatataactagacctgtcttggagcaatttttatcttttgcaaaataccttgatggtttatctcatggagcacctttgctgaagcagctttgtgatcatatttgtttattaacccagccatctggatacatacacctgcaaagggctggagagcaatgggcgatctcggctcaccgcaatctccgcctccctggttcagcccattctcctccgtcagcctcccgagtagctgggattacaggttcagctttccctatacacatatttgtctgctgaatttattggaactgctaccatctacaccaccatacgcagagtaggaacagtattacagctaatgcacaccttaaaatattactactgggttattaatcctgctgacagtagtggcattacacctaaaggattaggtatgtataacacttccactgtatttacatttgcctatgattattctgtattctgagtactgttaaagtgagcagtgtacatgactatgaaatcactgaaatgttttctttcttatatagcaaactggcatattgagaattgtttgtggtaaagaagtttagggcttttcaatattaa

SEQ ID NO: 410559 - DNA, 501 bp, Homo sapiens
tcatcaagagttcatataactagacctgtcttggagcaatttttatcttttgcaaaataccttgatggtttatctcatggagcacctttgctgaagcagctttgtgatcatatttgtttattaacccagccatctggatacatacacctgcaaagttcagctttccctatacacatatttgtctgctgaatttattggaactgctaccatctacaccaccatacgcagagtaggaacagtattacagctaatgcacaccttaaaatattactactgggttattaatcctgctgacagtagtggcattacacctaaaggattaggtatgtataacacttccactgtatttacatttgcctatgattattctgtattctgagtactgttaaagtgagcagtgtacatgactatgaaatcactgaaatgttttctttcttatatagcaaactggcatattgagaattgtttgtggtaaagaagtttagggcttttcaatattaa

SEQ ID NO: 410560 - DNA, 2101 bp, Homo sapiens
tcatcaagagttcatataactagacctgtcttggagcaatttttatcttttgcaaaataccttgatggtttatctcatggagcacctttgctgaagcagctttgtgatcatatttgtttattaacccagccatctggatacatacacctgcaaagttcagctttccctatacacatatttgtctgctgaatttattggaactgctaccatctacaccaccatacgcagagtaggaacagtattacagctaatgcacaccttaaaatattactactgggttattaatcctgctgacagtagtggcattacacctaaaggattagatggtccccggccatcacaaaaagaaattatatcactgagggcatttatgctactttttctgaaacagctgatactaaaggatcgaggggtcaaggaagatgaacttcagagtatattaaattacctacttacgatgcatgaggatgaaaatattcatgatgtgctacagttactggtggctttaatgtcggaacacccagcctcaatgataccagcatttgatcaaagaaatggaataagggtgatctacaaattattggcttctaaaagtgaaagtatttgagttcaagctttgaaggttctgggatactttctgaagcatttaggtcacaagagaaaagttgaaattatgcacacccatagtcttttcactcttcttggagaaaggctgatgttgcatacaaacactgtgactgtcaccacatacaacacactttatgagatcttgacagaacaagtatgtactcaggtcgtacacaaaccacatccagagccagattctacagtgaaaattcagaatccaatgattcttaaagtggtggcaactttgttaaaaaactctacaccaagtgcagagctgatggaagttcgtcgtttatttttatctgatatgataaaacttttcagtaacagccgtgaaaatagaagatgcttattgcagtgttcagtgtggcaggattggatgttttctcttggctatatcaatcctaaaaattctgaggaacagaagattaccgaaatggtctacaatatcttccggattcttttgtatcatgcaataaaatatgaatggggaggctggagagtctgggtggataccctctcaatagcccattccaaggtcacttatgaagctcataaggaatacctagccaaaatgtatgaggaatatcaaagacaagaggaggaaaacattaaaaagggaaagaaagggaatgtgagcaccatctctggtctttcatcacagacaacaggagcaaaaggtggaatggaaattcgagagatagaagatctttcacaaagccagagcccagaaagtgagaccgattaccctgtcagcacagatactcgagacttactcatgtcaacaaaagtgtcagatgatattcttggaaattcagatagaccaggaagtggtgtacatgtggaagtacatgatcttttagtagatataaaagcagagaaagtggaagcaacagaagtaaagctcgatgatatggatttatcaccggagactttagtaggtggagagaatggtgcccttgtggaggttgaatctctgttggataatgtatatagtgctgctgttgagaaactccagaacaatgtacatggaagtgttggtatcattaaaaaaaatgaagaaaaggataatggtccattgataacattagcagatgagaaagaagaccttcccaatagtagtacatcatttctctttgataaaatacccaaacaggaggaaaaactacttcctgaactttctagcaatcacattattccaaatattcaggacacacaagtacatctgggtgttagtgatgatcttggattgcttgctcacatgaccggtagcgtagacttaacttgtacatccagtataatagaagaaaaagaattcaaaatccatacaacttcagatggaatgagcagtatttctgaaagagacttagcgtcatcaactaaggggctggagtatgctgaaatgactgctacaactctggaaactgagtcttctagtagcaaaattgtaccaaatattgatgcaggaagtata

SEQ ID NO: 410561 - DNA, 402 bp, Homo sapiens
ctcctttccatctttcacactcactggaatgtgcctccttcagcaggtctcagaccccactgcttcctcactgctctgcagccgccttatgtgtgttcccctcccccattcttaacctgattagttccagtgtcccatcgtggttgtactgttttccctttcctctctcttctagaagaacctctcacattggttaacctaactcagatagctgaaagtgcctggagaagagctgcaaaactgtgcagactgattccattttagattcaagtgcagagatcttaaatggactataataccagcaaccctgccatgttgctgtagtcgctttggttcccaccctcccttccgttcccactctcccttctcttcgaactgtcaccatgcttcttacttgcagcc

SEQ ID NO: 410562 - DNA, 374 bp, Homo sapiens
ttttttttttgagatggagtctcgctctgtcatccaggctggagtgctaatttttgtatttttactagagatggggtttcaccatattggccaggctggtctcaaactcctgactttgtgatctgcccacctcagcctcccaaagtgctgggattacaagtgttggtgccgtgagctgcgcccagccaactactgtgacttctaaaaggtgaatattataaaattctagcttaaccaatttccctccgcttcatcgaattttggacatttgaacttcataacaattcatttttgttttgtttcgttttgttttgagacggagtctggctctgtctccagggtggagtgcagtggcgcaatctcagctcactaca

SEQ ID NO: 410563 - DNA, 445 bp, Homo sapiens
tcccggatccaagtgatcctgctgtctcagacttcctagtaggtgggactactggcatgcgtcacgacaccaggctaatttttgtatatttagtaaagatggggtttcaccatgttggccagactggtctcaaattcctgacctcaagtgatctgcccgcctcggcctcccaaaatgctgggattacaggcatgagccactacatccggccaaatatattctttttcaaagaagtgaactcaagtaatttacctctgtagtcctagaatgtatacattttaagtgtaaaaacccttcataaagaatcacttttctggccagacatggtggttcacacctgtaatcctagcactttgggagccaaggcgggaggactgtttgagcccaggagtttgagaccaacctctgcaacatagtgagaccctgtctctaccgaaaaaaaaaa

SEQ ID NO: 410564 - DNA, 421 bp, Homo sapiens
gagcaagaacgcatccaggaggtcctggccggcactgggcaggagagcgttctacccagggagccgggggacccctgagagctcagacagcccagcctccgtacatgcaaagcagctgtgctcagaaaccaaaagaggaatgacaaattgctgagggcaaggaaagctgctctctgacccaagtgtgccaaattagggcaaagccaagcctgtcagagagaaaggaaatacagctgagaatcaggaattttaatttttaagagccacacatggtcttccatcttgtttctttgtaactgcgtccctctcctgctgaagcattgctgttgtgtctgaggcctctgtagcacccacagctgccaacacatgtgctctttctggaaacggacacccccgtggagagctactttgttggctttgt

SEQ ID NO: 410565 - DNA, 409 bp, Homo sapiens
gcacctctcccctgctgccctgtgcttgggccaggaccacagcaacacctgagtcatctcaccttctatctctctggttttcactcacctgcctccccagcttgggtttctttgtgaagagaattttctctctccctcccatctgtgcgctcccagggaagcacagcctgcctggtgacagcttctttcaagaatgctcagggatggccaggcgcggtggctcacgcctgtaatcccaacatttggagagaccgaggcgggaggatcacttgaggccagaagttcgagaccagcctggccaacatggtgaaaccccgtctctactaagaatacaaaaaaaaaaattagccgggcatagtggtgtgtgtctgtaatcccagctactcgggaggccgaggcaggaggatgg

SEQ ID NO: 410566 - DNA, 503 bp, Homo sapiens
gcagccgtagacagtaagtacgtgagtgtgctcagccgtgctcccacaaaccctgtttctgaaaccaggctggggtccacagaggatggatggccacatctgacccaaggcctgtttgtgtatgacctgtgaactaagaatgttcttaatacttttaaagggctgcaaaaacaaaaagaacaaaaaagaatatgcaacagagaccacgtgtggtccacagggccagaaatatttgcgatctggcccttcccagaaagtctgctggcccttgggcagaccacaccatttgcaacaaccaaaattcagtaaaacttcaatgtttctggtccttaagagtcctaaggccagggtggcagcttccagcccagccccaatactcactggtcttctgctgtctcccagagttggcgctggggctggacagccactgcccaggggacgccattgggctccagcttagccggaccatccttgaaccaggcccaggcatcgggggccccgtg

SEQ ID NO: 410567 - DNA, 135 bp, Homo sapiens
tcctggcaaatgtatataagaaaaaatgtcataatttggttgagattctgcatttccttgggcagcactgaattttggctgggggactttatagactagtagttctaggcatctcttgggagcttgctaaaaatg

SEQ ID NO: 410568 - DNA, 341 bp, Homo sapiens
aacacagccacctatgtcaaaagaccaagtgtcccagggtgtcctctgacccaaatctattttggctccacataagaattgtgtcagccctactttaaacatccctcagcatcagggagaatctctggtaaacagaggctgagcaggcctgtggggaggaactcaggctcaggtgaacacagttaggaacctagtaggtccttaataaataatggctagaaggttgggcgtggtagatcacacttgtaatctcaaccctctgggaggtgaagtgggaagattgcttgagaccatgagttcaagaccagcctgggcaacatagtgagacccaccccctccca

SEQ ID NO: 410569 - DNA, 219 bp, Homo sapiens
atcctcagagctttatagcctttcagttgagaaatatgaaacactgaaaatcaaaaacaaatgctggaaatcttctagaatgcaagatattactaatagcctgtaacttctgggggaaaacaggaggcaccatggaccccattctgcgaaaaacctctgttttcccatagaaccccaggaattgacatgaaataaacctttctcaaaatctaagacttt

SEQ ID NO: 410570 - DNA, 1076 bp, Homo sapiens
  misc_feature (992)..(992): n is a, c, g, or t
  misc_feature (1006)..(1006): n is a, c, g, or t
  misc_feature (1064)..(1064): n is a, c, g, or t
agctatgacagaggggacttggagaaccagatgcatgtagccgagcagtggaggagaaccctgctgaaggatttccatgacacctaagttgggatgtggatgtgcgggggtgaggaagataaggctgcaaggtctcctggctgccctactacatgctgcaggctctgcctttcatgacccctggcgacagccagggccccactcctgagagacactggcaacacctcatagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaggcaaactataggataacacagagccctttttgaaaataaattggcattggagtgttttaccctctagctgttttacttagaatgtaacatatgctgcctacccacctcaaaatgtctgtactgcaagagggccctgggcctctgctttccatattcacgtttggccagagttgtagtcccaaagaagagcatgggtggcagatggtagggaattgaactggcctgtgcaatgggcatggagcacaaggggtcacagcatgcctcctgccttaccgtggcagtacggagacagtccagaacatggtcttcttgccacggggtgttgttgtctctggtggtgctgcatgtctgtggctcacctttattcttgaaactgaggtttacctggatctggctactgaggctagagcccacagcagaatggggttgggcctgtggccccccaaactagggggtgtgggttcatcacagtgttgcctttggctcctaaagatagggatctacttttgaagggaattgttcctccaaataaatttgctttaccttggtcctttcttttgngccagtattcaagngggataacttttgacagggtcacatttgggcaaacctgacactggcttgctgcatctnctttggcaacat

SEQ ID NO: 410571 - DNA, 461 bp, Homo sapiens
gtgaagatataggtttggaaaggggatataactttccatggtcaaaagcaaataaactgaacatctcagccagcccatctgcttggagccctctgccttaaagccacatcactctctgagatgaaacaccagccagacagggtgaagacaggagcgagctccaggtttacaagtgataggatccctgtggatttctagttcagactgaaaatccatgaaatttagaataatatggggatagtttacagacatgtgaacttttactgtgtatgttttacttacaatgcaatacctaatacttccactgcgacatcagcaaacatccttagccctgtttgccactgcaccacagagcttttcatgcaaactaacattacagtatgatacaaagaaaactgtttcttcttaagatatttacaatgtgatcaggtttatttaaataaagtccattttatactagc

SEQ ID NO: 410572 - DNA, 428 bp, Homo sapiens
ctaataccatcacattggggattaggagttcaacatatgaattttaaccaggggaggacacaaacatttatatcataataatctctaggaaggtctttgactggcaagtgttacgcagcctgggtggtgtaggacttagggccaagattaggtaagctgagtgaggggtcttgggtgcagagtttaaggaggggtcctcttagagtcatgtaggtgcctcatttgcctcatcctaatttcacccctaacggctaatttcgtgcatgacttgaaggcagtcactgtctctctgaccattagtttcttaacctgtaaaatgaagtggtcagaagactataagtcctgttaggttctctgggtttgaaactgctgcattgttccatagctcctgagacacagctcaccctctccaacctacccactggact

SEQ ID NO: 410573 - DNA, 556 bp, Homo sapiens
ggctttgtagattatccttcactttgacattataagcagaacacagagcaaactccactaaaaattattaactattcattagctctatcttgttaatgataacctttgtttgcaaagacaaaagctggctgatggagtctgctttgatgttccatgtttacactgtatgtgtgtggtctctgtatctgaatatgatattcagcagggataatgtacatatgagaactctaaaagtattgggtttagagtgaaatattgattattttcatattttattaatctctgtctaactgaatccatttcttgactttgattttggaaaggttctctggcgttaattgccatacaaacgagtgctctttctcttaggtaagtgatgtggagagtattatattgctgttccttgcctataaaataaccagattacaaaagtattaaatataaaataaaattacaggagtcagaagtgtgagacttatttctataatgtaacaaataatggattctaccttattactgtaacttcaaagttttattaaaagttgtctaaaggtta

SEQ ID NO: 410574 - DNA, 1886 bp, Homo sapiens
ctgagtgttaataatagctaatacacattgtaattacctggtattatagattatcatgcttaagtgtacctcaatcaccatgagtctgtatcttctaatatcttttactgactgatatggtttggttctgtgtctccacccaaatctcatcttgaattgtacttccataattcccatgtgggagggacccagtgggagataattgaatcatgggggcagtttcccgcgtactgttcttgcagtagtgaataagtcttatgacatctgatgattttatcaggggtttccgcttttgcatcttcctcattctctctctgcctgctgccatccatgtaagatgggagttgctcctccttgccttccaccatgattgtgaggcttccccagccacgtggagctgtaagtccaattaaacctctttcttttgtaaactgcccagtctctggcaacttatcagcagcatgaatggactaatacactgacccataaggaagtgtctttgtttggactaatgacattattttcctacctatttggaacaattcatttaaaacttctcaatattaagaattgtgacaaggattcttctttagttttacataatttcacattatctttttggataaataatttgagtctttatttcctcgtagtaccttgttctcttatcaccttttcttcttttggtcagccatatccagtctttccataacattatttagcaatacttttaaagcacctactctgtgtcaagtactatgctagttgctggatttattacagagaataaaatagacattttctgtactcacaacgtttagagtctagcagggaaaatacatgtaattatacaaagtagaggagagagagagagagacaaaaagggaaagagaaagaaatacacctaactcagatttttgcattccaggtgtcaaaggggttaccaggttaagatggcagaaagaaggagaaaaacggggcctgtcagggataattaatagcattttaaagcctaggagcaagagaaagtatgatgacacagaggacctgaaaatagtggtagaggctatgatagactctaccttttcacaatgaggaaatatggagctcattaatttatatatatatataggtttgcctgacttcgtccaagtacatggaagttttgatggttcatgttgcagtgaagatgagtgaactaaacagagaagctcttacgttgtagaggagtttaaataaacaaggtacagtcatagcattatgctgttatagctggagggtttgcaatgtatttgatcaggagttaagcaaataactaaagagtcaagtggtcatggtataagttggtaagttttgatatggtgaggtagagagtcaaactagagaggggctgctcactctaaagttactcaaaatactctatttatctaacaaagcatgggcttaaaacctctgaatcaacccaactgtcttatttcctagctgaggaaaccaaggcctagagaagttagagaccaaagtctcacaacaagtgagcagcaaagatgggactggaacacgtctcctgactttcacttcgctcacttgctattgtttaaagaaccttttctagaggccaggcacggtggcacttggggaggccgaggtgggcagatcacgaggtcagcagatagagaccatcctggctaacatggtgaaaccccgtctctactaaaaatacaaaaaattagccaggcatggcagcaggcacctgtggtcccaactactcaggaggctgaggcaggagaatggtgtgaacccaggaggcggaggttgcagtgagccaagattgcgtcactgcactccagcctgggggacagaatgagacatgagactccctctcaaaa

SEQ ID NO: 410575 - DNA, 2013 bp, Homo sapiens
cgccgcacgcacgcgcactgcgcccagcatgagggtcgcggctctgatcagtggtgggaaggacagctgctataatatgatgcagtgcattgctgctgggcatcagatcgttgctttagcaaatctaagaccagctgaaaaccaagtggggtctgatgaactggatagctacatgtatcagacagtggggcaccatgccattgacttgtatgcagaagcaatggctcttcccctctatcgccgaaccataagaggaaggagcttggatacaagacaagtgtacaccaaatgtgaaggtgatgaggttgaagatctctatgagcttttgaaacttgttaaggaaaaagaagaagtagaggggatatcagtaggtgctatactttctgactatcagcgtattcgagtggaaaatgtgtgtaaaaggcttaatctccagcctttagcttatctttggcagagaaaccaggaagatttgctcagagagatgatatcatctaacattcaagcaatgatcatcaaagtagcagctttgggtttagatcctgataagcatcttgggaaaaccctggatcaaatggagccttatctcatagagctttctaagaagtatggagtacatgtttgtggagaaggtggagagtatgaaactttcactttggattgccctctatttaagaagaaaataattgtggattcatcagaagtagtcatacattcagctgatgcatttgcacctgtggcttatctacgctttttagaattgcacttggaggacaaggtgtcctcagtgcctgacaactacagaacatctaattatatatataatttttgaaaagtgttttggaacattgttcattaaaccaccatttctatacaaaaaaattgcatagtattttctcagttactatgactagtttatttttttctcatgactcttatttttttagagaaacatactttcactagaagaggttagtggaaccatttattaattgggaaaatgtcgacggcatgttcattaatagtgccaactttcttggaattcactctttctctttcgttaacacatcttccctatgaccttttttttcttttatttcatctataaaccccatttctgtagcatttctttttttatcacactagtttcttttcctccttctctctttcttgctccaatccctaccaataatgtcatgatgcagaggcatttgaaaatgaagatgaaaagatggtcactttatttagccagtcaagcttattctactgggtgtcgccaaagcgatttatcatttttattttaaatatattcatggttgaagtgtttcaacgttattggacaattaggaagaatgtccttaactcttacaagttattttataactgatttttaaaatgctgtttttcagtattaactatgttgaccttagaaaacttttacaaaaaatagactttatgttttagaacagttttaggttcacagcaaaaatggagcagaaaatgcagagatttcccatataccctctacctccacacattcacagcctcccctaccgtcaatgtcttataatagagtggtacatttgttacaactgatgaacctacattgacacattattatcacccaaagtccatagtttacgtgagggttcactcttggtgttgtacataatatgggttttgacaaatgtgtaatgacatttgtcaaccgttatagtattatacagaataatttcactgccttaaaaaatcctctgtgttttacttattcatccctccctctcctttaacccttagcaactgatcttttcactgtgtacatagttttgcttttaccagaatgtaatgtagttgaaatcatacagtatatagcttttcatgcagtatatagcttttcagattggcttctttcatgtattaatatgcatttaggtttctctgtatcttgtcatgtatatgtagctcattttttttttagtgtagaataaaattttattgtctggttctaccaca

SEQ ID NO: 410576 - DNA, 1712 bp, Homo sapiens
ccttgtgtgccttgctgaggagtttggagaccccattctgaaaaagaagaagtagaggggatatcagtaggtgctatactttctgactatcagcgtattcgagtggaaaatgtgtgtaaaaggcttaatctccagcctttagcttatctttggcagagaaaccaggaagatttgctcagagagatgatatcatctaacattcaagcaatgatcatcaaagtagcagctttgggtttagatcctgataagcatcttgggaaaaccctggatcaaatggagccttatctcatagagctttctaagaagtatggagtacatgtttgtggagaaggtggagagtatgaaactttcactttggattgccctctatttaagaagaaaataattgtggattcatcagaagtagtcatacattcagctgatgcatttgcacctgtggcttatctacgctttttagaattgcacttggaggacaaggtgtcctcagtgcctgacaactacagaacatctaattatatatataatttttgaaaagtgttttggaacattgttcattaaaccaccatttctatacaaaaaaattgcatagtattttctcagttactatgactagtttatttttttctcatgactcttatttttttagagaaacatactttcactagaagaggttagtggaaccatttattaattgggaaaatgtcgacggcatgttcattaatagtgccaactttcttggaattcactctttctctttcgttaacacatcttccctatgaccttttttttcttttatttcatctataaaccccatttctgtagcatttctttttttatcacactagtttcttttcctccttctctctttcttgctccaatccctaccaataatgtcatgatgcagaggcatttgaaaatgaagatgaaaagatggtcactttatttagccagtcaagcttattctactgggtgtcgccaaagcgatttatcatttttattttaaatatattcatggttgaagtgtttcaacgttattggacaattaggaagaatgtccttaactcttacaagttattttataactgatttttaaaatgctgtttttcagtattaactatgttgaccttagaaaacttttacaaaaaatagactttatgttttagaacagttttaggttcacagcaaaaatggagcagaaaatgcagagatttcccatataccctctacctccacacattcacagcctcccctaccgtcaatgtcttataatagagtggtacatttgttacaactgatgaacctacattgacacattattatcacccaaagtccatagtttacgtgagggttcactcttggtgttgtacataatatgggttttgacaaatgtgtaatgacatttgtcaaccgttatagtattatacagaataatttcactgccttaaaaaatcctctgtgttttacttattcatccctccctctcctttaacccttagcaactgatcttttcactgtgtacatagttttgcttttaccagaatgtaatgtagttgaaatcatacagtatatagcttttcatgcagtatatagcttttcagattggcttctttcatgtattaatatgcatttaggtttctctgtatcttgtcatgtatatgtagctcattttttttttagtgtagaataaaattttattgtctggttctaccaca

SEQ ID NO: 410577 - DNA, 290 bp, Homo sapiens
cagcatgagggtcgcggctctgatcaggtaatgcggtcctggagccgcctccttcctcctaggccaggctctcgtcccttccagccgccgctagcgccgaaagagtgggtgtctccgtctgagtcgcgcgttgggggttccgcggctcctccgagccacaggaagaggcggagccttcgctgttgccggcccgcatgtgcctcggcccctggctggcgcgcctcctccctgtctgtcgctctctggtcttctagcccttaaacttggattcccattggattcaagtggga

SEQ ID NO: 410578 - DNA, 1182 bp, Homo sapiens
  misc_feature (1034)..(1034): n is a, c, g, or t
cgccgcacgcacgcgcactgcgcccagcatgagggtcgcggctctgatcagtggtgggaaggacagctgctataatatgatgcagtgcattgctgctgggcatcagatcgttgctttagcaaatctaagaccagctgaaaaccaagtggggtctgatgaactggatagctacatgtatcagacagtggggcaccatgccattgacttgtatgcagaagcaatggctcttcccctctatcgccgaaccataagaggaaggagcttggatacaagacaagtgtacaccaaatgtgaaggtgatgaggttgaagatctctatgagcttttgaaacttgttaaggaaaaagaagaagtagaggggatatcagtaggtgctatactttctgactatcagcgtattcgagtggaaaatgtgtgtaaaaggcttaatctccagcctttagcttatctttggcagagaaaccaggaagatttgctcagagagatgatatcatctaacattcaagcaatgatcatcaaagtagcagctttgggtttagatcctgataagcatcttgggaaaaccctggatcaaatggagccttatctcatagagctttctaagaagtatggagtacatgtttgtggagaaggtggagagtatgaaactttcactttggattgccctctatttaagaagaaaataattgtggattcatcagaagtagtcatacattcagctgatgcatttgcacctgtggcttatctacgctttttagaattgcacttggaggacaaggtgtcctcagtgcctgacaactacagaacatctaattatatatataatttttgaaaagtgttttggaacattgttcattaaaccaccatttctatacaaaaaaaaaaaaaaaacccgggcctcctatgccggcgggcggcaaccacgcagctcctcgacgtgccagtgggtcaaagctggttcctggccccggttttcctgtgtccaggggcaatcggcccgctccccaaaggagagcgaataaattcgaaagcanggacgggaaagcgcacgacagcacccaacacccaacacacaacacacagacaccaacacccgcgcacacccacaacacacaccaccacacaccacaccacccaccgagcacccacgcgcacacacacagtaaccacccccaccaccca

SEQ ID NO: 410579 - DNA, 1697 bp, Homo sapiens
gagaggattggaggaggaaggaactgggggtcccggacgcctgggcctaagtgagaaggggactaggggcctggactcctgggtctgactgaggaggggccaggagctaagcctcagcacctccagcaatgaagctgggaagtaagtctcctggcgccttgaggggaccagggttggtcccttggatacctaggacaccttctcacttctgctggctccagatcctgtgcagatcggcagggtccaacaggacaccccagggaaggtgctttccattgtgaaccagctctacctggagacccacagaggctgggggagggagcagacccctcaagaaacagagccagaggctgctcagagacatgatccagcccccaggaaccctgcgcctcacggggtctcctgggtgaaaggcccgctcagcccggaagtggaccatcctgggccggctctcgccagcctactggaagaggaggaggaagaccttgaaggaaaggaggaaggaagggaggacgaccctgaagaggaaggccctgaggacgtgctcaccattcacgtccagtctctggtcagggcccggagcagctacgtggccaggcagtaccgaagccttcgggtgcgcatcgcctcagattctgggggtccccacgggtctggggacccggccacggagctgcttcaggatgtgcggcacctccttactgacctccaggatcacctggcaaaggactcctacatcagggctgtctttggaagcaggggtcctgggctccccaagaaggacgaggatccaggccccgcgctggagacggcggtgtgccaggcggtgctggcgcccctgaagccggccctgtggacacgactccgcacactccgagcaccggagctgcggcggctgcggcggcgacagacagccctgcgggcgggggcggggcctccgggggcacaggggccgggaccggaagggcagagcctcgcccccgccttgcggagccgcatccacgagcgccttgcgcacctccacgctgcctgcgccccgcgccgcaaggtggcgctcctcttggaggtgtgcagagatgtctatgcgggcctggctcgaggcgagaaccaagatcccctgggggccgacgccttcctgccggcgctgaccgaggaactcatctggagcccggacattggggacacgcagctggacgtagagtttcttatggagctcttagatccagatgagctgcggggagaggctgggtactacctgaccacgtggtttggggcgctgcaccacattgcccactaccagcccgaaacagaccgcgctccccgggggctcagctccgaggcccgcgcctccctgcaccagtggcaccgcaggcggacgctgcacagaaaggatcatcccagagcccaggtgactgcccatctggctgcaagtagaagggagggtgagacctggtgcccttctgacccagctcccacctctccccacaggccaacctgccctttaaggagccatgggcagaagagactgtgacagggaccagtgacaactaggggtttcacacccctccgttcatgcctgtaatcccaacattttgggaggccaaggtgggaggattgcttgagcccaggagtttgagaccagcctgggcaaaacagtgggacccccatctaccaaaaaaaaaagtaaacaaacatta

SEQ ID NO: 410580 - DNA, 1617 bp, Homo sapiens
gagaggattggaggaggaaggaactgggggtcccggacgcctgggcctaagtgagaaggggactaggggcctggactcctgggtctgactgaggaggggccaggagctaagcctcagcacctccagcaatgaagctgggaagtaagtctcctggcgccttgaggggaccagggttggtcccttggatacctaggacaccttctcacttctgctggctccagatcctgtgcagatcggcagggtccaacaggacaccccagggaaggtgctttccattgtgaaccagctctacctggagacccacagaggctgggggagggagcagacccctcaagaaacagagccagaggctgctcagagacatgatccagcccccaggaaccctgcgcctcacggggtctcctgggtgaaaggcccgctcagcccggaagtggaccatcctgggccggctctcgccagcctactggaagaggaggaggaagaccttgaaggaaaggaggaaggaagggaggacgaccctgaagaggaaggccctgaggacgtgctcaccattcacgtccagtctctggtcagggcccggagcagctacgtggccaggcagtaccgaagccttcgggtgcgcatcgcctcagattctgggggtccccacgggtctggggacccggccacggagctgcttcaggatgtgcggcacctccttactgacctccaggatcacctggcaaaggactcctacatcagggctgtctttggaagcaggggtcctgggctccccaagaaggacgaggatccaggccccgcgctggagacggcggtgtgccaggcggtgctggcgcccctgaagccggccctgtggacacgactccgcacactccgagcaccggagctgcggcggctgcggcggcgacagacagccctgcgggcgggggcggggcctccgggggcacaggggccgggaccggaagggcagagcctcgcccccgccttgcggagccgcatccacgagcgccttgcgcacctccacgctgcctgcgccccgcgccgcaaggtggcgctcctcttggaggtgtgcagagatgtctatgcgggcctggctcgaggcgagaaccaagatcccctgggggccgacgccttcctgccggcgctgaccgaggaactcatctggagcccggacattggggacacgcagctggacgtagagtttcttatggagctcttagatccagatgagctgcggggagaggctgggtactacctgaccacgtggtttggggcgctgcaccacattgcccactaccagcccgaaacagaccgcgctccccgggggctcagctccgaggcccgcgcctccctgcaccagtggcaccgcaggcggacgctgcacagaaaggatcatcccagagcccaggccaacctgccctttaaggagccatgggcagaagagactgtgacagggaccagtgacaactaggggtttcacacccctccgttcatgcctgtaatcccaacattttgggaggccaaggtgggaggattgcttgagcccaggagtttgagaccagcctgggcaaaacagtgggacccccatctaccaaaaaaaaaagtaaacaaacatta

SEQ ID NO: 410581 - DNA, 1601 bp, Homo sapiens
gagaggattggaggaggaaggaactgggggtcccggacgcctgggcctaagtgagaaggggactaggggcctggactcctgggtctgactgaggaggggccaggagctaagcctcagcacctccagcaatgaagctgggaagtaagtctcctggcgccttgaggggaccagggttggtcccttggatacctaggacaccttctcacttctgctggctccagatcctgtgcagatcggcagggtccaacaggacaccccagggaaggtgctttccattgtgaaccagctctacctggagacccacagaggctgggggagggagcagacccctcaagaaacagagccagaggctgctcagagacatgatccagcccccaggaaccctgcgcctcacggggtctcctgggtgaaaggcccgctcagcccggaagtggaccatcctgggccggctctcgccagcctactggaagaggaggaggaagaccttgaaggaaaggaggaaggaagggaggacgaccctgaagaggaaggccctgaggacgtgctcaccattcacgtccagtctctggtcagggcccggagcagctacgtggccaggcagtaccgaagccttcgggatcacctggcaaaggactcctacatcagggctgtctttggaagcaggggtcctgggctccccaagaaggacgaggatccaggccccgcgctggagacggcggtgtgccaggcggtgctggcgcccctgaagccggccctgtggacacgactccgcacactccgagcaccggagctgcggcggctgcggcggcgacagacagccctgcgggcgggggcggggcctccgggggcacaggggccgggaccggaagggcagagcctcgcccccgccttgcggagccgcatccacgagcgccttgcgcacctccacgctgcctgcgccccgcgccgcaaggtggcgctcctcttggaggtgtgcagagatgtctatgcgggcctggctcgaggcgagaaccaagatcccctgggggccgacgccttcctgccggcgctgaccgaggaactcatctggagcccggacattggggacacgcagctggacgtagagtttcttatggagctcttagatccagatgagctgcggggagaggctgggtactacctgaccacgtggtttggggcgctgcaccacattgcccactaccagcccgaaacagaccgcgctccccgggggctcagctccgaggcccgcgcctccctgcaccagtggcaccgcaggcggacgctgcacagaaaggatcatcccagagcccaggtgactgcccatctggctgcaagtagaagggagggtgagacctggtgcccttctgacccagctcccacctctccccacaggccaacctgccctttaaggagccatgggcagaagagactgtgacagggaccagtgacaactaggggtttcacacccctccgttcatgcctgtaatcccaacattttgggaggccaaggtgggaggattgcttgagcccaggagtttgagaccagcctgggcaaaacagtgggacccccatctaccaaaaaaaaaagtaaacaaacatta

SEQ ID NO: 410582 - DNA, 592 bp, Homo sapiens
agcgtggtggggagagccttgagagttggagccaggcgggagagggtagcactggtgggaggaatctatgcggtcctgaagattctgatcccctgggggccgacgccttcctgccggcgctgaccgaggaactcatctggagcccggacattggggacacgcagctggacgtagagtttcttatggagctcttagatccagatgagctgcggggagaggctgggtactacctgaccacgtggtttggggcgctgcaccacattgcccactaccagcccgaaacagaccgcgctccccgggggctcagctccgaggcccgcgcctccctgcaccagtggcaccgcaggcggacgctgcacagaaaggatcatcccagagcccaggccaacctgccctttaaggagccatgggcagaagagactgtgacagggaccagtgacaactaggggtttcacacccctccgttcatgcctgtaatcccaacattttgggaggccaaggtgggaggattgcttgagcccaggagtttgagaccagcctgggcaaaacagtgggacccccatctaccaaaaaaaaaagtaaacaaacatta

SEQ ID NO: 410583 - DNA, 1387 bp, Homo sapiens
tcaacattcttaatgtgaatggccaccctactataggaaggtgcatcacataaacaccgtgtttatcgatgccaccacctccacgtctagaagggacaaaggcagcgaggagatccagagaccgacggggagatggtggctttcaggcttctggtgtgggtgcatgggggaaaggtacaatggttaactttccatcaaaaatacggcaccacacgatggtcttgagaagacacactcggtcttctggtttagaagcaaattgacttcctgaagctgtgaagcgaactatcgcaaaactctcttgcttcttgaatgtgggggcgatacaaattcaattaatgatgccatacacgtaatcttttcgactttttagaagtcacaaacgctttaactctccagtgaaaataattgaaagaggttaaacataaggggaatgggctttttttttttcttgtttttatttgggacaatttttcaaatgataaaactgtataaatacaagctgggtcagtcaaggaaagcgctgtggctgaagattttcgtaaaaaccttagtaaacgtggcatttaagtaactaattatgctttgccattagcagaccattaagataaacaggagaaagttcacactcctgctatttcgttccctaagaatagtcacaaagataataccaggctagttggtgggttatcttctccattaggagggttaatgtttaaatttgttaattaaaatacaaaaaatttggtttcctacacagccaacgttgtgagggaagtctcacggggacatcctgactccttgaaatttaccttttgttactttatcctgtggcattatcccctggagtcatatagggtttcaagactgttaatgttgcagggaatgtgagtgaatatgttagaagtctggactttcttctcccttatcataggtgactggcatacacactcctcataaagagaagttatggctcatcaaaagagtgactttatgagcattaatagaataataaatcttgcacttttagttcaagaaacagtgaagtcctataatcagagtgacccacgcaaatatgatccattcacttgcccaactctgacaggatacggatagtctataaatcattttagtttttaaaaccttaaaaaaggaaggcacccaaatctcccaaaggaaggtgtttatggggggaaagggacttctagcaaacctgcaggaagagatcatggaaaaacgaacagtcggtccagaagctgaattagatagactttccaccgaaacaagaatggatagatgttccaatgtcattgtttcagtatttatgttctatcatttaaaaagagaaaagtcttcctgcttcctgaaagctatacaaaaaaaaaaa

SEQ ID NO: 410584 - DNA, 1903 bp, Homo sapiens
gcaccgggaaaataacaatcgtatttcaggttgaaagctcctattactgctgggttttggaggctgcgataaaatcttcatcgacgtgaaggtaccttctgggttggcttgggtcgtaagtcctaagatgggggccgtccttccctgggggcagggacgtagggaaccaggcggtggggagggagaaaggagcgacgaggtcagaggaaaccttgggtttccaaggctcctggggcaccaaagggcttcccgcagtcggggaattgagccctggggaggagccttttgcgagaacgtgagcgcgccccaacacgcctcagacctcgtaaacccacttggcaaagaccggggaagcggctggcggaccgactgcggtgaactcaagaaattaacctgcgctgcaactaaacgggctgccgccctttcacactcacctcgagcgaccgagatagagaaagctcccgaaccggccgcggggggacttggctccaccctcccgtcccgggagaagaggacaaaaaggggagatggacttggaatggccccgcccttcacagcgctccaatccttggaaaccaaacctcctctccaagcctccacgtctagaagggacaaaggcagcgaggagatccagagaccgacggggagatggtggctttcaggcttctggtgtgggtgcatgggggaaaggtacaatggttaactttccatcaaaaatacggcaccacacgatggtcttgagaagacacactcggtcttctggtttagaagcaaattgacttcctgaagctgtgaagcgaactatcgcaaaactctcttgcttcttgaatgtgggggcgatacaaattcaattaatgatgccatacacgtaatcttttcgactttttagaagtcacaaacgctttaactctccagtgaaaataattgaaagaggttaaacataaggggaatgggctttttttttttcttgtttttatttgggacaatttttcaaatgataaaactgtataaatacaagctgggtcagtcaaggaaagcgctgtggctgaagattttcgtaaaaaccttagtaaacgtggcatttaagtaactaattatgctttgccattagcagaccattaagataaacaggagaaagttcacactcctgctatttcgttccctaagaatagtcacaaagataataccaggctagttggtgggttatcttctccattaggagggttaatgtttaaatttgttaattaaaatacaaaaaatttggtttcctacacagccaacgttgtgagggaagtctcacggggacatcctgactccttgaaatttaccttttgttactttatcctgtggcattatcccctggagtcatatagggtttcaagactgttaatgttgcagggaatgtgagtgaatatgttagaagtctggactttcttctcccttatcataggtgactggcatacacactcctcataaagagaagttatggctcatcaaaagagtgactttatgagcattaatagaataataaatcttgcacttttagttcaagaaacagtgaagtcctataatcagagtgacccacgcaaatatgatccattcacttgcccaactctgacaggatacggatagtctataaatcattttagtttttaaaaccttaaaaaaggaaggcacccaaatctcccaaaggaaggtgtttatggggggaaagggacttctagcaaacctgcaggaagagatcatggaaaaacgaacagtcggtccagaagctgaattagatagactttccaccgaaacaagaatggatagatgttccaatgtcattgtttcagtatttatgttctatcatttaaaaagagaaaagtcttcctgcttcctgaaagctatacaaaaaaaaaaa

SEQ ID NO: 410585 - DNA, 397 bp, Homo sapiens
ctaatatgaaaccggtcatttggatagtcctacaactatggaaaattaaattcagaatttaaaagcctcctccaaagaaatgtccaggcctagatggtttcactggagaattctaccaaacatttaaatatgaattaacacctattctactgtctcttccagaaaatagaagaaatgaaaacactttccgacacttctacgaagccacaattactctcataccaaaaccagacaaacccaatgtaaacaaataaaactatagaccaatatccctcatgaatatagatgcaaaaatctttaacaaaatattactgatgggattcatcaatattgaaaagtaattatataccattattaagtggggttcatttcagaaatgtaagtctggtttgatctt

SEQ ID NO: 410586 - DNA, 382 bp, Homo sapiens
cctttattccaggggatggggctctgacaggtgaaacacagcatttgtttaaacagaatagagaaagtctgcaaaacattcaagggcaggaagtagcaataaatactcctctgtgcaactgaagcagcacagagcttggggtgagcagaatgtcatcactcaaagtagaatttggccagggcctcccagggtcccaccaagggatgcagtgaactttctaaaagtcaagacctctgtcttatctcctccaaaagatgagaaagtgagatgtgaagctcctttctggagatgggatatgtttttcatggtaggttctgatctcttttgcaggctttgagcataagaaccaagggcacaaaaatagctccttgaggaaaaaaaa

SEQ ID NO: 410587 - DNA, 340 bp, Homo sapiens
taaagttagcttaggaacgtcaattctgattctattcaatcttgttctggctcttgtagtcactcttctgaggcactcttgttctttgctgtatcaaggtcatacttaaaaagagatgttatttcttgatcagggttttgagaggattacattttcaatgtgaaggttcagccactgttttagaggactgtactaatgagcataagacagaaggtcttggcccaatgtggacccgcattcagttctattctccatgacatctttaacctcagccagctatttcgcaaaagtgagtaatgggtcggctgggcatggtggctcatgcctgtaatcccagcac

SEQ ID NO: 410588 - DNA, 3180 bp, Homo sapiens
  misc_feature (2349)..(2349): n is a, c, g, or t
gggaaagagagctagagataataagtgtgaaacaatgtcacagaatcaatgacggaactcttcccaggacaaaggatgacttttgagttcagtctttgcctttaattctacatggggaggagagcacgtttagccacaaatggaagggattactcatttgagctatttggttatatgattatttccccagagaataggatgtgcagggcattacacaagcagtgccaatagcagcaaagttcttgagagtgctagtaattcaaatggcaggaagagaaggaataaatggtaaggctacctacagttcacagagagctccatcctcactgtggctttggattttgtcctgtgtgaaagagaagtgactgtgaactgacatgctgtgtttggtgttttagaaagatggctgcagcagcggtttggggaatggactgcaggagtggcattggaaacaggaaggttcatgactattgccagagacagaggatgaagcaggagcaaggaagattcaggacaggggactccggggctgatcaggaggcagaactggttgataagtatatgtagcagcataagaaagaaagaatcccagattgacacccaggcttctcacttggaagcctggatagatactgaatgcaatcacaaaggctgggaagtcaatgggactgcagggaagggaagggaagggaggagaagaggaagggcaggagggtccaatatcaatattcagcttttagatgtgttgagcttgaagtgctcagatggagaagtccaggaggcagtagaatacggtggtccagagcacaggagagcaatgtggcttgagttgtcatttgctcacatatttccgtgtcagttacttgtcttagatcacagaacaagttctcctctcacagtttcctggctccacctgtctcatgctcaccgtcagcatcgaaattgagccacaccaggggttctggataccagcttctctctaggtgaggctgctatagtcagcagctgattagttgcagttatcagcaactggtaatataatatattgtgcatataagtgtaccagaagtcatgtttatatattgctgcaaatactcggaatggggatctcttgttccctgcttaagaccacatcacattacttggttttgtacgctagtggctgaaccaaaaaaagtaggagatgattttttttcttttttcttaaagcagtagcttttgaaccttgaccatgctttctaaccagctgaggggcttttgaaaaagagggtgccttactgtgccccagaccaggacaatcagtatttctggggaatggagcctggcacacacacatttcttaaagctcccttggcaattctgaggagtggattacatgttgtatgtagctcgtaacgaaagaaatcttgtctttgctctcagacccccatttcttactcatctcatgagctccttcgagatccagaaacagttgcatatttcattagtaaatcagttccagagtcacattttatttcacaagttagtccattaaaagtttcctgcagtgaggaaatagccagaaagaacactccacccctcctcctttttataactatagggtctggctcgacagagcaggagcatcgccatcttggacaagcccctcattctaaagttcaccttaataaaaaactgcctaaattcaaactgcatcagcctaatggctaaggtcagcatgaccataaaccacaaataacatctccaaccggaaacattcgaaactcctcctcgaccagagacatgctagtcccgagataacccccctccagcagggaagatgccagtctcgggataacctctctctggccggaaagatgcctgccccaagataaacttgcctcctcccagagatattccaaccctgccataaaacttctccctcaaacaggaacattccaaaattctgataatctccctcaccctaaaaccaatatatactcctagtctgtaagagaaagcgctcttgaccaaaattcaccaggagtgcctcccaggttttaactaaagaaaacctctctttaactgccaaaaaaaaaaagggaaaaaaaaaagctttctgcagtggctttcagcgggcccagcatggcagcagcacctgagaacctgttggagatgcacactcttggaccccaccctggcctctgagtaagacactggaagggcaggccccggtctgtgcacacaagtcctcagggagattctgactgatgcatgccagattttgagaactgctgatatactccaggcacatcgcatgctgggatctagatacaccaagggaacaaaataactgcacttgtcctctgnggaccgacttaccttttggaagggctgagaaagagagacacatacaagatcactccctgtaatgcaatgttttataacagatgtgatttgggatttcagtgggagcccaaaagagggactgactaattcagcctctgtgacaaggggagtttctcagaaacagaatgcttagctgggcctccaggcacagggacaggaatgaggaaatacttgtaggccctgtgctccttcagcaaaaccctcagtttcttgttatttttataaatgcaaacatcttattaaagtagatgctaaggcattagaatttcctgctttatttttctaaatgaccatgaggaaacctggaatgtcaaagataaagtgcaacacattctgcatttaaaaattaaaatgatcctttttaaaagtagcaaccagatgtgaaaaattggactggagtccaggttatagttgatagctttaactttctccccaacagcaacagcacaattttccctaaaatgtgttatgaataagtaaaatgactacttcacatcctttaactcttcctacagaaatctaagagagaaatgaaacaaaagtttgcacagttctagacacgataaatacatgtgaaatcacacaactcagaaaatgtcccttaaattaattgagccattggtacttgtgaattagaagagacatctatgttctgatccactgttgaaagctgtacaatgttacctatttatttgcagacatcctttggaaacaaataggtagatttgcaacaaataaagagtggagtacagctgctgacattaccttgtatattcatgcctttatgtaaaa

SEQ ID NO: 410589 - DNA, 178 bp, Homo sapiens
agactgaagatggcatggtgtggtgattggcaggagacattgtgataggactcgagtcccaactctgctactcagtagctctgtgagcttggacaagttaaccaaccatagtctctttatttgtaaaatggggataataatagaccctatatcacatgattgttatcagtattaaatg

SEQ ID NO: 410590 - DNA, 217 bp, Homo sapiens
gctcagtctgcacacagcgggtttggtcagaaatgcctggctcccccgacatgctcatgagattgttaggagatagaactgtgacattggggtgccagtgttctgtaaactgcttcctggcgtacaggtgggggtgctcacctgactgtgaaaaccttcccagaggcagaagaccagcagtggcagcaaggcacgggccacctcctcaggggacagc

SEQ ID NO: 410591 - DNA, 226 bp, Homo sapiens
gtaccaccacacccagcccagaactatttttatattaatactaagaccattacttgccatttcactgtgttgactttcgcacgaatggtgcaaaagcaatggtagctaaagcttctggcaccttagacagcaaggtggtgacaccaaactttactagtagtcattgtattctttgccacacacacgtggtaaaacaaaacaaaaacctagtttcacctaagaatgt

SEQ ID NO: 410592 - DNA, 433 bp, Homo sapiens
ttttttttttttgagacagggtctcactctgttgcccaggctggagtgcagtggtgcagtcatggctcactggagcctcaaactctccaggctcaagtgatcctcccacctcagcctcccaggtagctgggactgcaggaatgtgcatacctgactaattttttttttcttctatatcgtgtagtgatggggtttcaccatgttgcccaggctgatcttgaactcctgggctcaagtgatcttcccaccttggcctcccaaaatattgggatcacaggtataattgtgattgggatcactgtgcctggcctaagatatgatattttatctagaagttttagttatttccagcagtccagatacctatcttgtcattgccttagaaatggaagtctatgattttaaatatatttctaagcctcaacttcctcat

SEQ ID NO: 410593 - DNA, 292 bp, Homo sapiens
ttttttaacagaccagatcttgctatgtcgcccagactggccctccctactctgcctcttgagtagctgggactacaggggtgtgccaatgtacctggtgtgactgaaagtttttgagttggggaatgacagtagaatacaattttaagatgatcaatttggcaacaagatgtaggattagtagaaagtggtagagtttgaaagtcaggtgttaggagattttaataccagttaatacatgaacctaaaactacaaaggtagcagtggaaatggaaagaaaaacactaagtg

SEQ ID NO: 410594 - DNA, 365 bp, Homo sapiens
tcatttgtgattgcacagtggcatacaggagatggagaactagcttggattcatgtttaccctttgatggtggttctcaatgggggacaatttcgtcctccagggcacatttggcagtgcctgagacatgtttgcttgtcacaacctaagaggttgtttactgatgtgtagtgggtagaggctggggctgtttctgaatttcctatcgtgaacaggacagtctccttctcctgctcccccaccccactacaaagaattatttggtccaaaatgccaatagtgctgaggctgagaaaccctttcaaaatttttgtcccaaaatttttactaaattcttgcacataaaatcttttgttttctctgtt

SEQ ID NO: 410595 - DNA, 198 bp, Homo sapiens
aactgtttctaaaatttgcatctttaagaaaaaggtttggtttactatcttttaagaactataagagaaaaggaggaatcatcacattttgagtaagtctgaattaggacaattgcttttctgtcatttagttcgacattcctaagactcttactgggaattcccttcctgggttaggactctcagcttcccaaagct

SEQ ID NO: 410596 - DNA, 518 bp, Homo sapiens
ttcattcacagacatggctaatggaaaatttgtatatgttataaatactatgaaaatggaaactcaagttttcctgtcttctcagatctcatttttaaattcccaagcatctctgtcacttccatgcgccctccacacctagactcactccaagtggaccctgtcctcccattcttaatcactccactcgctgatttcaccctgccctcagatgacttcacgtccttccccttctgatgttgtgagcgcaccagcacctgctggaaatgattcagacaccgggaagctttccaaggtcaccgtgacgatgaaatgacctctacccacatcagctgaacagcccccaactcgacctgtgcttacgatgcagagtagaagccaagagcttaaagctgacaagacactgatctgggtggcgatgaataaagccaagctggctgcttaagagtctcctgggaaacttcttagaagcctccagggttccacatctggatattgaatgcattaggtctgggcaa

SEQ ID NO: 410597 - DNA, 671 bp, Homo sapiens
ttcattaacatagcttctaaggtgtgggcaaggccagtgttctgtgcccaagaaagtctgctgggcacactgtgaccttcactgagtctgctgaatcagcccactttgactcagcccagatatcagaatagcagggcagtggggatggtgttgggataacagcttagttatatgggaaaaaaaataggaatggtttgctccatcacatcaaactgtaaataaatttcagatgcatccaagcactatatgtaaaaatgaaatgaggccagtggggtgggtcctgcctgttattccagcactttaggaggctgaggtgggaggatcacttgagcccaggagttgaagaccaacttgggcaacatgacaaaaccccatccctacaaaaaaatttaaaaaattagctgggcatggtggcatgtgcctgtaattccagttacttgggagtctgaggtaggaggaacgcttgagcccagcaggtcaaggcaatagagcaagaccctgtctcaaaaaaaaaataaaaaagagaaagaaagaaagaagaagaaggaaagaaggaaaggaaaaaaggaaggaaggaagaaaggaaggaaggaaggaaggaagaaagaaaaagaaagagaaaaagggaaggaaggaagagagagagagagaaggaaggaaggagaaaaaga

SEQ ID NO: 410598 - DNA, 470 bp, Homo sapiens
tcagacctctcctgaaagcacatgtttgctcagctccctccctggcgctgttccgctttcctcacttccttgcaggtttctccctagggcctccctcaataaatcaattgcagtgggaggatcacttgagcccaggagttgaagaccaacttgggcaacatgacaaaaccccatccctacaaaaaaatttaaaaaattagctgggcatggtggcatgtgcctgtaattccagttacttgggagtctgaggtaggaggaacgcttgagcccagcaggtcaaggcaatagagcaagaccctgtctcaaaaaaaaaataaaaaagagaaagaaagaaagaagaagaaggaaagaaggaaaggaaaaaaggaaggaaggaagaaaggaaggaaggaaggaaggaagaaagaaaaagaaagagaaaaagggaaggaaggaagagagagagagagaaggaaggaaggagaaaaaga

SEQ ID NO: 410599 - DNA, 509 bp, Homo sapiens
gcacaactgtagccccagccactcgggaggctgacgtgggaggatcccttgaacctgggggcggaggctgctgtgagccttcatcatgccactgcactccagcctgggcaacaaagcaaaaccctgtctcaaaaaaagaaaagaaaaaaagaaactgcttgaaagtcatgacgaagaatgtcaggaggggacttattctggctgcagttgactttctccttaaatgtcaagtagtgattgatttggataagaagtaaactgttacttttcataacatactttaaggaatttatcaaattctatgtataatgcccattaaaatatactccattctggagtaaagggtaagagtaatatttttaaactagttaataaagtctttagctttcacataaaccatgatatttgaggtgtctaaaatcacagggtctttttttttttttcagtcttcccagttgttctctgctctattcctaaataaagttaacttgaaaatgcatggccggttg

SEQ ID NO: 410600 - DNA, 713 bp, Homo sapiens
agcagtcctgaggcgggagcacacaggactaccttgttcagatgaggataatgatgtttggccaactcaccccccaaccttctcactagttataggaagagccaggcctagaaccttctatcctggccccttgccctatgacctcatccctgttccatgccctattctgatttctggtgaactttggagcagcctggtttttcctcctcactccagcctctctccataccatggtaggggggtgctgttccacagaagggtcaggtgtgtctgggaagtcctaagagctgcctggagtttcaaggcattcttaaaaacgttcttgcctaatcagatggtgtcagtagttggcaaagcccctttcatgcgtagtagctgggggtatcgattgatgtttttggcaacacctgtccaattgtaaaatgtacatcctcccttcccccaaaatgcacataccctgtgatccagcaattctgcttctaggatttgtctattagagagatcttttgccttgggcataaagaagtctgctaaaggatgtttgctgcagcactgtgtgcagtaacaaagacggaactcagctaaatgtctgccgttggggacttctcatccccacattgggttagtgtgctgcctttagaagaatgaagcctctgtatgttctcccatggaaacatgctccaatgtatgttgttaagtaaaacaaaaaaaaa

SEQ ID NO: 410601 - DNA, 511 bp, Homo sapiens
accccagctacttaggacatgtcccatgacacacgctgaccctctcctgtggaactagcacccccactagccatggtataggagagaggctggagtttcaaggcattcttaaaaacgttcttgcctaatcagatggtgtcagtagttggcaaagcccctttcatgcgtagtagctgggggtatcgattgatgtttttggcaacacctgtccaattgtaaaatgtacatcctcccttcccccaaaatgcacataccctgtgatccagcaattctgcttctaggatttgtctattagagagatcttttgccttgggcataaagaagtctgctaaaggatgtttgctgcagcactgtgtgcagtaacaaagacggaactcagctaaatgtctgccgttggggacttctcatccccacattgggttagtgtgctgcctttagaagaatgaagcctctgtatgttctcccatggaaacatgctccaatgtatgttgttaagtaaaacaaaaaaaaa

SEQ ID NO: 410602 - DNA, 735 bp, Homo sapiens
ttttcacacataccattctctttctgcttcacagcagtcctgaggcgggagcacacaggactaccttgttcagatgaggataatgatgtttggccaactcaccccccaaccttctcactagttataggaagagccaggcctagaaccttctatcctggccccttgccctatgacctcatccctgttccatgccctattctgatttctggtgaactttggagcagcctggtttttcctcctcactccagcctctctccataccatggtaggggggtgctgttccacagaagggtcaggtgtgtctgggaagtcctaagagctgcctggagtttcaaggcattcttaaaaacgttcttgcctaatcagatggtgtcagtagttggcaaagcccctttcatgcgtagtagctgggggtatcgattgatgtttttggcaacacctgtccaattgtaaaatgtacatcctcccttcccccaaaatgcacataccctgtgatccagcaattctgcttctaggatttgtctattagagagatcttttgccttgggcataaagaagtctgctaaaggatgtttgctgcagcactgtgtgcagtaacaaagacggaactcagctaaatgtctgccgttggggacttctcatccccacattgggttagtgtgctgcctttagaagaatgaagcctctgtatgttctcccatggaaacatgctccaatgtatgttgttaagtaaaa

SEQ ID NO: 410603 - DNA, 393 bp, Homo sapiens
cacacccagcctacaactattcctttattttccaattttgactgtttatacaaaagaaaatctcatatcctttatatagctaatgacactgtataatattgacagttttataatattatcacattgcttcaataaggtgatttttattggcactgaaaatgcattaaattatgcctaacagtttattagtcaatattacaaggcactcaaatttatctttaaaaatctggcacaggaacctgagtcaggatataaacacctatattaccagttgttattagaaaaaggctgttcaacttaaataaccgtgacttatacctatcaaaattccaatgaaattttcaacacaaaaaaaaaaactcccaaaatttgtagggaacataaaaagaccac

SEQ ID NO: 410604 - DNA, 614 bp, Homo sapiens
ttggttgcacaatacagccactgagcttcattctggtttggaaatgttacagctgcaattgataaggtcattttggattggtgcacactcctccatctggaccagagatgccccagtgactgggaaaggagttgtcccttcctttgaatattcagcctcatcactcttaatcccagtaggaggaacctgccgtctttcccattgtctttgcatcctcagctctctccgagcctcaattcttggacccttgggctctgccgatggtagcctatcctggtacgtgcacgcctgggataggtgactgcttgaccatgcccaaatgcgagtacgggaccaacctacttttaggggtgctcaggtaacgaagggggaactagccaggcacagtggctcacacctgtaatcccagcactttgggaggctgaggcaggcatatcacgagtacaagaggccaatatggtgaaaccccatctctattaaaaacacaaaaattagctgggcatggtggcatgtgcctgtagtcccagctactcaggaggctgaggcaggagaattgcttgaacccaggaggcggaggttgcagtgagccgagatcacgccactgcactcctgcc

SEQ ID NO: 410605 - DNA, 373 bp, Homo sapiens
aaatacctagtttctaccagagacagtcacaggcactgtacttctactctggtttgttacctgtgttcttaaaaaaattaaatgctacattttagtaagaggttagtgaaataaaattttaatttttcccatcagaggacatggagcccttgaattctatcccagactcccagggtcttccaggttaacaagtcctgcactaaggaattggctcagtaaaacctcagcattctcacaggaagagcctaaaaaggagactgggataaattagtgagaggtccaaattatgcaattttcttttaaaataaatgcagttttattactttccacttgtagccattataggcagtagattaaatgagtttctagagaa

SEQ ID NO: 410606 - DNA, 485 bp, Homo sapiens
attttcaaaaatgttaagtggatggacaaagatagtcatagtagcatgacagaaggttgaaactgaagcaatcagaaaagtaataataatgaaaaggagtctgagctgctgatccccagaaatgcccagaaatgagagatattaaaggtagggattaaggaagtgactaaaaacattaaaatgggggttgaaagtttgtaaatggaagaattgggctcccagattctttcccacatcatgaagccaggcaactaccccggcttcattttgtcaaagacttgagatatactttgtgaattctgtaattcaactggagaagtactggtcttgcaaatcctaagatcagtttaggacagaaagaaggcactctaggctgggcacggtggctcacgcctgtaatcccagcactttgggaggccgaggcaggtggatcacgaggtcaggagatcgagaccatcctggctaacacggtgaaaccccgtctc

SEQ ID NO: 410607 - DNA, 386 bp, Homo sapiens
aaaacattagcagagttctcattagcatgcataaagaaaaagcacaatggaactagaccaagtggttttcacataagaacagactggaagggctaggatttttcagtttggaatgaaggtttggcaaagatataactacttcttaagtttgattatgggatatgggttaagggcagattagcttatttaccaaattctgtggcatcctacttcattttcacctcccacctcctacacagagtggagatacggtcctaagtataaacaagggtactgccttttgaaagatcatgtccttgcactattaacggtatgaaatggtggctcacgcctgtaatcccagcactttgggaggccaaggtgggtggatcatgaggtcaggagat

SEQ ID NO: 410608 - DNA, 780 bp, Homo sapiens
aacattttttttaaagcctttgtgatatgaagcaaacgaacctcttacattgctggtgggaataaaatggtacacaaatgttagaaaacaaaattggcagattcttttaaagtaacatatatccttggcatatgacctagcaattccactcttacttagtcaaggaaaacatattcacccaagacctgtatattaatatgcatagttgttttattcatgatagccaaaactagaaacaaccgaaatgttcatcaagtgagtggataaacaaataggatccatacaatagaatactacttaacagtaaaaaggaacaaaccactgataaatgcagcaacatggacgagtacatactgtacgattacatttatttgaaattttagaaaaggggacttacctactaaaagcagatcactggttgcctgaggccaggagagagtcaggaattgactgcaaagaaaaatgagagaactttctggagtactggaaatattttagatcttctttggagtggtggctacactggtatataaatttgtcaaaactcatccggtgcatgatcctgaaagcaaaaactgcatttaaaggggtacattttactgtatacaaattgattccaaatccatcttgttctagagcccctgctctttcctcattgtcagccctcctcatttgaagaattcttaggaggcctgagttgagaaagatcctgactctgagcttggaaatgttgggcttgagcaactgaatggccatccctacagatggacaagaatagca

SEQ ID NO: 410609 - DNA, 620 bp, Homo sapiens
tgtgccagttagggttaagtgtttttaatcgattgcagtgccttatggagaaaagaaaatatagatatatatatggcatagtgcttagcacatactagctatccctcttgatgaattaatgagtacttatgtaaatgacaaattaggcgtgtacataaatgacttacaacattttttttaaagcctttgtgatatgaagcaaacgaacctcttacattgctggtgggaataaaatggtacacaaatgttagaaaacaaaattggcagattcttttaaagtaacatatatccttggcatatgacctagcaattccactcttacttagtcaaggaaaacatattcacccaagacctgtatattaatatgcatagttgttttattcatgatagccaaaactagaaacaaccgaaatgttcatcaagtgagtggataaacaaataggatccatacaatagaatactacttaacagtaaaaaggaacaaaccactgataaatgcagcaacatggacgagtacatactgtacgattacatttatttgaaattttagaaaaggggacttacctactaaaagcagatcactggttgcctgaggccaggagagagtcaggaattgactg

SEQ ID NO: 410610 - DNA, 1091 bp, Homo sapiens
caaagcagctctatacatcctgagaaaacatttggggagtgatatactgtagtctttagtactcatcttatgagaaggctgcatgtgtgcctttaggatgcagacattgatcctggctttcactcagtttaattaggactctttaatacatctggttttaggtggtggagaacatgactttcactctgcagattcaggctgcctaataaagatagccctgtagacaatagaaaggaacttagattgagggtcttgctgtcataactgaaccatattcgtatggtgttttagtatggtgaaaacacttaatgctgtctaggaaaacatttgaatatgttgggaagtttagttagattatggcatgaactcaaatccataagattttagcattaaaattatagatttgccatgtaaatgtatttaattaataacattgatcatgatcacttacatctctgaaggaaatattaatgctctgcaaaaaagaagttaacttcttttataggttttcttgttgttgttgcatgacaacaaaaatgtcttcaaggcatagatccaaagttgctttctgtattggaaaaaataatataattgaaaacgtgattagcgaggagtttctacgtacttctccaatatgaatttgcctatggatgcctggtctgtagagccttcaagaaacgtaactgaattaggaaaaaaaacaacacaacaacaccaaaaaaaaaaaaaaaaaaaaaagggggggggggaaaaaaatacccccggggggccccattttggggcccccgttttttgggacaaagggggcccccaaaaggggggcggaaaaaaaaagagaggaggggcggcgtgaacccgcgcggccggggaacaggccgccgggacttcggggaggacccctgcgggggcgcgctcagggaccccccacgaaattaagcccaggaataaactcggtcacgggcaccggtagcgcgagaatgcttcgcttttgaatccgagcgcagtatacacaaagaagcacagacgacccaacacagagtccaaatcacataacacaaaaaacagagatagtagaagtcaggacgagctac

SEQ ID NO: 410611 - DNA, 390 bp, Homo sapiens
ctccaccatacagttctgtacagttcttcagaatctacagtcctttgaattcagaacagttcagtcgtggaaaatgagtgcacctccaatcaccatatgctcagtctacatatctagttaaatacctacatttctttcaccagaggggctatccttttgttgcttatctgcagtttccaatttggtatattcagccatctagtcatttcagtaagaaagtgaatcctgggggactaaagttttttggatctcttaaattctaaaaagtttttgatctgtggatgttgctcagtaaacttcaagtttcctgtacaatctgactatatcaaaatcaactaaaactgtgtttctactctttcctcaaacaaacatgaaagcagtgcttgggat

SEQ ID NO: 410612 - DNA, 296 bp, Homo sapiens
atcctactcaactcatggagagatatattcatctttatatccctagtgcctagtaatggacagagcctcaaatatagtgggagcaacccactgttgaactgaacttaatctccaagagatcacctcaagcaattccaattaagaaacaaattcacaaaagtccaagagaggaccccattaaaaacagatacaggtaattcagttaccatgcatatattctaactagccatagcctcctctgcaatgtccagaactacccacaccataccacaccactctaccctactcaacaatta

SEQ ID NO: 410613 - DNA, 188 bp, Homo sapiens
agcttcaacatgggaaagggaaacgaagacccctatctccactgctcctccatccaatgttccactgaccagccccctttccaacagatctcctttacaggaaagggctcagatgagaagaaaccgttcaaaggaaaaggcaagaccgcctcttcccattccagtgagaagcacatacaaaggcaagg

SEQ ID NO: 410614 - DNA, 382 bp, Homo sapiens
taaacctttaacaatagaggtattgaaagttttctgaatactatcattgaattgatatataagtatgaaccccttgaaaatagtaaaattatctggtaatcacttctgatcatgaatttcaccacttttcagatggaaagagaataacgtctctaatttggatccagaaatctgagattctggatttaagggaactggtgttaagtgcatttgttgataaaagttaatcttactgggccaggcacggcgacgcatgcttgtaatcccaacacttttggaggccaaggcaggaagatcacaaggtcaagagatcgagaccatcctagccaacatggtgaaaccctatctctactaaaaatacaaaaattagctgggtgtggtg

SEQ ID NO: 410615 - DNA, 274 bp, Homo sapiens
attcgcggccgcgtcgacctatgacataggaaaccagttatagatctgatgtttttaatctccaatcctttcatttttcctctacctcttcaactccattgtagatttcacaagaaatcttcaaatatctgtagagagggagatattcaagcagctcttgattctggaaagcaagcatgaacagcacagtgcaattactcaggttctggaaaaaaagtgaaattcacagtgcacaatacctttcaaaagataaagtttaaggttgaacttaaat

SEQ ID NO: 410616 - DNA, 320 bp, Homo sapiens
ctgatttcattttcaaatgctgcacacagaggggctctcatctgtaaggaacggagcaccctcttcaactcctcatcatccttctctgttagtggtgtgagcactgtcatgacatcctctgttgactggcactgtggacagacatactcatcaatgagctctgcctcactctgcaagatgccaatgcagcacccatggtaccaattctgacaccgatcatggccaataaaaaatctgcaagatccgaaatggaaatgtgagttcaaaacagatgggatgatgttacttataataaagcatgcacctgaaaatttgctaaa

SEQ ID NO: 410617 - DNA, 358 bp, Homo sapiens
tgttgttttgagaccgagtctcactctgtcgcccaggctccgtctcaaaaaataaataaacaaatcagactaatttaatgttgttagctgaatcttctgagttattggcaaaaatacctgtgtatttaactttgaggctttttttcagtgagcaaatgatattcattggtaataaaaaaatggctaacaaggaaataactttagaggatggtgtctactatcttagttttcagaagtaatctagataaaatgttaaaatgaaagaattgagtaaatgaaattgggataaatgttttaggtaaactctttgtgtaacttaaaatcttaaaattgtttttgatgttcattggatatctgg

SEQ ID NO: 410618 - DNA, 1201 bp, Homo sapiens
gggctattcttaaacatttaacccttttccctaagattgtgacaaggaaataatgtatattattagcccctctattcaacattctaccagaattacactagctagtgtaataaagaaaaagcaataaaaaacatatagattggataggagaaagtaaatttgtttgcatttgtaggtaacatgattatgtacattcgaaaccccatggtgtctacaaaacaatatactaggacaagtgaatttagcaagattacaaaaatacaaggtcaatagaaaaaaaaagcaattattagcaatttttatactagcagtgaacaattagaaaatgaaaagcatagtttatattagcatcagacatatcaaatgggtagaatgagtctgttgtaagaaattaaagaagaccttgataaatggagagatatatttatggattgaaacactaaaaattgtttaaagctgcccattttccccaaattggcctttattttaatgcagtgtaagtttggtctttgttgttgttgtcattgaggaaatagacaaactactataaaatttacatggaaatgcaaaggttttagactagccaaaacaattttgaaaaaagaaaaaattggaagctttatgctatctgatttcaggactctgtataaagccacaataatcaagacagtgtggtactggcttaaggatagacaaatggatcagtacaacagaatagagtccagaagtagacccatacgtatgtggtcagttgttttttgaccagggtaccaagtccaacggggaaaagaaagtttttaacaaatgatactgaataactggatatctcaaacctttctcactgtttactgaaacattaatttaagattgattacaggtctaaatataaaatccaaaagaataaggctttgggaagaaaacataggagattatcttcacaacattgggataggtaaagatttcttggacatgaactaaaggcagtaatcatcgaagaaaaatatggataaattggacttcaaaaaagttaaaatttctgctcattaaaggacttttaaaaacatagacattgccaggttcagtggctcacaccagtaatcccagcattttaggaggcctaggaggaaggattgcttgataccaggagtttgagaccagcctgggcaacatgtgagacctcgtctctaccaaaaaaaaaaaa

SEQ ID NO: 410619 - DNA, 281 bp, Homo sapiens
acttatagactggagagaaatgtaaacaaacagatgccgtgttaaattgtaactgcgtaaagttaaccatagtacatacggcagtactgtaataattttgcagcaaccttcttttgctgttacggtgagctcaagtgttacaagtatccacttaaaatgctgtgtttaaaatgctctgtgatgctaattgtctctgagctattcgtctctccagtaaattgtgtatcacagtaaaaagtgatctctcgtggttcttgcatagttttcattgtgtttagtgc

SEQ ID NO: 410620 - DNA, 240 bp, Homo sapiens
tgccagagggctcccactgcctattcagtccagacaatagtgaatctccccactctgtgcccagcagtctcagagccagctctgctcacatcttactgtgtatctgtgtgccaataattgtatattcttgacaaaaatgttcttgagatgacacatgctccaaacacctctagactctgcctccgcctccgcccctccgttttccctaatggtacaaaggctgaaagaggatgactatca

SEQ ID NO: 410621 - DNA, 871 bp, Homo sapiens
gataatttattatttgggtattttccaataaatatatcttgtaggaaaacattgttgcttaaaaaaaagtgtgtccttttttaaaaaaatggtgaacaagttttgtctaattcaaagcttattaaaaggttatatataaaacaaggtaaaaggaaccagaaaagaaaaaaaatgtaaataaagttataaaaataaagaattttttcaaggttaaaaagctgaaaaagaaataattttatataagaaagaattttatatggtaaatttagtcctaaaataaaataactggttgtttaacaaggagggatgttcaggacaaaccagaaagtccaagcatgtcatgaacattggtgtaagtcatgataagattttatatatatatatacacacacacacacacaccccaaaagcttttatataatcaagttgtcatattattattaagttttggtttgcttagggaagaaagagctaatttttaaaaaatcaaggttattacatccatgtatcttcctgtgtatgcttttaaagtccttgtaacattgagttacagggctttaactcctgtgtctgaaaaatcacaaacactgatgacaatcaaagcctcatcttaaggccccgtagaagatgccaatcaaaataaactgcattcctgaggcactaggcaagaaattaaagctattcaactcctcaaggcccagggactattgcggaagaggtgggcgcgtaagattgtaagggccgattttgaaagatccagtaagttcagtttctctatgaactaatcattcaagtcaaaggcacactgatgcaaaatcagtatatggacccctgtgtctgattagcaaggttttcttgaagcattaaccaa

SEQ ID NO: 410622 - DNA, 1126 bp, Homo sapiens
aggaaaaggtactcagttccttaaatggaagaaaaaaattttagtgactatttgattgccattttaaagataaacattgcaaagacagaatcaaaaaatatcattttttccttcctcttacaaaggaacaagatacatcagcagttatctttcagaaccatagttactgatttccaatagaataaaattgaatattctttatactgctactgattagtaagtaaactaatatgaaaagaccactagacaagaaaggtcatcttttttctggtttcaaactatgtccctttatagcaataacaatgtttaaaattactagttttaaaatgttttgaaatatagtaaaaatcaaacaaaaaccaaacttaatatttgcttggttaacttcataatgccaaattgtaacagaaacatcagtatctgacagctattttagaaataatagctagtaatgactgaactatgaacttctacgttatatagcaccattaaatgagaagcctcattaaaaattataaattatcaggctcccttacaagctaataactgaaaagaatgctactctcctgagaatatcaagattataaaacttttgtattctgcaccatcacccaatactatatatatccattcaatattatattgatttatttctctcaaattttcatatttaatataatccattatgaaaatattcaaataaactttcaaaaactgaagtgcattgttaaaaaagatcatttcaccagtttttctaacataaatatgaagcttgcttcttcctctcaaataacacaatatgaatatgtcattgtatggtatcacacttctagctaaacctattctaaggcgcttatcattcagataaaggtagacttcttctgaagcacttgtccagggatggtgttcaaaacttgttttcttgccaaatctttcctttccctcatcttcttcatctcagtaaatcacacaccactatctatctagtttctcaagccaggaaccaggaaatcatttctgacaattttcttcccacatccaatccatcatgaatctgtcagttgttcctcctccacacctcaccatctcctctcgattatatgacgtcgggtacgagctcgaatcg

SEQ ID NO: 410623 - DNA, 498 bp, Homo sapiens
tgtcagttgttcctcctccacacctcaccatctcctctctaaaatatatgtataatctggctaccatcatgtttttcctggactactgtagtattacaatatctttactttcacccttgcctttctccaatccattctcaaagtagcatttttaaaatgtagattaaagcgtatcacttctctaattcaaaatcttcaacgactgcaatgtctttagtaaaacctgtaagtctttaatatgccccacaaggccctgtataatctgctttctatctctcatttcagctcatatggttttctgccttattatgcttctgccatcctgaacttttcatttctttcaaatattaagttctttcctgtgtcatagccttcaaacatatttttctctcttccaagaaactcttttctctcctgacctgtcttcttattctgtttccacttagaatcaccaactgagggaagccttctctgagaatacaacattaatttctcccc

SEQ ID NO: 410624 - DNA, 502 bp, Homo sapiens
ctgcccaatctctgctgtaagtcctttccacagcctggcatttgaaagtccaccttcagtgaaaagatagaagaattggaaaggaatatctgcacaggcattcttgaagcctgaattctgcatgaaattaattaagtatccagattcaatagagatttacatgatttatgtggatctcccttgaagaagcaggtttctattataatgaaattagttgaatttcaaattcatcaagcaggtctattacaggatcataggatcagctgattggtttcattctcaggaaagtagcagcatgaagttaattttataaataagaaaaactatgaaatgcttcagttctgacacacgaagcctttgcacttcagtatttcaacaaatatgtctatattaaataagatatcatgtaataatgtttctcttaaatcaatgctataatggacttcacacatcacaaatatagtatggaattttaggtctaaatttagtgtaagacttgaaa

SEQ ID NO: 410625 - DNA, 398 bp, Homo sapiens
ttaaaatttgaagttctgaagactctttaaactcataaatggacaattggtggtttttgttaatgttacatgtaatttttttagctcttttaacataaacaagagttaagtgttgagaaacaacactagctgcacggattatatattaaaaattaagtattagttggctgggtgcggtggctcacgcttgtaatcccagcactttgggggggccaaggcgggtggatcttctgaggtcaggactttgagaccagcctgaccaacatggcgaaaccccgtcactattaaaaatacaaaaattagctgggcgtggtggcgggcacccgtaatcccagctacttgggaggctgaggcaggagaatcacttgaacgcaggaggtggaggttgcagtgagccg

SEQ ID NO: 410626 - DNA, 637 bp, Homo sapiens
agtggcctttcctaggaggctggctggctttctgcttctgggaggctacagttccaccgcagaaatgtgcaggtagcatgtttatctttgaatccaagcctgtgggggaccatcatccattacaaggagtggggtggaattgtgaactattcagaagagcagcaagccaatgggaacatgtctaggaccggggaagccttgtagtttttcttaagcacactgccacgcttcaggccagcccttctgggccacgttggtaacagcaagcatggtctctggaaagccttgtgggaacctccctacccctcctgctggctaaattcgcggccgcgtcgacgttcgtccataccaccctgtgaataatttatttgtatcctacagtttatatattaagttataatcagtttacttgacaactacttctccactccaaaaaaaaaaacaaaaaaaacacacaaaaaaaacctacaattttttaggaaggggactaggtcttccattttttattctctcagtgtttgttattttatcagccttgtaataagtgtttattaaatgcttggggaatgaatcaatgaatgaatgaagcaatcatcaatcaacaaggaacagatctgcaagactagatttaaaaaaa

SEQ ID NO: 410627 - DNA, 347 bp, Homo sapiens
gccttttccctgtctctcctagggaatatcacatcttgagttagggagaaattgctcaggaagaacaggctttgttcctctttcctctggaagcagtatattccttcaaagctttagtgcagtgagtgacattgcccttgaggtatgtaacccagggtgggctgcggttaagtttccctcagctgtggtgcaattgtaccacgctcagtccagactccttctgccctgggtacctcagctgtggtgcaattgtaccacgctcagtccagactccttctgccctgggtacctcagctgtggtgcaattgtaccacgctcagtccagactccttctgccctgggtacct

SEQ ID NO: 410628 - DNA, 270 bp, Homo sapiens
cttcagttctatgggcatctggcttgttggaaaattggcctggtttcattttcccatcctccctttattttggacctccagttacacattttaggccatttgatattgtctcacagtcactaatgctctggtaattgttttcagtcttttttttttctttgtgcttcattttggattgtttctattgctatatctttaagttcactgatttattaaaatctgccagtaatcttcagtgaaattttcatttcaggtgttgtatcatctcta

SEQ ID NO: 410629 - DNA, 662 bp, Homo sapiens
tagtgaattcatttcacaagtgacctatcgcaaagttatttacaaaaaccagttaggatagtttatttatagtgtgttaaagaagcattgggaaatcagctaacataatttgtacatctgtgagacttaacagcttttcctagacatttgctcaatgccagcactgtcttctacagggcatgaggcacataaatagaacctaatgggtgcaaggggctggcagggggcttttggcccattttatttgtttgctgactttactgtactcacattaaagattactgctttgactggttccttaattttgagataactgcattagatcttaatttaactttctgcctcagtatatgtgtttgcgatagaacttgcaaaaaaaaaaaaaaaaaaaaaaacaaggcaaaaccaaactgaaacaaacgaaaacgagacaggaagatgtcacggtgactcaagtacacgtctcacggtcctgcctgtaacaacaacaacataaagtagcttcgaaataagtcattatgagtcgcagggggaaatgaactgacaggaactcatagtgttttagctataaagaggctatgtttctgtccatggagggaacaggatgtttctttcctctttttctcaggtgatgtaaaaaaataaatttatatttaaatgct

SEQ ID NO: 410630 - DNA, 290 bp, Homo sapiens
atgaggagcttcttatgttgtagctggtcatataagaagaaaataaacacaattggatataaactgcctgcttcatacacacagatccaaaccaattcttggggaatgtgctggaactaatgtcacaccccctttggcacattccacttggcagagattgtgtctggagtcctttgtccctccttcaagaaccaaaactccctctggtcacaccccagctgttagattaggaaaagctagctgtgactccttgcatcactgtcaagcaacctaacatgtggcttcccaac

SEQ ID NO: 410631 - DNA, 384 bp, Homo sapiens
gttggggaagccaccccacctctctgagcctcagcttccccgtctggaatttggggatgatcttcgtggctcctggggtgtgcgacgaggccttggttgatggtggggcagaggtagcctagccccaggaacacagtaggtcctcagctggggagagttctacttggaagtcttgcttctccttgtcccaacctgcggggctgtgggaagacccctcagctggtgtgtggcctcaccaggttccttctaagaggatgcaaaagcaagttttcatttgactcggtttcccagaatgtgctctcagagcccaggccaggcaggaggctcttgagaaaaggacaaaaagacatggtggctcacacctgccatcccagcactttggga

SEQ ID NO: 410632 - DNA, 455 bp, Homo sapiens
  misc_feature (30)..(30): n is a, c, g, or t
gctgccgcctactactactaaataggcggncgcgtcgaccatacacatgcatttgaaaagcattaacaattggcctgaataaatatataaagaactattaaaactcagcagtaagaaaacagctaaataaatggacgaaatatttgaactgacaccttgaagacaaaaaacaggctgagcccggtggctcacacctgtaatccaagcactttgggaagccaaggcgggtggatcacctgagttcagaagttcgacatcagcctggccaacatggctaaactccgtctctactaaaaatataaaactaggccggttgtggtggtgcacatctatggtcccagctactcaggaggctgaggcaggaaaatcacttgaacctgggaggcggaggttgcgccactactctccagcctgggcgacagagtgagagtctgtctcaaaaaaaaaaaaaaaaa

SEQ ID NO: 410633 - DNA, 255 bp, Homo sapiens
cgtcacgtgaagatgtgcttgcttcccctttgcccttccaccgtaattgtgagtttcctgaggcctcaccagccatgcctcctgtacagcctgtggaactcttgaaacatggattttttcctaataattgaagacggttcaagaaaatatcttctacaagaaaatatgcaactaggagtcctgcaatgaacgttgtttgctttcttcaatatcaattataataatattttatctttaaaatcagaattttaccga

SEQ ID NO: 410634 - DNA, 2791 bp, Homo sapiens
gcaaccgggcgcggggcgcggagtcggcggggcctcgcgggacgccgggcagtgcggagaccgcggcgctgaggacgcgggagccgggagcgcacgcgcggggtggagttcagcctactctttcttagatgtgaaaggaaaggaagatcatttcatgccttgttgataaaggttcagacttctgctgattcataaccatttggctctgagctatgacaagagaggaaacaaaaagttaaacttacaagcctgccataagtgagaagcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctgataggagaggaaaagtaagcatctctgcagaaagccaacaggtactcttctgtttgtgggcagagcaaaagacatcaaataagcatccacagtacaagccttgaacatcgtcctgcttcccagtgggttcagacctcacctctcagggagcgacctgggcaaagacagagaagctcccagaaggagagattgatccatgtctgtttgtaggacggagaaaccgcttgggtaacttgttcaagatatgatgcatgttgctttctaagaaagccctgtattttgtgattgccttttttttttttttaagatgctttcattttgccaaaataaaacagataatgtggatggtttaagggttatagtattatagtttaaataataacaacaaaattcttcccaggaactctgctggaaggtaaattaaaatacttgtttttccattggtaaaatattgttgcactctgtgaaccaaaagacagtctaagttggaggacatagaacggaactcatcttaaacatactccccaccccgtcttggcctcctcagaccactttggccatccctgcatttggggccgctatggtaatgtgaatgcactgggtacaaacaccgcctgtctaggaccacatttggaattcctgcaggtggccttttgcagcttcaggcaatatggaacaaatgaaggtttatgtgactctaatagaagtaattgttgataggtgttcttcagatccacttctgtttctgattgagttaggcatctctttcatggtaaaacccttttcattaaacacaaagaaagctttttttttttttttttttttacggggcggggaattggccggggggggctttgggtctgtcctccaagggatcattattatttaaatctttgcttgtttctgtgttgaagacagggtgctttcaaatagaggtaatttgctcttgtgttgtaagaggaacatgtcaacaaagataggaaatgagggtgatcgtgca

SEQ ID NO: 410635 - DNA, 368 bp, Homo sapiens
ccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattaggttagtatcaaagtgaacaaatacatgttttatgactcttttctgttactttttattttgtagcgcagtgcttctaggatatttagtagaagaggaatatcattaatttt

SEQ ID NO: 410636 - DNA, 2625 bp, Homo sapiens
cgtcacgtgaagatgtgcttgcttcccctttgcccttccaccgtaattgtgagtttcctgaggcctcaccagccatgcctcctgtacagcctgtggaactcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctgataggagaggaaaagtaagcatctctgcagaaagccaacaggtactcttctgtttgtgggcagagcaaaagacatcaaataagcatccacagtacaagccttgaacatcgtcctgcttcccagtgggttcagacctcacctctcagggagcgacctgggcaaagacagagaagctcccagaaggagagattgatccatgtctgtttgtaggacggagaaaccgcttgggtaacttgttcaagatatgatgcatgttgctttctaagaaagccctgtattttgtgattgccttttttttttttttaagatgctttcattttgccaaaataaaacagataatgtggatggtttaagggttatagtattatagtttaaataataacaacaaaattcttcccaggaactctgctggaaggtaaattaaaatacttgtttttccattggtaaaatattgttgcactctgtgaaccaaaagacagtctaagttggaggacatagaacggaactcatcttaaacatactccccaccccgtcttggcctcctcagaccactttggccatccctgcatttggggccgctatggtaatgtgaatgcactgggtacaaacaccgcctgtctaggaccacatttggaattcctgcaggtggccttttgcagcttcaggcaatatggaacaaatgaaggtttatgtgactctaatagaagtaattgttgataggtgttcttcagatccacttctgtttctgattgagttaggcatctctttcatggtaaaacccttttcattaaacacaaagaaagctttttttttttttttttttttacggggcggggaattggccggggggggctttgggtctgtcctccaagggatcattattatttaaatctttgcttgtttctgtgttgaagacagggtgctttcaaatagaggtaatttgctcttgtgttgtaagaggaacatgtcaacaaagataggaaatgagggtgatcgtgca

SEQ ID NO: 410637 - DNA, 323 bp, Homo sapiens
atcacaagacattaatgaagacctcaaaccctgaatataatcaagcttttagctctaatttccaatctataagaaatgtagaggatagaggaacaaattaagtgaaaccacgaatagacaagatgataaaatctagaatgtggggcctgggcacagtggctcatgcctgtaatcccaacactttgggaggctgagggaggaggattgcatgagtccaggagttcaagactggcctaggaaacatggcaagatgttgtctctacaaaaaaaaattaaaaattagccagggatggtgacatgtgcctgtaatcgtagctacttgg

SEQ ID NO: 410638 - DNA, 849 bp, Homo sapiens
catgttggtctcgaactctgacctcaggtgatccacccacctcagcttcccaaagtgctgggattacagaagtgagccaccgtgcctggcctaaaatgggcatgtttcagtccttatgttattcagcagcatctaacactgttgaccacccctatttcttgacattatctgtttttggtttctacactaccacattcttttatttccttccctacttctttggccttttctgataaatttccctcatttatttcttttcctttgtcaactgacttttgttattgttacccacatttacatccttacttgttctgtatatacaccctccagatatctccagttaaatgcctcacaaagggctcacaattaacatggtcatcatcatctgctttcatgcctttccccacctttaattatctcttgaaaggcaccatcatccattaccctatagtctcaaagcagcaatcatcctgtatttctcccttcttctcacgttaatcaatcatccaaatcctggatttctctctagcacctatctttcatccctcacaatcatgtagctgccttataatctttggctccagtctttaggctgccaacacattatatatgccttactgattctagaagagatctctataaaacagaattctactcaagtcatcacctgtagatttagcagctccccatcacctttaagatcgaatcaagctctttgctatgatacaactcttcatgacacagtctctaagcctcaagtcatgttcctacctactttatcatactttatgtaggcaaattgtttgtgttacagtctttcatgtcttatcttcacatatctcatttact

SEQ ID NO: 410639 - DNA, 271 bp, Homo sapiens
atcctggcagagaggaaaaaagatacatgacaagccatgtgctggcccagaagtaacacatttcaggccacattttatcagccaaagcaagtcacccctgagataattgggtgtggatgtataatcctcccccaggcaggggcatgggaatgtttggcaccagtaatacaatctaccacaggcatttcaagcaaagcatgtctaaaccttctatttattgttttatccccatccaaaacctattcctccccaattttccttttattctatt

SEQ ID NO: 410640 - DNA, 402 bp, Homo sapiens
atcctggcagagaggaaaaaagatacatgacaagccatgtgctggcccagaagtaacacatttcaggccacattttatcagccaaagcaagtcacccctgagataattgggtgtggatgtataatcctcccccaggcaggggcatgggaatgtttggcaccagtaatacaatctaccacaggcatttcaagcaaagcatgtctaaaccttctatttattgttttatccccatctctactaaaaaaaacaaaaattatctgggcatggtggcgtgcacctatagtcccagctacttgggaggccgaggcaggagaattgtttgaagtccagaggcgggggtttctgtgaaccaagatcgtaccactgcactccagcctaggtgacagagtgagactccatctc

SEQ ID NO: 410641 - DNA, 567 bp, Homo sapiens
ttcatctcaaatattataataataaaaataaaatgcatcagtgacctaaatataagtgctaaaaccataaaactcatagaagaaaacaaagggataaatcttcatgaccttggattaggcagtggagtcagatatgacaacaaaagcatgaacaacaaaagaaatattgggtaagttaaacttcatcaaaatcaaagacttttgtgctttaaaggacattattaagaaagtgaaaagcaacagaatgggagaaaatattagcaaatcatagataagggtttactatccagaatatataaagaactcctacaactcaacaataaaaaggccaacaacccaattaaaaatgatcagggttcggtgcagtatctgtaatctcagcactttgggaggctgagatgggaggatcatgggaacccaggaatttgagacatgcctgggcaacatagtgagacttcatctctataaaaaacttaaaaaattagccaggcatggtggcacacactgtgtaccagctactcaggagactgaggtgggaaggttgcttgagtctgggagggagaggtt

SEQ ID NO: 410642 - DNA, 333 bp, Homo sapiens
aaaatggaggttaaaggcagaaactctacaaccaagccacctgtatttgagtccagtcatgtaactttggaaaatttatttagtctcttttgccttgggctcctcacctgtaaaacaggaagagattctattttatcaattctaacatgctttcttattttaacttctttaaaattggggtgcatcttacatttcagtcttacaatccaagacatcttgcaattgctattattgcaattgcaatagagatacaactgtgtgaaagctttttgttagcatcttctagcaaggtcaagaatgcatcatcaatatattttagactcaatgaagcac

SEQ ID NO: 410643 - DNA, 680 bp, Homo sapiens
tgaggtagggcctcgctctgtctcccaggctggagtgcagtagcatgatctcagctcattgaaacctccacctcccgggctcaagtgatcctcctacctccgcctcccaagtagctgggactataggcacacaccaccatgcctggctaatttttgcatttttggtagagagggggtttcaccacgttggccaggctggtcttgaactcctgagctcagatgatccacccgccttggcctcccaaagtgctgggattataggcatgagccacggcacccaggctgccatgatattccttacagtgttgtggagtcagcacagtgagtttgtaagggcttaagaattctgatacttcttgagcatgtcttcctaggtaccgatccttaacctgaactgctgtgagaacggtaaacctattaaaatgcaatgtttgtatgcatcattttacaagcacctgcactactgacacctgtcttagattataaatctctgagaggcagacactgtgtccccctatagtaagtctatatgtcagcaaagtggcaaatacaaggggagtgatttgaggagatgtgtaaatatcacagggctacaatcccaacctgacatcactgggttcaagtcaaggaggtctgagtcacagagttctagaactagataaccttaaacatgatctttt

SEQ ID NO: 410644 - DNA, 855 bp, Homo sapiens
agcctctcttctggtaattatgcccatgacactgtcatttgcaggccttctttaaaattccacttgggcagttaaaagaacataaaatgactttcttagaagctttcctgaaatttaaattaaccacaatcattaaacattccctatgtcaataatttgactttcctactcaaagttttttaaggcatcagttttgtctagcgtggtttttttctttagaaaccatgttggttatgtgtgaattgcccatctttttacaatctctgctcaataagtttatacaatgagtctctggtaagagacagacgtgggagtgaaaatatttctccttaaccacaggaagggattttttacaatgcctttagctgcggataccgagggtacctcacccagcaggaaggagagggaactatacttgggctaaacactttcataaactacttctcatggaaaagaaaatccaaatagtggaaatttctttaaaatatccatgtgccttgagatagaagaaagccctttcgtttaagaaaaatgcacttaaaattaatgaataccttgtgatccaaaaacattttatacatatacgttcaggtgttttgaagtggagtgaacttctatttatagagtgtgttgcgctttattatatagtattatgcatttacattgatgatcaaagaacattgtatctgtgcaggcatgggttccgaaaaggctgaaaaattccaggtgagccgtggcaacaacctctaaaggatctaggaacctaaagaggatctgccttttatttaatagaaatcttagaaacaaaaataactgacatggcttgaatgtcaattgtttaaaaaaaaaaaaaaa

SEQ ID NO: 410645 - DNA, 406 bp, Homo sapiens
gctttataaatgacatttaaaatttcattttattagtcccttgattctgtcttactttaataggtcttgataaagattaggctttttaaattttaatgaatatgaaattcattctgttgtttatggcttacaaatttgtagtatatgctgaagtcttcctccgtaagggatttatttgtttttctaaaactgaaggacagcaatgcatggtggctcatgcctgtaaccccagcactttgggaggccaaggttggaggatcacttgagcgcaggagttcgagaccagcctgggcaacatggcaaaaccctacatgcgggcatgcaccaccacgcctggctcaaattttgtatttttggtacaaaatacaaaagtgagccagacgtggtagtgtgtgcctgtagtccc

SEQ ID NO: 410646 - DNA, 734 bp, Homo sapiens
ggtgttttattttcttcttgtcataagtgtcatattcaaagatccataggttgagctgttgggttggacacatgaaatagaggggacaagatttcatctctttatttcccaccaactactggcagcctttaccttgggaaccaccttggctatttctgccaggaaacactattgagagctccagtcactgctgttttaaatgagactttgggaattgaatcccagtttccctgagcccactcttaatcctttccttctaccaactagacgatattcagatgtggttgccctgagatcagtgccataaaagaattaaaattggcagttcccttccacattatttgatcttaattacagctttgtgagagaagtagagcagttgttatatttcctttttcttgtgtttttcagtttttgaaaaatgatttcagagataggaaaattgagcgctaggccaggtgcagtggtgtgtacgtgtaattccagcactttggacggccaaggtgggcagatctcttgagctcaggagtttgagatcagcctgagaaacatgatgaaactcgtctctacaaaaagtaaaaaagtataggtggtgtgcacctgtagtcccagctacttgaaaggctgagatgggagggttgcttgagtgtggcaggttgaggctgcagtgagccagaattgtgccacagcactccagcctgcgcgacacagcaagaccctgtctcaaaaaaaaa

SEQ ID NO: 410647 - DNA, 666 bp, Homo sapiens
aaaccaagcaaggtaaagctgcccaaacacaccagccctttctcacatccccaggctttagcccctgcagcttcctcttcgtgtaaggcatacgatgtccagctcgtccatccaaggaatcagtatcccatttacctttggtgttcccagcagatggtctgtaagctttgaaactgaatgaataaagtgattttgcctaatgcagaggtgggtttcaaacccaagtcttctgcctccaaattcagtgtttgtttcatgacatcaagtaaagtagatagactactacagagaatttgggtatagtcttggtggcctgctggaatgccaatcttgaaatgatctacttggtttatagggctgcaggaagtgtgttggtgttttattttcttcttgtcataagtgtcatattcaaagatccataggttgagctgttgggttggacacatgaaatagaggggacaagatttcatctctttatttcccaccaactactggcagcctttaccttgggaaccaccttggctatttctgccaggaaacactattgagagctccagtcactgctgttttaaatgagactttgggaattgaatcccagtttccctgagcccactcttaatcctttccttctaccaactagacgatattcagatgtggttgccctga

SEQ ID NO: 410648 - DNA, 497 bp, Homo sapiens
tgtaaccaagttggtaacaacgcaggggaattcttcggtaaaattccttcctcttacaaaatccagctcaccctgcacagtcaacctaattgtcaccgaatataggagaatggggaaactaggatttgcgtgttcaagggcggacaagccagtccaaacaggcattccagtcattgggtgggtgacagccaaagaaggtacgtcattttccttcctaccacccccatctctgaacaattctacagggatgtctgtcagagtgcctacatactatttctgttgcttgtataaccctgatgaagcagtggtgcgcattgtccaatgaaccacgtcgtgtttaaacaacagtcggttaagcaaaataaataagtaaataataaaaattccatccttcctagtgactctccgaggacattggggtcatcaagttaataactccagcctgggggacagagcgagactccgtctcaaaaaaaaaaaaaaaattagccaggagg

SEQ ID NO: 410649 - DNA, 456 bp, Homo sapiens
taccagcgttgtcccactttagcccttgaggccacaaatgcaggaatagctacactcttgaagcaactgtaaccaagttggtaacaacgcaggggaattcttcggtaaaattccttcctcttacaaaatccagctcaccctgcacagtcaacctaattgtcaccgaatataggagaatggggaaactaggatttgcgtgttcaagggcggacaagccagtccaaacaggcattccagtcattgggtgggtgacagccaaagaaggtacgtcattttccttcctaccacccccatctctgaacaattctacagggatgtctgtcagagtgcctacatactatttctgttgcttgtataaccctgatgaagcagtggtgcgcattgtccaatgaaccacgtcgtgtttaaacaacagtcggttaagcaaaataaataagtaaataataaaaattccat

SEQ ID NO: 410650 - DNA, 517 bp, Homo sapiens
tgtaaccaagttggtaacaacgcaggggaattcttcggtaaaattccttcctcttacaaaatccagctcaccctgcacagtcaacctaattgtcaccgaatataggagaatggggaaactaggatttgcgtgttcaagggcggacaagccagtccaaacaggcattccagtcattgggtgggtgacagccaaagaagatccacctggtcacatcccaatttccccagggcatccgaagcaggtctgagcagccaaggataactacttagtctcctgctagaaaatatctcagttgttatccccactttatagatggtcaacttactttatctatctgatgattggctcctacagccagtaagtggtgaagctgagatgtaattccaaggctgctgatctccaaagccagttgtctttccaaatattagaatatactagtgtctgtggtctgttaaaaaaaatgatgacagtgcctttttaaataaaatttaaagcatgtacatgaaaaatactaaaa

SEQ ID NO: 410651 - DNA, 723 bp, Homo sapiens
ttttcatttttctacatatggatatcctgttttcccagcatcatttattaaagagactgtccttttcccccagcgtatattcttggtgcctttgtcaaatatgagttgactgtaaatacatgcacttacttctggggtccctatcctcttccattggtctatgtctctgtttttatgccagtactatgctgttatgtttattatagttttgtcatgtaatttgaaatcaggtggtatgatgtttcccgctttgttctttttgctcaggattgccttagctgtgccagatcttttgtaattccatgtgaattctaggattgtttttctatttctgtgaagaatgtcactggtgttttgattgtagttcacttagggtagtatagacattttaacaatattaatttttatcatccatggcatgggatattttccatttttcatatcctcttcaacttctttcatcagtgttttagttgcctcacagagatttttcacatctttggttaaatttgtattttgatatttttgtagctattgtaaatgaaattgttttcttgattactttttcagatagatctctgttggcatatagaaacactagtgatgtttatatgttatttgtatcttgtaattttactaagatgttatttgtatcttaaaattttacaaattttcagttctaaaagttttttggcagagtcttcaggtttttctaaatataag

SEQ ID NO: 410652 - DNA, 384 bp, Homo sapiens
ctgcctcggcctcctaaagtgttgggattacaggtgtgagccaccacacccagcaagcctggcctcaaacttctgacctctagtgatctgcccgcctccgcctctcaaagtgctgggattacaggggtgagccactgcaccttgcctgaactacatgacttctaaagtcattccagttctaaaattctaggcctctatgaacccaaatgttgtgtagagtgaagcagataaagtcactgttttatacagatatttaggtcctacctaagaataagacctccttctaaatggtaggtcagaagaatcctaactcgcataggttgaacaagatataaaagctatggaggctggagtcagactctgttttagttacctttggccgca

SEQ ID NO: 410653 - DNA, 486 bp, Homo sapiens
tgtctctctgtgatggagaacaaaggacatagaattaaggaattaaccttagagaatgtttacattttaaagagtggagaagaatcaaagagtagtcaaatatgatagaaaatcctgggcgactatttctgagttctgttttgttttgtttttttgccctttaagtagctctctttagtaggaaagggaagaatattgacttgggttagttagttctgatttcaaatttcccctttatcacttacttggcagtatttaaccttttcagagtgtttcactgtcagaaaataggaattcagggttgtgaagattacataaaataaatacataaagcacagtgcttgtgacagagtttctttaacttcattagcaccttccctgtgacttcaagtatagacaggacttttatacattagaatggaatatttgtttaactttgtttatgtctcttgttttctccttccttttgcttccacttaaaaaaaa

SEQ ID NO: 410654 - DNA, 217 bp, Homo sapiens
actccaagaacttcgacttttttttttttaagtagaactagcttgttgtatcagttatctctgacttccttctcggcctggaaaattctcattgcacatgctgtttgacataactacattctattttcaaaatgtctgctcgatttcattgactatttgactaaagtctttacttcctagtttgccagatgccatccactctcaagtactaccttct

SEQ ID NO: 410655 - DNA, 875 bp, Homo sapiens
gtacgctttagttcaattcaaatcactgtattctttccccattgctaacctaatatatgaaacaagcttagctgtctcagaagtttttcaagagatgatcaggaaaaattaatgcacattcaaaaggagaatcttcagtacaaatttgtttttttaaaaatagatttagggctgggcgcggtggctcacgcctgtaatcccagcactttgggaggccgaggcgggtggatcacgaggtcaagacttcgagaccagcctggccaacatggtgaaaccctgtctctactaaaaatacaaaacattagccaggcgtggtagtgggtgcctgtaatccctgctacttgggaggctgaggcaggagaatcacttgaacgcgggaggcagaggttgcagggagccgagatggcgccattgcactccatcctgggcaacaagagcgaaattccatctcaaaaaataaaatagatttagggggtacaagtgcagttttgttacatgggtatattgcatagtggtaaaatgtgggcttttagtgtacctaacacccagagaagcatacattgtgcccagtaggtaatttttcatccctaaaccttttctcagcctcccactttctggagtctccaatgtcggttattccactctttatgtccatatctacacattcaatcctaatttgtaccaagtagcatctcacctttaaatcacaggcttattagttgggtgttttctttttacttatgaaaattcatctagtcaaactgtcaattaatttttcctcatttcattaaaagtgtatatctaatgctttctctaaaaattgatgtactggaaatacaaataaataaatgctccctgtgtagaatttcaacttg

SEQ ID NO: 410656 - DNA, 206 bp, Homo sapiens
aaaagatttaccttcagagtaatatagtatgactgctcatagtcaactttgaagatagaaggaaaccacaagacaaggaacgtgagaagtcaccagaagctggaaaatttgatcacaggacttccacaacagtaaaataataaatttgtcttgttttaagccaccaaatttgtggtactttgttatagcaaccatagaaaactaat

SEQ ID NO: 410657 - DNA, 441 bp, Homo sapiens
tgcaatgcttccattttttcattcacttttattctttacattcaaagtatggatgaaacatttttcagttacaaacagtgctctaatagatattttctacaactgtgcttgtaacgtctgcaagggtttcccagcaaatgcctgctgagggagaagcacatcttcacttttacaggcaccacccagttaccctctgacgagttcccatttcctcattgtcttactacaaaatgacgcagtcagacttacttgtttttaccattaggattgttttttgttttttgtttttttccctttgcatctgcaagtttccaagaccttttaaaaataacttgttattatcctggcccccaaaataagctgctctctaatttttcttacctataactcccacaataaggtggccgtgccccagtctaacaggtacgtagacaagaggtc

SEQ ID NO: 410658 - DNA, 582 bp, Homo sapiens
tgagatggagtctgactctgtcgcccaggctggagtgcagtgctgcaatctcggctcactgcaacctccgcctcccaggtttaagcaattctctgcctcagcctcccgagaaggtggggttacaggtgtgtgccaccatgcccagctaatttttgtattttcagtagagacggggtttcaccatcttggccaggctggtcttgaactgctgacctcgtgatccacttgcctcggcctcccaaagtgctgggactacaggcgtgagccaccgcgcctggcctaaaaacactcttgtcctaatcagagagtagttagttgtctttgtgggagtagggaattggtggtggaaatgttctctatcttgttttgggtagtggttgaattttgacaactgtcaaaattcatcaaatggaagccaggcacagtggcacacacctatatttctagctacttgggaggctgaagcaggaagattgcttgagcccagaagttcaaagccagcctaggcaacatagtgagactctgcctctaaaaaacaacaataaaaaacaaaaatgaacaaacacaaacaaaaaaaccccc

SEQ ID NO: 410659 - DNA, 318 bp, Homo sapiens
ggcatctacttgtcaggggcatattgggacctccgctccaaagaaaaaggtaaatggttgcattttgctttcttaattccacaatggaagtaccatggtttgcaggtctcactgggttttctaaggtaatatgtttcataggaatgtccctttggttcatacatggtttgacataaaagggaatcatctttgagtggtgtctggaacaggaaagagctgtgcagcagatccaggctgtgacacagcagcttgtcttggtgacttcactttaccataagaaaatgccacagaactgggtggcttaaataacagaaattt

SEQ ID NO: 410660 - DNA, 309 bp, Homo sapiens
aatttcaggaaaacaaaataagtatttaataaatatctgttgaatgaatggactaaatgattactaatgaagactacagttgaacaaaaatgttttagggcagtctttctcaaatattaatatgtatatgaatcatctgtgagggaacttgtgaaaatgcatattctcattcattatatccagggtaggacttcatactcagcatttctaaaaagcttccaagtgatactaatgttgctggtccttagacaacactttgaatagcatggcttttggatactagtgtaaaattttattaccgaatacatg

SEQ ID NO: 410661 - DNA, 853 bp, Homo sapiens
tgatgtttcgggcacgctgcagccgactccctgaacacctcatctgcactatctgatgccctttggttgtcgtgtatcataacctacccagaaccaagccatgtacatagcttgcagatgcaatttatcacgtgaggttatggctgcaagtgctactcattagggcacatcaaatgtccccttattaaatgggagggtgacttccttatgttccatctgagtagcatcaagtgatgtttttaaatgttgtctcaaacactcagaatatataactcctctgatctaagtaagtttataactccttcaaccagctatcccttaaagcatttttaataaagtactgtgtgtgtatgtatatatacatatgtgtgtgtgtgtgtgtgtctgtgtgtgtgtgtgtgtgtgtgaattaatgtggtgggcccctctgataatgcaagtggatcgacttttttaacaaaacaaatgttattgtgaaacatgcatataacaaagcaataaaacaattttgagttcaacaagtaggtctgaactctcatataaacatttaaataacctaaagtgaatatacagtagtaaaatgtaaataatgagacagtatttttgaatatttgaactgaatattaccttaatataataattgaatgttaccttaatataataattgaatattaccttcttaatacaattggtttaagtataagtttagggatgtcagtttggtaattacagtgagttgtcagttatggtgacattaatgtcttagaaaagttcttaaagtttttacccatcatttcttcaaatatttcctctcccattctcctaggacacttcattaaacacaaagactgtc

SEQ ID NO: 410662 - DNA, 675 bp, Homo sapiens
gtgctgggtgccaactacaggctttgcttgggagtcccaaaggtttccctcactggggcttgggatactaatatggaacctacactagcaccactaaatcagacccagaaagttcccccaggtgtccaaacacctgcatgaacaagcaggcagtttcctctaggttgacttcttgtctggccctacacatctctcagtttcatcactcagccaccagccctgggtctcatgtatgcacctgctgcttgacccagtcccaggagacactgagccttagaattgggctccttctctggaccttgccccaaaggctatttctgagtgactccctgggacttccctgacatggtaacccctagggctccaactgaacatgggtgctgtgagcaaggggaaattcttctgagtagcagatggagagtgggtagaacaagaggcagttgttctggatcagagataagcatggggtgagaaccatagtacactggattttatgtttaagcagcactgatcctcgatagttcagaactcccgcactgaagtccagcgtaggcaggtaaggacaacctggagccaggcattaatactcacttctacttcccatctgagtcatattcagagtctggccttgcctggtactttgactgcagaaggcaacccatggctaaatcaagg

SEQ ID NO: 410663 - DNA, 691 bp, Homo sapiens
gtgctgggtgccaactacaggctttgcttgggagtcccaaaggtttccctcactggggcttgggatactaatatggaacctacactagcaccactaaatcagacccagaaagttcccccaggtgtccaaacacctgcatgaacaagcaggcagtttcctctaggttgacttcttgtctggccctacacatctctcagtttcatcactcagccaccagccctgggtctcatgtatgcacctgctgcttgacccagtcccaggagacactgagccttagaattgggctccttctctggaccttgccccaaaggctatttctgagtgactccctgggacttccctgacatggtaacccctagggctccaactgaacatgggtgctgtgagcaaggggaaattcttctgagtagcagatggagagtgggtagaacaagaggcagttgttctggatcagagataagcatggggtgagaaccatagtacactggattttatgtttaagcagcactgatcctcgatagttcagaactcccgcactgaagtccagcgtaggcaggtaaggacaacctggagccaggcattaatactcacttctacttcccatctgagtcatattcagcaaatcctccgaataaatcagctgatcctcctgttgactggctggtgcttcagcagatcccaaggtcgggtc

SEQ ID NO: 410664 - DNA, 189 bp, Homo sapiens
ctttgactgcagaaggcaacccatggctaaatcaaggcacctcaagcctcatagagaaaagggaaagactcagcatttgctgagcttttactctgcactaggcaatgtgtaagtgcactttacatgtaccattaattattaggaatgtttgttaatccagtcactaaacactcagccaccaagtactag

SEQ ID NO: 410665 - DNA, 1029 bp, Homo sapiens
cagacacacacacactgctgtgcagaatcactgtcctgttgtgtgatcttcaaatgaagcaagagaggaataatctgggattgactgagataaatttatctcagctcttcaaaataccatgtgagcatagtgtaactcacttggacagctgtggaatgaaactcttgttttagtggccattagatacgtcaagagaactgactacgtagaagaatgtgtggtaaaggtagtttggcaattggtcaaatttgaagtagcatttacaggccgaggcaggtggatcacctgaggtcaggagttccaggccagcctggcctacatggtgaaactcctaaaatacaaaaatatctcctaaatacaaaacatctcctaaaacaaaaaaactctcctaaaaatacaaaaattagcctggtgtagtggcaggcacctgtagtcccagctactcgggaggctgaggcaggagaattgcttgaatctgggaggtggaggttgcggtgaggagagatcatgccactgcactccagcctgggcaacaagagtgaaacaacatctttaaaaaaaaaaaaaaaaaaaaggagcatttacatcaccaactgaaattaaataattgtcccccaaggtgatgtgtagcctgacttttgtgactgagggattgatctcttgacaagtctttatgaaataacaccacaggagggaaaattatatgcaggcatcaagctttgcatttattttgcaagccctctttatcgggtttgtatgatcttgttgtgtacagctaacaaaaggttacttctttgtcatgaaagccgtcctcagttttcagagacagtggggcaccacagagactttctttctctgcatccacatttctattaatgtcattactgcatttgattcctttatgaagcccttttggtcacatcaacagtgcattctaagctctctatcttaacttctagctttgtctgcaaaatttgtgtggttagcctgaggcatatgcagataaattgcccaggttcagtgttctca

SEQ ID NO: 410666 - DNA, 506 bp, Homo sapiens
gtcaatctcttctccagattgtaagctcctagaggacagggaccatgtcttatctatctatgtatccgtagtgcctgatccagtatctagcacagagtaaatacccaaggaaaaaatgtaaggccaggaatggtgactcacgcctataatcccagcactttgggaagccaagcaggaggattgcttgagaatagccgtttgagaccagcctagtcaatatggtaagtccctgtctcaacgaaaagaaatttttttagccagtcatggtagtgcacacctgtagtcccagatactcgggaggctgaggcgggaagattgcttgaacccaggagttcaaggctgcagtgagctatgattgtaccactgcactccagcctgggtgacagaatgagcccatgtctcaacaaaaagaagagagagagaaaaagaaagactgggtgcagtggctcatgcctgtaatcccagcactttgggaggctgaggcaggcagatcgcctgaggtcagg

SEQ ID NO: 410667 - DNA, 744 bp, Homo sapiens
gggaacagctttacaaatttcatatttacaaaaagaaaaacaaataatcaaaactgaattcttaatttaaagcatctgcttataagaagttgcttttactgtaaagatttttctgatatttattgtaatttagataaatctctaggttcaaagcaactctaaattatagtgtattttttcctacttttgaatgttcacccaaaacatctaattttactttgaaacaaagccaggattttagagtacttactacttatattatttcttattaacctaagccccacaacagacaatactttatttcagtaaagtatatttactctaggaggtggtgatttgagatgagacaccctgccttatcagcattatcgtgtggattggtgagactgggtgacttctcaatgaactattagaagaggcacaatgttgtagggtgagggatatggaaattaagtaacagaagaagacaatccagaatatattattgtaattaaaaggtaattttgaagtctttttttttttttagacggagtctcgctgtgttgcccaggctggggggcgcagtggtgcgatcttggctcactgcaagctccgcctcccctgggttcacgccattctcctacctccagctactcgggaggctgaggcaggagaaacgcatgaacccaggaggtggaggttgcagtgagccgagattgcaccattgtactccaatccggacaatagttgcgagactatgtatca

SEQ ID NO: 410668 - DNA, 458 bp, Homo sapiens
agcagagacttcacaaggtgcacacatacatgaaccacatgtcacaacccacaaccactacaagaagatggcccaagacctggcccagaaattgaagaaagacacttccagttttcagagggagatcctctgccacaagagaacagcccaggaaagctagatggccgctgcgaccactgagatagaactccaggtgctgcagaaagaaaatgactacagcaggcagaagccggctgactgcaaggccaagttgcagcctttcctgagtggccctttggctcctagggctccaccatccacagcccacaggagcccagaagtgccaagaggggccaggcgtggtggctcacacctgtaatgccagcactttgggaggccaaggcaggtggatttcttgaggtcaggagttcgagaccagcctggccaacatggcaaaaccccgtctctattaataatac

SEQ ID NO: 410669 - DNA, 966 bp, Homo sapiens
ctgtccttacgggtcgacagctgatatcttgaccttgttcatcccatgtttctttgtttttgaggattattattgttatttttaatgtatctaagttttttaaaagttgtcttttaacttaaaaaattatgtcatttttttcacaaattgttagattggtagaaaagtaatttgccatcactttcagtggcaaaaacttcaattacttttgtgccaacctaatagtttagatttaaagaaatatgcacagatgctttactttcagtggcaaaaactgcaatgcttttgcaccaacctaataatttagatttaaagaaatatgcacagatgcacgcacacacacacacatgcacacacacatagatataatttgtacgaatcttacttatttgttttcaaacctttctttccttctgaggtaattgtaatattgcaaaagatcatctctgggatagtctaaaagcctgtttgtaggtacatttgtacctctggctactttgaagtaaataattttagataaataatgtgcttacctaagatattatctttagaatagaaactttatgatcatgtttaattgcaacagtaattgctgttattttattgcagttaataaaatgtcaagtgtcaaaaacaactttattgtaactaattctaccttcctgtcctcatgagtatatgaaattttgctattcttaatgctcctaattgtttttcattttcttatctaacttatttttcctttatttccttgctatgctagagtatgctgaatgtggaatcctgccattataactaacattatagtgcacacgcttgtacgtggacagtcttttatgctgatatttgcaaggccttcttccagcatataagggatccatgggcctttttgttttaagaaaggaatgtagcaaatggaagtccaatatgagaaaggcaatttgtggaagcagagtgtaaaaacac

SEQ ID NO: 410670 - DNA, 349 bp, Homo sapiens
taaggaaaagaaaatttagagcaacatgagggagttgcagtattaaacatggtggtcagggcttccctccacgaaactgtgagatagaagcaaatgcctgaaggtgagggagtgagccctgtaactgtctgaggatgactgttacaggcagtccattagggaagaacatgctagcacattttggcatagctggagaggcacaggcaatgagaaggatgttgagaaaaggctttaaagagaaaggaaatagcaaaagcaggggtagcagttagaaatcaattaagaaaattccccatgttaaatagaaagaaggtgggaaaattggaattcaaatcatggttttcctgac

SEQ ID NO: 410671 - DNA, 305 bp, Homo sapiens
attaaggaggacaaagctcgacagcagatttcacttggctgattttgtttttctgttctttttctgttttcctgatgaggcttctgtacttctccctttaaggaggcaactgaatagcatgaaaataaggggtatgggtggtggtagttgctgaggggaatgacaatggatttggtaacacagcatgctaatatcatgcaaataatgagatgatataggaatctctgctctagtggtgggtctgaggtttgctctagtggtgggtctgaggttttctctactgagggcaaaattggagctttttt

SEQ ID NO: 410672 - DNA, 165 bp, Homo sapiens
tagcccagcctataagatgtgtactatcttgtagcccagcctataaaattgtactgtcttatacattgtggctagaattgttttctgtatttcaccctttaaaaaatatcaagtagagtttattttttttattcacataataggctttagtcccctagaatctga

SEQ ID NO: 410673 - DNA, 462 bp, Homo sapiens
tttttttagatgggagtctcgctctgtcgcccagcctggagtgcagtggcacaatctcggctcactgcaagctccgcctcccgggttcatgacattctcctgcctcagccttccgagtagctgggattacaggtgcctgccaccaagcccggctaattttttgtattttaatagagacggggttttaccatgttagtcaggatggtttcaatatcctgacctcatgatctgcccgccttagcctcccaaagtgctgggattacaggcgtgagccaccacgcccagccattacttatttatttatttatttatttaatatgttgagatggagtcttgctctgtcaccctttccactgtgcaacagccaggacaggaatttcctaaacgctgacgacttcagctttggccttctcccatttctggtcctcaacagagggaagaacagctggtcacttgtacaaa

SEQ ID NO: 410674 - DNA, 771 bp, Homo sapiens
gattttctcacctggttgctgcagattattggtcagagttctacgtttatgaatagtttctgcctattgtccatttgtatattcagtctcctaacttctaagaatttctagggaaagaatcatgaatgtatatagaaatgcttattgaaaaattgtctataatatggaaaattgaaacaatgtaaatttatagtcagggtctatttaaattataccattatcagtgtaatattatataactactatttttagatgatgtagatgaatatccaataacattaaatatttataatagtttaagataaatataggtataaaaccatacctgcattatgacttcatttttgtaaaaaaaaaaaaaagtgcgtatatctaggaaaaagagactggtgtgatatatatcaaattggctccagtggtaatatcatgatggcaggattaagagtgattcaaagttttttcttttgtatagttttaaattacatacaatgactgtgtactatttttataaacagaaacatttctataaatgtattttttaaggaaaaaaggaaaaaaaccgtccatatgttgacttatgtaatgtacccatttaagagaaaaggagtctaagatatgataaagagatgtgaacaaatgaattcaaagacacttagtgtaaagcaggagagctgtgtcaatatgcctttctgcgattttttatgaggcatgattactggctaaagctatttgttatgatagcactttcttataaatgtgtttctggaaaac

SEQ ID NO: 410675 - DNA, 447 bp, Homo sapiens
tgtacaacagagcactactcattaaacaaacaaacaaggacacactcaacaatatgaatgaatctcaagatcattattctgagaggaaaaaagccagacaaaataaagaatttacataaagttctagaaaatgcaacctagactacagtgacagaaagtaagtagaccaacggtttcctagaagtggggttgggggagtgatggcttgtattaggccattcttgcattgctagtctcagggaatacctgaaactaggtaatttataaagacaagaggtttaattggctcatggttctacagcctatacaagcatggcaccggcatctgcttggcttctggggggccttagggagcttttactcatggaggaaggtgaagtgggagcaggcatgtgacatggccagagcaggagcagcagtgagagaatgaaggcaggtgccacacag

SEQ ID NO: 410676 - DNA, 263 bp, Homo sapiens
gtcattatttaacctactacaattgggcctatccctaggccatgccagcctgggtgataaagcgagactctgtctcaaaaaaaaaaaaaaaaaaaaatctttaattgctgaaaagcatgaaatgtttcctttccgtccctgaattttctcatgtcatttttttcactggaatgccttctccctcttctttgtttatccaaattctactttatcttccaaagcccatctcaccttctccagtaagtcttccctgagtgctccag

SEQ ID NO: 410677 - DNA, 476 bp, Homo sapiens
gtatgtcttatgctcacccatcacgtagttcgttatcaccactacagatattgacaagctagtgaaacctgcgttttcattgcatttaactttgaaggcacacatctttgaacagaatgctaggtgctaatgtcatagcttacatctagatagggctctatttatgatgctgttatgttgtcttcataatctattgtggtattcagtttagctcataacagctgtataaattcaggttgccaagggtaaaagaggtgacccaacctcccatctggctgtattccccttgcacactcatatacctgtctcttctcaatgccctaattctatctcctataaaaagtttgcatcttcatgaattattcctatcttagtaaattaataaatggcctttcagaacaagtcataataaaaatacagctgggcatagcgatgcacacctttaatcccaacactttgggagactgagcaggagg

SEQ ID NO: 410678 - DNA, 434 bp, Homo sapiens
ggagcttccagttacagtcatgcattgcttaatgatgggatgcattctgagacatgcgtcattaggcagtttcatcattgtgccaatatcatagaatatacttaaacaaacctagatggtatagcttacaacacacttatgtgggatagcctattgctcctaggctacaaacctgtgtggcatgttgctatactgaatacagcaggcagatgtaacccagcactttgggaggctaagatgggtggattgcttgagcccaagagttgagaccagcctgggcaacgtggtgaaacccagtctctacaaaaaaaaaatacaaaaaattagctgggtgtagttgcacatgcctgtagtcccagctacttgagaggctaaggtgggaggtttgccaaggtgatgttaagtatcctcgagaggctgagcctggaggttga

SEQ ID NO: 410679 - DNA, 348 bp, Homo sapiens
aagtaataaatgataaaaattctaacataaaagttgaattaaaataaaacttaagtgttgggaaattcaattagaaaagagttaagaaaaaagaattaaattgttaccaattgcataatggatgacattttagacttgactaaggtcaaataaaacgatttttaaactgggaaacattttgacaaaattacataaataaggtaatattatgcaaaagaaattaaagataaaatacacaaatttcaaataattaaaataatatgacaagacgaatagttagcagaattaattgccatatttatttatttattttttgtttttgtttttatttgtttttgagatggaatc

SEQ ID NO: 410680 - DNA, 520 bp, Homo sapiens
gccttttttctggtggagggagagtgagtgactgcttttccgggggcacacatctgcataacacattgcctgaaatgcccttccctggaactagagtgtggttcgtaccctctcatggtttccatctctgatttcttttcccggtgttgatccctcagtccaaggcatgaacactgttacttattttatttgatttgttctccattcctcccttctgcgtactcctttgtagcttgcttctcctgatcattaaataagatttggctgggtgctgtaaccccagcacttcgggaggccaaggtgggcggatcaccggaggtcaggaattcgagaccagcctggccaacatggtaaagccccatttctactaaaaaaaaaaatacaaaaattagctgggtgtgtttgagggcgcctgtaatgccagctacgagagaggctgaggcaggagaattgcttgaacctgggaggcggaggttgcagtgagccaggattgtggcattgcactccagcctgggcgaca

SEQ ID NO: 410681 - DNA, 387 bp, Homo sapiens
ctcttttaggatttcctcaggtaacaatcttctttcaatgttcaataatccaagcagaacattttctcacttcatccgcctcccatgctaggttcacactgtgaaattggcttatctctgacctaaccacttccttcaccagacatagagctggtgtagctcaagggaaagaggcacggcgctgggaaatgattaggccccaccgtcccaagcaagagctcaggggagttctgaggctggagagaccattcgggatatcaccccgggttcctgagaacctgagatctgcggggaggcgtcaggcatccggaaacgcccgagtctggggagacggaccccctcagactttcctctaggagactctacaggtaaaggggagtcctggga

SEQ ID NO: 410682 - DNA, 372 bp, Homo sapiens
cattttacccaagaaatataaacacaaagctcaagggcacaggaacaagagaaaaagcatgacacgctttagaattgcaaacaatttgtcatgaggttggagaggtagctttaaatcctaaaagttctggaatgctatgctaatgaattggattttattctgactgcattagggagatgttgaatgatttttacttgggggtgagatggatgtgagtatagtgatagcagtgtggtgagtgctagtgtgggttggagtggcatgttagaggcagaaacatgagttgggagatattaccttatcgaaaagcgtttcttcaatgatcttctgagtttgggaatttttaaaaactagatcctcaaaagatagatt

SEQ ID NO: 410683 - DNA, 435 bp, Homo sapiens
cccacttcccatcctggcggcctaaaggcaaggcctagaccctggagaggccaaagtcgggccaaaacaacagcgaagctgggactggaacaggcgctgggggcctgcgcatgaccccaggctcagaatgcgacactccagtgacgccggggaatgagttgagatggagccggagacagaggttggggttcaggacgaggcgcttgggtatgggatcggatctgagacggttgcggcgctggtgctttgggctggaccagactcgaacccagagcggagcgagggtcagagccagggcaagagtccgaagcccagctcagcgtccagcccgcgagagaccccaccatgaatgacgtccgagtagggttggaactcgaagcccgaacgcactggaaatgcagccggacgacggctgggatccgagtgggtccgggc

SEQ ID NO: 410684 - DNA, 348 bp, Homo sapiens
tataaatgacaattgtatatgtttaaggtgatgttttgacatacatatacaatgtgaattgatgaccacaatcaagctaattaacgtattcatcacctcatatagttactctgtgtgtgttgagaataagatctactctcttagcaaatttcaaatatgtgatatattattaactatcatccctatgctgtatattaggtctctagaatttattcatcttataactgaaagtttgtaccctttggccaacatctctccatttcccctacccctcaacttcagaaagtcaccttttttactcagtttctatgagtttgagtttttttagattctacacatgtgtgaaat

SEQ ID NO: 410685 - DNA, 364 bp, Homo sapiens
gaaatacattaacacatcactaaaatgtctgaataaatgtttggataagtaaataatttcagtggaattcttaagtggttcacagaagttattaaaacttacaatgccctttaataattggcagaagaaaccagagggctccactgggagatggagctgggaggtctctggagggttgaaaggaaccccagtggggcgtcttggcaggcagttgtttctaattacgctgcaactctttacattttcctgtcaattgaattgaaactaaaccagctgttaattttctagcttaatgttagaactccctgtggaaatggtgctttagtgctgatttctagagggaatatttattcaagtatttcaa

SEQ ID NO: 410686 - DNA, 632 bp, Homo sapiens
ttcctgcttctcccactcctgaaggtgcctctgctcctgagcatactcggtgctatcctctgggtgaacaggccttggaggactccttggacagagtcatgaacaggagaacttgcaacaccccatgcccattggaaccctgtccagagacacagcccctctgactgcaaaaaggacttctgaccctgaccctcatatttctttccatcttatcaccggatactttttaaaagttaaaaaaaaatgtaggccgggtgcggtggcttacacctgcaatcccagcactttgggaggccaaggcaggtggatcacttgagtccaggagtttgagagcagcctgggcagcatggtcagacctcatctctacaaaaaaatacaaaaattagcagggtgtggtggtgtatgcctgtgatcccagctacttgggaagctgagacaggaggatcgcttgagccccggaggtggaggttgcattgagtcgagattgtgccactgcactccagcctgggtgacagagggagaccctgtctcagataaacaaataaataaataaaatacatcccatacacaagagtatgtatatgaggtatctatacagttcaaggactaaaaataaacatgtgtacccacca

SEQ ID NO: 410687 - DNA, 378 bp, Homo sapiens
cctactggcatctagtgggcagaggccaggactgttgctaaacaacctccagtgtacaggatattccctacaacaaagaattatctggttccaaatgtcaatagtgcccagactgagaaaccctgagttctgttgtaacatctaatgaagtttatttccttttggctctccgtgagtgttagctaactcataagatccccaaaactacctttctttttaacggaagggtggtagaaaagtcgtatcattctggaaggctgctggatctcattttgaatcagagcctgaacctagttgttgctgccagaagttgggaatttgggcagctcaggttcatagaaagcagagtttctcccactagtgtgtattgtttctgag

SEQ ID NO: 410688 - DNA, 316 bp, Homo sapiens
agcccaactgatatttcccttcctacagattttttttcaaccacatgctcatctctattctgatggcattgtgagaacacatcccactgtgttatagttgtctggtaacacattgctcttcctagaccagctttttttttcagagcatgacacacttgatcaatgatgcacagatacaggacacactgcgttgtgcaaggctgagcgatccagctgcgtctgctccctggttttctgaatattgagatacactgagaccagcggcattctagggctcaccttgaatctcttctcatttatttctttaagaagcctg

SEQ ID NO: 410689 - DNA, 392 bp, Homo sapiens
tacaagctttccccactgcatgaaatagctctactccatcttttcacttggaaaaataccttgcacatttcaaagcccatttcaaagtctgctttttctataaggccatcctttccctgtgcagaacattttaatgcccctgtccccagccctctctgtggtctgcacagggctggctactcacttttctgtgcacttaatcatctacacacaatagcatgggctgtttattataaccacctctttacaggacagtgttcctcctctggtctgtaggctcctgacaggcagcgcctgccctacttatctctgacctcagcatctggcagagttcctagtactagagaatgcctgctggattatgggaggcattcagcaaagagcagtccacc

SEQ ID NO: 410690 - DNA, 176 bp, Homo sapiens
caacaccatttgggtaacaatgccattttgaaacaggccaggaagagttataatgaaaataaacattgtttggaatggaggcagcaggcagagttcattttctctctttccctttcaggtagttctgaacaataaaagccaccaaccagtattcatatctgattaaacaaaagtta

SEQ ID NO: 410691 - DNA, 287 bp, Homo sapiens
atttatccctccccacctgccttgccccttaacccctggcaaactaatcttttaaatctccacaattttgctttttccagatgtcatatagttggaatcatacattatgtgttttttttctgactggcttttgttttttttaaggttcctacatgtcttttttgtaactttacagctcatttctttttattgctgaattgtactgtattatatggatgcatcacagtttatttatccatttaacaacagttagttggtgctggaactggacatccacatgccaaaaa

SEQ ID NO: 410692 - DNA, 428 bp, Homo sapiens
cgcatgcgcgttgcgcgccggacgcggaacgtctgccggtgtccccgcgctgctggtcccggggtccctgaaccgcgggcggccccgctccctctgctggccatggcccccccgcccgcgtgccggtccccgatgtcaccgccgccgccgctgctgctgctgctgctgctgagtctggcgctgctgggcgcccgggcccgcgccgagcccgccgggagtgccgtccccgcgcagagccgcccatgcgtggactgccacgccttcgagttcatgcagcgcgccctgcaggacctgcggaagacagcctgcagcctggacgcgcggacggagaccctactgctgcaggcagagcgccgtgccctgtgtgcctgctggccagcggggcactgaggaccacgctgctccgtgtgaataaatgcccagtggca

SEQ ID NO: 410693 - DNA, 535 bp, Homo sapiens
cgcatgcgcgttgcgcgccggacgcggaacgtctgccggtgtccccgcgctgctggtcccggggtccctgaaccgcggtaagggcggtggtgcgggcgtccgaatgggcgttttctagatacggggcgcggactagaggctcgctgggcccggagaccggcggactggagtcggggaaccggagggcggccccgctccctctgctggccatggcccccccgcccgcgtgccggtccccgatgtcaccgccgccgccgctgctgctgctgctgctgctgagtctggcgctgctgggcgcccgggcccgcgccgagcccgccgggagtgccgtccccgcgcagagccgcccatgcgtggactgccacgccttcgagttcatgcagcgcgccctgcaggacctgcggaagacagcctgcagcctggacgcgcggacggagaccctactgctgcaggcagagcgccgtgccctgtgtgcctgctggccagcggggcactgaggaccacgctgctccgtgtgaataaatgcccagtggca

SEQ ID NO: 410694 - DNA, 811 bp, Homo sapiens
  misc_feature (15)..(15): n is a, c, g, or t
  misc_feature (77)..(77): n is a, c, g, or t
  misc_feature (87)..(87): n is a, c, g, or t
  misc_feature (108)..(108): n is a, c, g, or t
  misc_feature (135)..(135): n is a, c, g, or t
  misc_feature (146)..(146): n is a, c, g, or t
  misc_feature (181)..(181): n is a, c, g, or t
  misc_feature (286)..(286): n is a, c, g, or t
  misc_feature (333)..(333): n is a, c, g, or t
  misc_feature (355)..(355): n is a, c, g, or t
  misc_feature (463)..(463): n is a, c, g, or t
  misc_feature (505)..(505): n is a, c, g, or t
  misc_feature (508)..(508): n is a, c, g, or t
agaagcttctggagnagacccagcaaaacatgaacgagttttacaacctcctgcagcccttcatcaaaacgtgcacnaagaacgccntctcggccgggaagaactggntgttcagaaatgccaagtccccgccgnactgtgagctnatggccggccacctccggtaccgctttacggctgntggtgcacacttcgtgctgctgctgcacctcatctacctgtttaattacgtgctgcaccactgcctgcgcatgcaggcccgggggctgctggccgccctgcaganggtcgtggtgcccttctactgctcctgcttcttggccgtggaggtanacatgctgcagttgttcgcccngctcctgctgctctgggagaaatacggctacttcgtttactccttcattctgctgctacagagcccagccctggggcttggtcagttccaggccaccctcttctacgngtactcctcagtggtccagccggtgctgctggccttcctgcngcngatccagaccctctagacgctgcacgaggagtttgtcaccagcctgattctggcgctgctgggcgcccgggcccgcgccgagcccgccgggagtgccgtccccgcgcagagccgcccatgcgtggactgccacgccttcgagttcatgcagcgcgccctgcaggacctgcggaagacagcctgcagcctggacgcgcggacggagaccctactgctgcaggcagagcgccgtgccctgtgtgcctgctggccagcggggcactgaggaccacgctgctccgtgtgaataaatgcccagtggca

SEQ ID NO: 410695 - DNA, 921 bp, Homo sapiens
cgcatgcgcgttgcgcgccggacgcggaacgtctgccggtgtccccgcgctgctggtcccggggtccctgaaccgcggtaagggcggtggtgcgggcgtccgaatgggcgttttctagatacggggcgcggactagaggctcgctgggcccggagaccggcggactggagtcggggaaccggagggcggccccgctccctctgctggccatggcccccccgcccgcgtgccggtccccgatgtcaccgccgccgccgctgctgctgctgctgctgctgagtctggcgctgctgggcgcccgggcccgcgccgagcccgccgggagtgccgtccccgcgcagagccgcccatgcgtggactgccacgccttcgagttcatgcagcgcgccctgcaggacctgcggaagacagcctgcagcctggacgcgcggacggagaccctactgctgcaggcagagcgccgtgccctgtgtgcctgctggccagcggggcactgaggaccacgctgctccgtgtgaataaatgcccagtggcaaaaaaaaaaaaaaaaaaaaaaacaacacaaaaaaaaaaaaaaaaaacaaacacaaaaaagggggggggcccaataagcaccccggcaggagcggcacacgcatccgttgcaggccacacccgatctttttgttaggaaacgaacggtgcgccccctaaagctgggcggcgtccttataatcatcccacggcgaagccaccgcgggctcgccacaaaaacactgtgcgctgagatcgagaacacagcgacggtccgccaccgcctacactcgtcgacacgaagcaacctcccttacttgtggcgtgcgggccactatcattggctgcaccgccctcgccacacgattctcccccccgggcgtactattatcctgtagctgcattggc

SEQ ID NO: 410696 - DNA, 840 bp, Homo sapiens
cgcatgcgcgttgcgcgccggacgcggaacgtctgccggtgtccccgcgctgctggtcccggggtccctgaaccgcgggcggccccgctccctctgctggccatggcccccccgcccgcgtgccggtccccgatgtcaccgccgccgccgctgctgctgctgctgctgctgagtctggcgctgctgggcgcccgggcccgcgccgagcccgccgggagtgccgtccccgcgcagagccgcccatgcgtggactgccacgccttcgagttcatgcagcgcgccctgcaggacctgcggaagacagcctgcagcctggacgcgcggacggagaccctactgctgcaggcagagcgccgtgccctgtgtgcctgctggccagcggggcactgaggaccacgctgctccgtgtgaataaatgcccagtggcaaaaaaaaaaaaaaaaaaaaaaaaaacaaaaaaaaaaaaaaaaaaaaaacaacacaaaaaaaaaaaaaaaaaacaaacacaaaaaagggggggggcccaataagcaccccggcaggagcggcacacgcatccgttgcaggccacacccgatctttttgttaggaaacgaacggtgcgccccctaaagctgggcggcgtccttataatcatcccacggcgaagccaccgcgggctcgccacaaaaacactgtgcgctgagatcgagaacacagcgacggtccgccaccgcctacactcgtcgacacgaagcaacctcccttacttgtggcgtgcgggccactatcattggctgcaccgccctcgccacacgattctcccccccgggcgtactattatcctgtagctgcattggc

SEQ ID NO: 410697 - DNA, 571 bp, Homo sapiens
ctctgacttccagcagggagagagggcctggagatttagatgattaccaatggccatgatttaatcaatcatgcttacataaggaaacctctataaaaccccataaatgacagtttggagagcttctgggttggtggacacagtgaggtactgggagggtggcgtgcttggaggtggcatggaagctctgtgcacccaccccctacccctgccccattgccctgtcttacgtttctcttcgatttggctgttgccttcctgagttgtagtagccttttaaacaaaccagtaatagtaagtaaagtgctatactgagttctgtgtcattctagcaaattattaaatctgaggcggggtcatgggaaccctcaaatttgtagtctgtaggcagaaatgggagtagcctgggcatgtcatctgtggctagcagctgtggcaggcagtcttatgggactgacctcttagtctgtgaggtctgggctaactccaggtagttactatcaaaattgtattgaattgttagacacctaattggtgtctgaagaattggagaattggttggtgtgattta

SEQ ID NO: 410698 - DNA, 411 bp, Homo sapiens
ttaaattccaaaatacatctgtcccagaggttttggataagggactttggagccacagtgcatttctttcattctttgactaatcagaccttttgtgatctttacaaaaaaaaaaaaaaaattgcctctaaagtataagaacaccgggagaagaaaaaatatataattattcagtagtgtaataattattcagtatcggaaactgtattttttttcctgtaaattaagtacttaaatgaaatcccaagtcactactcccttggggtcttatttttgttatctcaagacaaaataacactgacctaatttcagcttttaagtggacagccacaaacaccttccaggcagagctattccttggagatgccactctttgaaaagagaaagatgccacattagcttaaaagcacc

SEQ ID NO: 410699 - DNA, 497 bp, Homo sapiens
tgcaggctctgtctcaaagctttgcacgaggccatgctcatctttttcttcaattatttgatatcgcaagctgactatccacaacaactccccaatcccttaggctgattgtgcaacatctcaccttgcttacttatttatttcttttcttttgaaatgaaatttcactctatcaccctggatagagtgaagtgcagtggcgtgatctcgctcactgcaacatccacctcccaggtctaagcaattttcctgcctcagcctcccaagcagctgggattataggcacccaccaccacacctggctaatttttgtatttttaggagagacagggctcactacaacctccacctcccaggtctaagcaattttcctgcctcagcctccggagcagctgggattataggcacccaccaccacgcccggctaatttttgtatttttaggagtgagctgagatcacaccactgcactacagcctgggcagcagagcgagaccc

SEQ ID NO: 410700 - DNA, 273 bp, Homo sapiens
ctcctgagttcaagcaatcctcctgtctcagctagctgggactacaggtgtgtcccaccaggctgggctaatttttgttttggttattgttttcggtttttttttagagatggggttttgccatgttgcctagattggtcttgaactcctgagctcaagtgttccaatcgcctcagcctcccaaagtgttaatattataggtgtgagctgctacacccagccagattctgtttttttgtttttgtttttgtttttgtgttgagatggagtctc

SEQ ID NO: 410701 - DNA, 303 bp, Homo sapiens
gcattccatttagaaaacagatttaaccatatcacttggctgtctgtgtaaaactccgtaagctactttcaatggctcacaatgccctctatgatatagcttctgatcaaaacaatgcatgcacagaggagcttggaatgaaaagtggtagtgtcctgacactgtgatccccacttccaggcttcctccccataggacttcttttggccagttctgtgttttagtactcctggtgatgatctccatatcttcaaatagtatacttatactgatgtttgttgatttatcaaccttggatagcct

SEQ ID NO: 410702 - DNA, 673 bp, Homo sapiens
cattgttgtttttttcttcatgtcctcttttgtgcccatcggatttttgagactcacttttcaggccctaagtaagcaagaggcagaggtgaggaggggagtgtctgtcactgtccctatggttctggaatatgctgctcttcaaaggtctagcatcagcagcaacatccttcttgaagccaaaggaaaatttagatgagtggcagcgctgtggctgagggtgggtatggaaaggagaggcactgggtggggatgctaaaatactgccttcctgttccccagaagcgcagtcacttatgttcccctttatggccaagagcccccttaaccctcagcatacagttttctttcccttcgtgggaaccaactgaaattggcaaactgtgaccgtttgtgacgagttatctcagtcctcacatgagttcttacatgagtccctctatgaccttgtgcacctttcccagaaagataaattacataggttacaaccaaaggagcatgtaatgcctacttgttatttcatgtgccttgtaagaaccagagagggacctccttgctgaaccgcctcgaccatggagtaaagagttaggacatctcactgtacagcagtcaccccattgtgggcaaaactatgtcaacccccttggatttttagtaaaaaaaaaaaaaaaaa

SEQ ID NO: 410703 - DNA, 704 bp, Homo sapiens
gtccagagaatggctagtgtcctctagcactctctcagaagcaaaagcaagtctggggttacaacttccagtggcctactttaaatagacgctgttctggaaaatgactttatactttaaacacaaaatccaaaaaatagaactcagtggagtgacaatgacaatgcatgatggtggcccagtggctgtcccatgtgaaatacttcttgcctgacatgtatcatctacttgttgactgacctattgaggtgccttcatgacaccttttacattcatgataggtctcaggaagacagcagtgtacttggtggaaactcatgtaaaaagtgggttgtagggagctaaacagtgagtacacatggtatatggatacggaatggaataatagacattggagacttcaaaaggtgggagatgaaagggggatgaggtatgaaatcctacctgttgagtacaatgtacactacttacgtgcacagtacactgtttgggtgagaggcacactaaaagcccggacctcaccgctacccagtatgttcatgtaacacagctgcacttgtaccccctaaatgtatacaaataatctaaaaatagcccggacctcaccgctacacaatatattcatgtaacacagctgcatttgtaccccctaaatgtatacaaataatctaaaaataaagtggatatggtggctgtcgtgtcca

SEQ ID NO: 410704 - DNA, 364 bp, Homo sapiens
cactaaataaatgtcaagtgataaagcattgcagtggctgaaaaatgaagcttgcattcctgtaacccactaaattgttcatatagagcctcctgattgattttggttttctttgtgtgcaactttgaatccctgtctcatatttgggtcagagcaatgggagggacacatgacttgctttaaaattagcctcaaaactcattgtataacagctctcgttttcactaaatggaatgatttcttgagaagacaagcacagcatttgtaataagcctgcatagttgagtcgccatggagaaaattgtttacagtcaccaaaacactcaatgtttccacctgtaaaatggggtgtagatttagtttg

SEQ ID NO: 410705 - DNA, 507 bp, Homo sapiens
agctaccttttgtccttgggaaagttatgaactaaacaggtagcgagcattgagaggccttaggagaagactaaaaatcatgtatgatttttacacatgtacagttgacccttgaacaccactgagcttaggagtgctggcctctcccctacagtcagaaatctgcatataccttttgacttgcccaaaacttacctactaatagcctactcttgaccagaagccttactgataacgtaaacagtggattaatacatgttttatatgttacatgtatgatatactgtattaaagtaagctagagaaactattaagaaaatcatggccaggtgtggtggctgatgcctgtaatcccatcgccttgggaggccaaggtgggcggatcgcttgagctcaggtgttggagacctgtctgggtaacatggcgaaaccttgtctctacaaaaaaaaaaaatacaaaaatttagcagggagtggtagtgtgagcccgtagtcccagctacctgg

SEQ ID NO: 410706 - DNA, 346 bp, Homo sapiens
agccccgcctctcactttgggtcctagtgattcagagcagaaagtgccaggggagaagcaaaacaacagcaagggcagcagtggccaatcccgggctcaggcctgaaagtggagtccttctttccttccttccttcctccctccctcccttccttccttccttccttccttccttccttccttccttccttcctttcttccttcctttcttccttccttccttcctttcttccttccttcctttttccctccctccctccctccctttctttctttctttcttgatgaagtctcgctctgtcaccaggttggagtgcagtggtgcgagcaacctcctcctgccagg

SEQ ID NO: 410707 - DNA, 409 bp, Homo sapiens
ggctagacccagaagacagacaacagtcactacagttcagctcaaaggaagccacatccacaggaaaagggagagaatattattacatcaagggaacaccccatgggacaaaaagacctgaatagcagctttcagccctggaccttccctctgacagagcctacccaaatgagaaggaacgagaaaaccaacgctggtaatatgacaaaacaaggcttttcaacactcccccaaaatcacactagtttaccagcaatgaatccaaatcaagaagaaatccctgatttacctgaaaaagaattcaggaggtcagctattaagctaatcagggagggaccagagaaaggcgaagcccaatgcaaggaaatccaaaatatgatacaagaagtgaagggagaaatattcaagg

SEQ ID NO: 410708 - DNA, 1827 bp, Homo sapiens
  misc_feature (562)..(562): n is a, c, g, or t
  misc_feature (776)..(776): n is a, c, g, or t
  misc_feature (1245)..(1245): n is a, c, g, or t
  misc_feature (1497)..(1497): n is a, c, g, or t
  misc_feature (1537)..(1537): n is a, c, g, or t
tttgtattttcatcggagacagagtttcaccatgttggccgggctggtcttgaactcctgacctcaaatgatgtacccacctcagcctcccaaagtgttgggattataggcgtgagccaccatgcccagccccatccatgcatttctattaatgtctgctatccttgagaaactgtacataaaacatttttgtccccacatcactgaagataggacagaagcaagtgacagtcagacaactgtgtattaagggtatgctcttacagtgctcacagtttgatatatggctgtggggctgtttctctagatttgtaatacatactttgcaggtgaaagtttctggaatgtgagtatagcctcatttgggagttagagctcatttgggagttaggtgtaggtagaataacattgtgatttgaggctactgccaggttatgccttttcaaaaatagacttttcactcatttggcatggcctcccctttcttctctatttggcctgaaattcttaatttccctctctctcaagatagaattaagggcaagtgtgctggaagtgtttnatttggcaagaccaccattgatagacacatatgttgcccgggcaaaaaagatgctggttaatatttggatgagaagggtacatgttttcttcctctcccagttgtggtgatacctgtcagtttgtcagatactattttgctaccttgtcactgtggaaatttcataagacctaagcttccaactggccagggcactgttattttgggaggactnacctgtgctcacagattatagtaagacacttattcttaaataacttagaagtaagagagaaatagtggtcttgggataaagcttgaaatgtactgagtggcttcagaacaagaatggcctgttgccgatggactatattaatacatctaaggaaaagatgtgccaatctttatttttcagtctttaaaacatggttttaaataaaaaccaagtaacaaatgtatctccagagtatttaatatcatgagacatgtttacagtgtgctgtttaatagaataaaaatcatgatactctttaatacctgtacatctccatggatggaaaccttcatagtaagattgttttttcttttccttttttttctcatacttctattttttttattatcacagcaaggtgtgagaatttttttcttatacttgaaaaatgcttttctgtgattgctaaagtctctgaaatgagtaagtnttaatttacaaaatacatttcagccattaattattatttagaaaagaatacatgtatagaaagaaagaagagattgtaaaagaccagcaatggttgtgttcttctcctctgccctggtgtaacaactctggcccttgtaggtctctgccttttgtggagatgtttataataagccctcttagcctcatgcccgtcatacattcaggccgtaaagcttatcaaatagccatcctgttatgatttagctttccnggtacttggtctgcagaaagagtatatcttagcaggaggncccacatatgtgttcttttggccagattttattttattttaaagcaataatttggcccattggttgattcgtaagtctgtgtaaatttctcagcctgttgacaaactagtcttccaaatgtgcaatactaagttcatccagagtaattctttaccttttgataggtggcctgaagttgtttctagtaatagctcctgtaccacgtgccaactgggcttttcattttcaaaagtttattgaagaaagaaaattgagggctgggattataggcgtgagccacagtgcctggc

SEQ ID NO: 410709 - DNA, 2024 bp, Homo sapiens
  misc_feature (562)..(562): n is a, c, g, or t
  misc_feature (776)..(776): n is a, c, g, or t
  misc_feature (1245)..(1245): n is a, c, g, or t
  misc_feature (1497)..(1497): n is a, c, g, or t
  misc_feature (1537)..(1537): n is a, c, g, or t
tttgtattttcatcggagacagagtttcaccatgttggccgggctggtcttgaactcctgacctcaaatgatgtacccacctcagcctcccaaagtgttgggattataggcgtgagccaccatgcccagccccatccatgcatttctattaatgtctgctatccttgagaaactgtacataaaacatttttgtccccacatcactgaagataggacagaagcaagtgacagtcagacaactgtgtattaagggtatgctcttacagtgctcacagtttgatatatggctgtggggctgtttctctagatttgtaatacatactttgcaggtgaaagtttctggaatgtgagtatagcctcatttgggagttagagctcatttgggagttaggtgtaggtagaataacattgtgatttgaggctactgccaggttatgccttttcaaaaatagacttttcactcatttggcatggcctcccctttcttctctatttggcctgaaattcttaatttccctctctctcaagatagaattaagggcaagtgtgctggaagtgtttnatttggcaagaccaccattgatagacacatatgttgcccgggcaaaaaagatgctggttaatatttggatgagaagggtacatgttttcttcctctcccagttgtggtgatacctgtcagtttgtcagatactattttgctaccttgtcactgtggaaatttcataagacctaagcttccaactggccagggcactgttattttgggaggactnacctgtgctcacagattatagtaagacacttattcttaaataacttagaagtaagagagaaatagtggtcttgggataaagcttgaaatgtactgagtggcttcagaacaagaatggcctgttgccgatggactatattaatacatctaaggaaaagatgtgccaatctttatttttcagtctttaaaacatggttttaaataaaaaccaagtaacaaatgtatctccagagtatttaatatcatgagacatgtttacagtgtgctgtttaatagaataaaaatcatgatactctttaatacctgtacatctccatggatggaaaccttcatagtaagattgttttttcttttccttttttttctcatacttctattttttttattatcacagcaaggtgtgagaatttttttcttatacttgaaaaatgcttttctgtgattgctaaagtctctgaaatgagtaagtnttaatttacaaaatacatttcagccattaattattatttagaaaagaatacatgtatagaaagaaagaagagattgtaaaagaccagcaatggttgtgttcttctcctctgccctggtgtaacaactctggcccttgtaggtctctgccttttgtggagatgtttataataagccctcttagcctcatgcccgtcatacattcaggccgtaaagcttatcaaatagccatcctgttatgatttagctttccnggtacttggtctgcagaaagagtatatcttagcaggaggncccacatatgtgttcttttggccagattttattttattttaaagcaataatttggcccattggttgattcgtaagtctgtgtaaatttctcagcctgttgacaaactagtcttccaaatgtgcaatactaagttcatccagagtaattctttaccttttgataggtggcctgaagttgtttctagtaatagctcctgtaccacgtgccaactgggcttttcattttcaaaagtttattgaagaaagaaaattgagggctgggcacagtggctcacgtctgtaatcccagcactttgggaggctgaggtgggtggatcacctgaggtcagaagcttgagacagcctgaccaacatggcgaaaccccatctctactaaaaatacaaaaattagccaggtgcggtggcgcagcctgtaatcccagctactcggaggctgaggcaggagaatcgcttgaactcaggaagcagaggttgcagtgagctgaga

SEQ ID NO: 410710 - DNA, 188 bp, Homo sapiens
gcatgaaggtatcttttctgaaatgttgattcagaggttctgaactgatgtttgtgaggctgctttcattgtagcttgcagaagagttagattctaaacagcccagcaggaagcaccttggattctaatatccttaacaaggaaggggtagtgacggagagtcagggaacggctaaactactgacact

SEQ ID NO: 410711 - DNA, 119 bp, Homo sapiens
gtgatagctgcccaagtggactaggacaaatccctgaatcgtattaattcttgtctctggacctttacatatggtttgccctcagcctggatcctcccttagccaccttgcattcactt

SEQ ID NO: 410712 - DNA, 198 bp, Homo sapiens
aggagtgtgtgtatgtccttctttttaaagaaatgaccctcacctgctcaagccattcaaaaacatctcagttcttctcattccaaataccacactgacagcatgcaccctgcccctttaatgtatttactaccatacacatgtaaaattgcatttgctcagactcagtctttctgagtctgagccaaccatgattta

SEQ ID NO: 410713 - DNA, 355 bp, Homo sapiens
gcacaatctcatttaaccctcatggaaactctaacacaaaatatgatcaccatctttacatacaagaaaaatggaaacttaaaaagaaattaagtgacttgactaaaataacagcaactggcaaagtcatgagcggtgcccaggtttttagccacagagccaagtactgagccaccaggcaatcctgcctcccaaacagcaatctcagtattcactgctgtggactcttctaaaggcctcagccatctccatctccaggtaggtttcaggaccttttacttaactcagagtttcttagcatgttgtacaagcactactaagccgtaatgagtttgactaacaaaggaacccaatt

SEQ ID NO: 410714 - DNA, 91 bp, Homo sapiens
ctgtttgctattacattaatgctgaaaacacaattttctaaagctgaaatggaatgtgtatcatatgaaaagattaataatatttaattga

SEQ ID NO: 410715 - DNA, 607 bp, Homo sapiens
  misc_feature (571)..(571): n is a, c, g, or t
tttgtctacaaggtacttaaagcagtttttgttctggtttttccttgaaatagccaaaacatgctgttggaaaggcagatggtagattaagcagatttcatagacctttgcggtgattgtcattcatttcctttccagccttcattttaaaatgaaaatactaggagaaaattgggaaataatccgaataataaaatactgtggtgtagttaaagttgtagtctggaactgtttgcttcaagatatttcattagcttttttgaacaacaaacaatttcaagttatatatagacttagctggtttctcttcaagctattagctggttagggagatgattcgcacctttctgataaataatgctaaccgtgtatgtaaattttaaatgttctaaaaaccccatttaaactaaaaagacaagcgaaattattttaatattatcttttattaggctgagtgcagtggctcatgcttgtaatcccagcattttgggagcccgaggcgggtggatcgatagcacaaaggcgttagagacaaagacacaacaccatgatgaaacaaagacaacaccanaactacagaaacacaactcgacatggtgaaaacaca

SEQ ID NO: 410716 - DNA, 403 bp, Homo sapiens
agctgatccagcgatcaggacgagatacttacgcggacgatgaaagcaggactaagagcaagcaggctgatagggatccggagcatgagtttgagatacctttgtgaaatatgaacatagagatacctcagagaatagctgtagctatctgaagctacagatctgggcaatgttttgataaggtaatggcacagagatcatgatgcattaacacaaccacagagctacagctgagtgcagtggctcatgcttgtaatcccagcattttgggagcccgaggcgggtggatcgctggaggtcaggagttcgagaccagcctggccaccatggtgaaaccccgtctctactaaaaatacagaacatttgctggacgtggtggcgtgtgcctgtaatcccagttact

SEQ ID NO: 410717 - DNA, 328 bp, Homo sapiens
ttctaataacccctcccttccctttattcctgcactgggggtgctagctactttttgtagttatttactctgttacctcaatgtgcccctcacttctttttttgccttttcagccatccagtacaggtttaaccaattctccagattaaattctctctgttaaaataactgctgtggtttctgttttcctgaccagacactgactgatacagaccccacggctgccaaacaggctgcatgaggaagctgtaatttaccatctgtttttcctccttcaaaggagtaggtggcttccagcttacccagttactacactgcatcgaggtca

SEQ ID NO: 410718 - DNA, 423 bp, Homo sapiens
cacctctctatagcacctgtcttcaggctagaatggagcatgcccatgtatgctcacaaggtactaggggagcctgggagcatctctgccatctctctatagcacttgtctgcaggctagaatgaagcatgcccatgtatgctcacaaggcatactgttccatcatgcacagacaaacaccaatcaacacactctcggttgcagtcacatagagctccgacccccacagatgccatgggtgtgtgagcacacacagccttataggtacgaacatgctcccacaccagggatacctctcagaggtcttacctttttctacttcctgtctccatctaatggatagcactcctcttttcctgcatctcaagcttcagaaaatggcgctgattatctggagtaacattgtgtccggaattggtgggt

SEQ ID NO: 410719 - DNA, 437 bp, Homo sapiens
acttctttatatattctggtttttggcctcttgtcatatatatgatttgtaaatattttctcctattctgtaggtcgccttttcactctgttggtttttttgaggtgaagaaatgtttaagtttgatgtaattccatttgtctattattgcttttgctgtctatccttttggtatcctatccaagaaattattgccaaacccaatgtcatgaagattttcccctgtgttttcttctaagggttttatagttttagctcttacatttaggtgtttcatccgtgttagcgtgtgctttcattatttaaatacactctgcatggtcaagcagtctgtagtctgcagggaaatcattgagactcaaactcggccaaggttaggcctagacatggttctcttcaggttattggatgatggggctcatgaagctttagtgggc

SEQ ID NO: 410720 - DNA, 204 bp, Homo sapiens
agtcatcatctacctagacatccatctaggtaggagtctagggagtgagcgagcctagcccaccaccctccacccctcatctcaacctggctctgttgttccccttaaccccttgattcatgcagcgtggatgagacacaagcattaggaccccagtttataggggatgcgacacagctttttcccaaggatgccattcctatg

SEQ ID NO: 410721 - DNA, 496 bp, Homo sapiens
caatgaataaaagactgggatccctggtggatgagtttaaggagcttgtctacccgccagattacaatcctgaagggaaagttaccaagagaaagcacaataacgaaggttctgggagcaaaaggcccaaggtggagtattgagaagagaagctgaagacccacatcagcaaggtcatgctgggcaagttcactgtgcccatgctgaaagaggcctgccgggtggatgggctgaagagtgtgctaaagaagcaggacctgctgaaagccctcaccacgcacttccaggactgaccagaggccgcgcgtgcagccgcccttccacaccattcccaggctgcctggccttgttctcagccagttaaaatgtgtttcttctgagctaggaaggactttaagtttttgaggctttctgttgccatggtgatggtgtagccctcccactttgctgttccttactttactgcctgaataaagagccttaagtttgtactatt

SEQ ID NO: 410722 - DNA, 929 bp, Homo sapiens
ggtgaaaattagttggtaattaatccagcaataacagttaacagtctcaaattcagttaccacacaaataagaaaggaatacaaaaagaaggaggggatgtacttaaatccaaatgtgagcatggatatcacccagaaagagagagaattcagcatttctcctagtttgtggtctttgaggcataactgataagtgggaaaacagttgttctaatcgcagtggcagtgttcaagggaggaaccattgctggaagtgaccaagtgtactattttcaggtggcaaactcaccaatagggatcatttcccttttctctagttgaattggtgttgctgctaccctgtgctgagcagggtttggttttactgattgactgagaagatggtacctgtccccctgggctgagagcaggtgtacctgggcagtctctgaccatttagctgggtcccgtggttctgcagcacttgttaccttgcagaattggggcaggtgctttactcaaggtcagcggtttcacctcgaagactggacatcattgtaaaaaccagacgcagtctaaaagtgacaatgacaacagtgcaaaaatagaaggaaaaaaaggagaaagctgaaagtaaatcaagtctgtctataggactctcacaggagagcatgaatcatcaaagaggttccagagttacaaccaagaagtatttatggcgatcagtggtgcaaagggtaataatacaaacataataaagaagagaaaggaaagcatactagagataaaggaggcctagcattaaatgaatagggagataagcttaatgattatgctcaaatgactgagctattgatggcaaaatggctgagctttggaactgctttttaaaactggcctttaagaagataaataaggataattaaacagtaatgaagacccgtttcatt

SEQ ID NO: 410723 - DNA, 498 bp, Homo sapiens
ggttctagaatttggcatcagatgggtagcagctttggaaggaagcataagaaagggacacacgaggactccacacagccccaattgtcactttccaccaccacatatcctctttaattctgagagtattcaaaggagtttaaccattcagtggatgatacaattatcacagtggcatagccagttgtcctgttaacagccatcacatgtgaccctggggagcccaggcttctttcgtggtcagacctaaacctgctgagagagggtggtttcatgttagtcactgacagagcacatctccagctctcactgtggaatccaagttttcctttcgccttcctgcctcatttggttctgcccatttgcttggagccagaaagggaaaaggaagaacacaggacatcctctccgctctgcaactgacccaggtctgtctataacacctcctgacagtgcccagaaatcctcctatttaaaccattggcccctgatgcgatt

SEQ ID NO: 410724 - DNA, 972 bp, Homo sapiens
gcctgtgcaaaaatcagaggaactcaacagaaaacccagcctcccctacccaagtcagaatcgaacccctgaaggacccgccattggcttggcaaatcctccacccttcctcacaggcaagcgcaaccccggaaggggcctgtgtctctccagtcctgcagagcctgagggccccacatcacttaaacagcttttaccaaagatccacatgacgcaggctgcagtcagccctgagacctgggatctgtgaccaaatgcccttgagacgatggggctggcagaacccacaagcttccctgcggcgtgagggataatggcggtctctctcccataccactttgaacaagtgaaagccatttgcctttgttactccggaaaacgttttcactttgttgcatcttgtaaatattagagcagttgcagaaaagcagatgactttggtgtctttcctgatgatggagagactgtaaaattgcttttgctttcagtctcaggggaaggggagggaagagcagagcgtgatgggcacatggagaagctggctgtcccatttatgttttgattttattaatataaggagtgatggttttaggaaaaaggtattggttgggttgaagttaccacaatgattaggtcattttctagttctttctgtggcaacatttgggaagcttagaaagtgacttgcggccgggcgtggtggctcatgcctgtgatcccagcacttcgggaggccaaggtgggcggatcacgaggtcaggatatcgagaccatcctgcctaacacggtgaaactccgtctctactaaacatacaaaaaattagccgggtgtggttgtgggctcctgtagtcccagctactccggaggctgaggcaggagaatggcgagaacctgggaggtggagcttgcagtgagccgagatcataccactgcactccagcctgggcgacagagcgagactccgtctcaaa

SEQ ID NO: 410725 - DNA, 570 bp, Homo sapiens
cagatgccatgactacatctgtttgttggggaccagggaggctgccagtgaggattcagggtggaagtagtgtgtacccaatacctattgtgagatgtggcctggggagccctgagattgcctggccaggctcactcactacccagacaccctcttcctgcatggcgagtccctcagcccctccaaggctcaattctcagacatcggagtaatccacatcctccatcttgagttactcctcacaaggcctgcaagttttcctaggaggaagggaagacagggttgaacccacacaattctagaatctagaatttggaggatttctaaaccatttctgtaagtcagcccttgagaacttgtagattttctcatcatttgcagcatgagagtctggagtagactgtttggatttgactcttggttccttgggcaagttacttaacctctcagctgtgtgtcagtttccttatctaaaaagtgtggttaataataactgacctctcagaggtattgtgaggttactgtgatgattaaattagttgattcatataaaatgtttaaaagagtgcc

SEQ ID NO: 410726 - DNA, 291 bp, Homo sapiens
ggtgacaagagagaaactccatctcaaaaccaaaccaaaccaaaccaaaccaaaccaaaccaaaccaaaccaaaccaaacaaaatcggtccctactgtgccgacccagcttgcacattctactcggggttgggggacagcttggtgcattcctgtctctgcagacaacttttactgatggagcaccacctgctcagcacagccaagcacccaggttgtaaggaagggacaggcccagccaccctgcagcttacagcccacctgaggactaactagaattcagtaggacgaa

SEQ ID NO: 410727 - DNA, 350 bp, Homo sapiens
aggtgaggaaactcaagcatggaggggtaaagtaccttgcgctaggttacccggctaataagtggcccagctgggatttggtgcaggctgtctggctccagagcctctccttgtaaccttgatatggggctgtctctctaattgctaactaacatttatcacatgcttactacatgagtgtcactcttctaagtagtttatgtttacaaactcttaatactctcacaagccggccgggtgctgtggctcacgcctgtaatcccagcactttgggaggcccaggcgggtggatcacaaggtcaggagatcgagaccatcctggctaacatggtgaaaccccgtctctacta

SEQ ID NO: 410728 - DNA, 807 bp, Homo sapiens
tatcataattttggttaggtggttatatttggagttaacatcattatgactccgtaaatgccaattcacagctaagccatatagtatactataattacttttccttttgagcagtttttcctagagttaccattttgttgtttacctagttttgtttatacttactaccaacttaactacaaattcttccctgtctgtatctactatttcttcaaacacattacacattctaccaatttcaccttctcacagtagtatctctagaaatcttccaacctgtttctattgggactggaaactatctactaacctgaggacaagctgtcttcttgtgatcattattcatcatcatcctggtgattccctgggtctctagttaggtcatattccctgttacttgtatcctatgccttcatcttttttagtttacttctttatttttgttgagtaattcctccaataactgcctaagaaaggggacatgacaggtaaattttttaaggcttcgtaagtctaaaactgtcattagtctatccttaatcaacagtttagttggatactgaatacctggttgaaaatcacttttccttctgaatgctgaagactccactatcttctagcttccagtgtggtgtcaagaagtgcaaagccattctgattactgatcctttagatgtgacctgttatttatttcactctggaaactcccttgttttctaaaattgaacagtgatgtgccctgttttggctttttatatctgtactggtcactcaacaggcttttcctaactggtaactcatgtcctc

SEQ ID NO: 410729 - DNA, 423 bp, Homo sapiens
gaaatttcaccctgggtgtgcacactgttccctaagatcacaaatctgtaaatcagaacttctgcacagataattctcctaggatgggtgccaggtttcatttttcaatgtaatgaagtctcttgtagaaaagagcttaataaggcaaatgtctgaatttttagagctgttacctttacatctcattgttttaattctccggagtgctgtaaactaccagcatcttcactgaactttccttcgatcagtaatacctatattatgtgtttataaggcaattgaaccaaagctgttaattttttaaccattcttacggttttgcttgacttcaaaggacaccttaggttcaaaggacaccttaggtcttaatgtaagatttagtgaataaatctttaacatcacctcacacctcacattttactc

SEQ ID NO: 410730 - DNA, 421 bp, Homo sapiens
gaagggacaggcctgcttctggggaaagaggaggaggtggaaatgaagcatgggtggacctgggtgtggaaagtaaggcctacagaagtgtccttctggagctaggcctccactgggacagcccaagggctgggtcctgggctggattcgatctttctagttcacccagcatccccagtgcctgccacgatgccaggaacatcacagtactccacaaataactgctaagtggattaatgaattaatgatgagagactattaagatgcactttgttacttccagaaacagtctcgtctggaagacggatgtgtacagaagcaactctataggaggcagattgtttggggaagaaagaatgggaatgtgggtagaactggggaggacaaatccatttccactgtccacttccctaggtggtgg

SEQ ID NO: 410731 - DNA, 477 bp, Homo sapiens
gtgggtcctggaactaatcctctggataccaagggacgactgtgtttaaaccatcgtttgggtttggagagattaatgacaacagtggctaagcatgggaagggtttctatggtgggactgcattggaccacctctgaatgtgtgtattagcagtttagtaaataaaacaaatctaaattattatttgattggggttagtgggatgcaaataataagatttattcagagtatcctaaaaattcccccagttttatttagttttgtggaattatgtcctctttctaattttgcaacatttccttgcatgttaaaacattcttccctgaacccacaatgagtcttttacaacacatctctgatacaagaaaaaagatatttcaatgaaaaacagagcttgcttttgtacataagctaaaaacaaacaaaacaaacccagaagcatagctgtctgctcattcccttctacccaagagaaa

SEQ ID NO: 410732 - DNA, 405 bp, Homo sapiens
ctaacggggcatggcaacatacagaaaaatgaagcaagcaggaaaagagcagatctacccactgggtctggagacctggatggcagtggaggctcagccagcaagccaagacacattgttcaagatagttaagacagttctacctataattcagacagccaggcatctatggtgtaggagtgaggcaatgtagaaggagagaatcaaggaagaagtttagagtcagatcatcccagcttactaataagcaagaagtcagcccatctgcccattaccctgcaacagtccccacggcatcctctctgtccttaaataaatagatccaaggcaagatgaatgaatgggttcagggaaagataaatatctccagaaaaatgcaataaagagaaattttgagccaattaa

SEQ ID NO: 410733 - DNA, 452 bp, Homo sapiens
agggttcttggcagataactaaggctacaggagtcataagggtggcaccctaattctataggactgtagcctcataaaaagacggagagagagagagagctctctctatggcaaacaccgaggaaaggccacatgagcgtgcagtgagaaggcagctgtctgcaaggcacagagtgcactcactagaagccaaccacgctggcaccctgatcttcctcttccctcttcagagctgtgaaaaaattaatatctatataatttataaattacccagtctgtaatattgtgcagcacaaagtgactaagacatcgtatgtatactgatgacatacagatttagtcctcatctcttccttcaactgcaggcctatgtgtccaacttccttcttgactcctccacttggatgaataataaatagccacctcaaatattttaaagtccaaaacaaacc

SEQ ID NO: 410734 - DNA, 141 bp, Homo sapiens
tgtgcatcgggcagcggccagcaacctgcctctcacccacctggcccttctgggaggaccgggacttcctggggtcagattggaatgtacgtccaaaataagagtgaatggggatttgctgattattaaaacaattttgtt

SEQ ID NO: 410735 - DNA, 447 bp, Homo sapiens
aaaagaaatgttgttcttgtaagtcgagaaattgtgaggttgtttattacacggtgaaagctaattgataaggcattatttgtaatttccaatcaacaatccacctatatgtttaccagaaagacatataggttggttaaattcatacaacggtgataaagtttggatgtgtgtcccctccaaatctcatgttgaaatacatccgccagtgttgaaggcgggcctagtgggaggtgtttgggttatggggacagatccctcgtgaatgacttggtgtcctcccatggcaatgagtgagttcttgctccggtagttgatgtgagagctggttctctaaaggggcctggcacctcgtcctcttgtctatatttctccctctttctgtcttgctccatctctctttcttgttccctctctcgctgtgtgacatacctgcaccctcttcac

SEQ ID NO: 410736 - DNA, 395 bp, Homo sapiens
ttaattctaggggttgtacttggatttcaaaagacaccttatcatctttcagaagagagtagatttctcttctgtaaaggcagaatgaaaagcatacttttcaaatttgaaaaatatagtcaggttgatttaagtgacattttcttgctttaaattatattaaataggcatactctttttacgtttcatctgtagtaaagtgagagttagaaagaatggcaaagttctactcttcaaaagaccaaagcaccaactaagcctatgcatttttttttccctagaattctacgtatggaaaagagctatttgtagctgcataaagaaaagctgccacgctaggaaagactttgacccatccagcctgtgttgcctgtcctgtaaagtatttgatttca

SEQ ID NO: 410737 - DNA, 347 bp, Homo sapiens
aacaaggcagaggagtattgcatttatgatacacttgcagtcttggaagtctcatcaacccagctctgcatctcactagtgatgaactttcagcaaattgacagcactggaacccttcacaaggacattttttcccaaataacaggctttgtctgttttcatccatttagtcagcaggcatttttgagtaattctagcacaattgtttgaaatacctgctgtgaagtccaattgctcaaatttgcattccaattctgccactcacttcctgaaaaaacttctgatttttacctaaactctgtgcctctattttattaaatgcaaaacatgaggatttaaggaaattc

SEQ ID NO: 410738 - DNA, 381 bp, Homo sapiens
ttcctgtgggacatacaagtggaaacttgcagtataggcccttggatctgtgaatctggaccttaacctagaggttttggctaaaattatagatttggaaattatagtagtagttgaagctgtaaatgtaattacctagggaaagcatgtagaagaagaaaagtaaaatgtggccgggtgtggtggttcacatctgtaatcccagcactttgggaagcccaggtgggtggatcaaccgaggtcaggagttggagaccagcctggccaacgtggcgaaaccttgtgtctactaaaaatagaaaaattagctggccatcatggcgtgcgcctgtaatcccagttacttgggaggctgaggcagaagaatcacttgaacccggg

SEQ ID NO: 410739 - DNA, 638 bp, Homo sapiens
agataaaatttgaatagaaaggtaagatttgtatagtgattacaaagatgtgacctttaacagagggttttgttgtgtttgttttccacataaaagaatgaagaatttgtgagggtgaggtaaaagagaaggggtctccttaaaacttgagagaaggaaagaatttgtcccattgtagcaatatttgagaacaggttttattaaggttttaatatgtgttgaagtaaataattatgcaaattgaactagaaacttcttagtttaaatctagtctgctatttacagtgttagtagctggacatcatacttttttaaattaatgtaatattgataaatagcaatcctgtgtattctcttatttctcagacttaataacaaagactttataaatccacatatgtagtgggtttcagttgtttgcacgttattcatgaccaatattatgtacatagcattgttctaaggccttctttgatctgatcttgggtataaagaaacaaaaacaagccgggtgaggtggcctatgtttgtagtcccgggtgccctggagactgaggcaggaggattgcatgaactagggagttcgagaccagcctggtggcaacacagtgaaaccctgtctctaaaaaataaaaatt

SEQ ID NO: 410740 - DNA, 2958 bp, Homo sapiens
ctggatggactagccggggccatggccggcgcggcggcggagtcagggcgggagctgtggaccttcgcgggttcccgggacccgagcgcaccgcggctagcctacggctacggcccgggcagcctgcgcgagctgcgggcgcgcgagttcagccgcctggcaggaactgtctatcttgaccatgcaggtgccaccttgttctcccagagccagctcgaaagcttcactagtgatctcatggaaaacacttatggtaatcctcacagccagaacatcagcagcaagctcacccatgacactgtggagcaggtgcgctacagaatcctggcgcacttccacaccaccgcagaagactacactgtgatcttcactgccgggagcacggctgctctcaaactggtggcagaggcctttccatgggtgtcccagggcccagagagcagtgggagtcgcttctgttacctcaccgacagccacacctccgtagtgggtatgaggaacgtgaccatggctataaatgtcatatccatcccggtcaggccagaggacctgtggtctgcagaggaacgtggtgcttcagccagcaacccagactgccagctgccgcatctcttctgctacccagctcagagtaacttttctggagtcagataccccctgtcctggatagaagaggtcaagtctgggcggttgcgccctgtgagcacgcctgggaagtggtttgtgctgctggatgcagcctcctacgtgagcacctcgcctttggacctgtcagctcaccaggccgactttgtccccatctccttctataagatcttcgggtttcctacaggcctgggcgctctgctggtccataatcgtgcggctcctctactgaggaagacctactttggaggagggacagcctctgcgtacctagcaggagaagacttctacatcccgaggcagtcggtagctcagaggtttgaagatggcaccatctcattccttgatgttatcgcgctaaaacatggatttgacaccctagagcgcctcacaggtggaatggagaatataaagcagcacaccttcaccttggctcagtatacctacatggccctgtcctctctccagtaccccaatggagcccctgtggtgcggatttacagcgattctgagttcagcagccctgaggttcagggcccgatcatcaattttaatgtgctggatgacaaagggaacatcattggttactcccaggtggacaaaatggccagtctttacaacatccacctgcgaactggctgcttctgtaacactggggcctgccagaggcacctgggcataagcaacgagatggtcaggaagcattttcaggctggtcatgtctgtggggacaatatggacctcatagatgggcagcccacaggatctgtgaggatttcatttggatacatgtcgacgctggatgatgtccaggcctttcttaggttcatcatagacactcgcctgcactcatcaggggactggcctgtccctcaggcccatgctgacaccggggagactggagccccatcagcagacagccaggctgatgttatacctgctgtcatgggcagacgtagcctctcgcctcaggaagatgccctcacaggctccagggtttggaacaactcgtctactgtgaatgctgtgcctgtggccccacctgtgtgtgatgtcgccagaacccagccgactccttcagagaaagctgcaggagtcctggagggggcccttgggccacatgttgtcactaacctttatctctatccaatcaaatcctgtgctgcatttgaggtgaccaggtggcctgtaggaaaccaagggctgctatatgaccggagctggatggttgtgaatcacaatggtgtttgcctgagtcagaagcaggaaccccggctctgcctgatccagcccttcatcgacttgcggcaaaggatcatggtcatcaaagccaaagggatggagcctatagaggtgcctcttgaggaaaatagtgaacggactcagattcgccaaagcagggtctgtgctgacagagtaagtacttatgattgtggagaaaaaatttcaagctggttgtcaacattttttggccgtccttgtaatttgatcaaacaaagttcaaactctcaaaggaatgcaaagaagaaacatggaaaagatcaacttcctggtacaatggccaccctttctctggtgaatgaggcacagtatctgctgatcaacacatccagtattttggaacttcaccggcaactaaacaccagtgatgagaatggaaaggaggaattattctcactgaaggatctcagcttgcgttttcgtgccaatattattatcaatggaaaaagggcttttgaagaagagaaatgggatgagatttcaattggctctttgcgtttccaggttttggggccttgtcacagatgccagatgatttgcatcgaccagcaaactgggcaacgaaaccagcatgttttccaaaaactttctgagagtcgtgaaacaaaggtgaactttggcatgtacctgatgcatgcatcattggatttatcctccccatgtttcctgtctgtaggatctcaggtgctccctgtgttgaaagagaatgtggaaggtcatgatttacctgcatctgagaaacaccaggatgttacctcctaaaaaaaatttttagcatacattaaagtttctcttttacagtgatctctattattgttaagatctgcaacttggttcagtagaacttgatgttttgaataaggagagctctttttctttagaggcagggaatgctctcacctgcttccttctgcctttgacttctcaccctgcaaatttgcactggctgtgctcaggagagcacttctgaggcctcaggaacgaatgctgcacccacatccagtgaggctcctgtaggtatttgaagtataa

SEQ ID NO: 410741 - DNA, 2723 bp, Homo sapiens
ctggatggactagccggggccatggccggcgcggcggcggagtcagggcgggagctgtggaccttcgcgggttcccgggacccgagcgcaccgcggctagcctacggctacggcccgggcagcctgcgcgagctgcgggcgcgcgagttcagccgcctggcaggaactgtctatcttgaccatgcaggtgccaccttgttctcccagagccagctcgaaagcttcactagtgatctcatggaaaacacttatggtaatcctcacagccagaacatcagcagcaagctcacccatgacactgtggagcaggtgcgctacagaatcctggcgcacttccacaccaccgcagaagactacactgtgatcttcactgccgggagcacggctgctctcaaactggtggcagaggcctttccatgggtgtcccagggcccagagagcagtgggagtcgcttctgttacctcaccgacagccacacctccgtagtgggtatgaggaacgtgaccatggctataaatgtcatatccatcccggtcaggccagaggacctgtggtctgcagaggaacgtggtgcttcagccagcaacccagactgccagctgccgcatctcttctgctacccagctcagagtaacttttctggagtcagataccccctgtcctggatagaagaggtcaagtctgggcggttgcgccctgtgagcacgcctgggaagtggtttgtgctgctggatgcagcctcctacgtgagcacctcgcctttggacctgtcagctcaccaggccgactttgtccccatctccttctataagatcttcgggtttcctacaggcctgggcgctctgctggtccataatcgtgcggctcctctactgaggaagacctactttggaggagggacagcctctgcgtacctagcaggagaagacttctacatcccgaggcagtcggtagctcagaggtttgaagatggcaccatctcattccttgatgttatcgcgctaaaacatggatttgacaccctagagcgcctcacaggtggaatggagaatataaagcagcacaccttcaccttggctcagtatacctacatggccctgtcctctctccagtaccccaatggagcccctgtggtgcggatttacagcgattctgagttcagcagccctgaggttcagggcccgatcatcaattttaatgtgctggatgacaaagggaacatcattggttactcccaggtggacaaaatggccagtctttacaacatccacctgcgaactggctgcttctgtaacactggggcctgccagaggcacctgggcataagcaacgagatggtcaggaagcattttcaggctggtcatgtctgtggggacaatatggacctcatagatgggcagcccacaggatctgtgaggatttcatttggatacatgtcgacgctggatgatgtccaggcctttcttaggttcatcatagacactcgcctgcactcatcaggggactggcctgtccctcaggcccatgctgacaccggggagactggagccccatcagcagacagccaggctgatgttatacctgctgtcatgggcagacgtagcctctcgcctcaggaagatgccctcacaggctccagggtttggaacaactcgtctactgtgaatgctgtgcctgtggccccacctgtgtgtgatgtcgccagaacccagccgactccttcagagaaagctgcaggagtcctggagggggcccttgggccacatgttgtcactaacctttatctctatccaatcaaatcctgtgctgcatttgaggtgaccaggtggcctgtaggaaaccaagggctgctatatgaccggagctggatggttgtgaatcacaatggtgtttgcctgagtcagaagcaggaaccccggctctgcctgatccagcccttcatcgacttgcggcaaaggatcatggtcatcaaagccaaagggatggagcctatagaggtgcctcttgaggaaaatagtgaacggactcagattcgccaaagcagggtctgtgctgacagagtaagtacttatgattgtggagaaaaaatttcaagctggttgtcaacattttttggccgtccttgtaatttgatcaaacaaagttcaaactctcaaaggaatgcaaagaagaaacatggaaaagatcaacttcctggtacaatggccaccctttctctggtgaatgaggcacagtatctgctgatcaacacatccagtattttggaacttcaccggcaactaaacaccagtgatgagaatggaaaggaggaattattctcactgaaggatctcagcttgcgttttcgtgccaatattattatcaatggaaaaagggcttttgaagaagagaaatgggatgagatttcaattggctctttgcgtttccaggttttggggccttgtcacagatgccagatgatttgcatcgaccagcaaactgggcaacgaaaccagcatgttttccaaaaactttctgagagtcgtgaaacaaaggtgaactttggcatgtacctgatgcatgcatcattggatttatcctccccatgtttcctgtctgtaggatctcaggtgctccctgtgttgaaagagaatgtggaaggtcatgatttacctgcatctgagaaacaccaggatgttacctcctaaaaaaaatttttagcatacattaaagtttctctttt

SEQ ID NO: 410742 - DNA, 706 bp, Homo sapiens
cattctccaacatttcctgagaaccgtcaagatctcagtccctcttttctttgtctgcaaagaccttaagcagtggtcttttagctgacaaacaaatgcagatgattccccagcagagacggtgaacaggtgccccgttctggctctccatagttaggggactgggcatttctgtgtgattcctccctctgaggtgcaaggctctggtcacttttgtggcaacgctgtgttttccttctcacctgccaggttttggggccttgtcacagatgccagatgatttgcatcgaccagcaaactgggcaacgaaaccagcatgttttccaaaaactttctgagagtcgtgaaacaaaggtaagcgtgattgcaaaatatgacacctggtttccaatcctggtgttatcaataccagaactatgttcataatagcacagagttatttttttaaatgggggatttgctgcccatccaaagctgttgggctgccattaacctatccttgtttgtagtttcattttatttttcctttccatccaagttctcactttttttgttttacttcatgtatttttatgctttccaatcttgttgaagagatatggagtacaaaaaaaacaagtaattctgttgtcttgatcattattttctttaacacagagagctcatgaagagtaaagtgccttaatgtgaatagagtagctgcata

SEQ ID NO: 410743 - DNA, 1331 bp, Homo sapiens
gatatcgtcgaccacgcggtccgaactcgtctactgtgaatgctgtgcctgtggccccacctgtgtgtgatgtcgccagaacccagccgactccttcagagaaagctgcaggagtcctggagggggcccttgggccacatgttgtcactaacctttatctctatccaatcaaatcctgtgctgcatttgaggtgaccaggtggcctgtaggaaaccaagggctgctatatgaccggagctggatggttgtgaatcacaatggtgtttgcctgagtcagaagcaggaaccccggctctgcctgatccagcccttcatcgacttgcggcaaaggatcatggtcatcaaagccaaagggatggagcctatagaggtgcctcttgaggaaaatagtgaacggactcagattcgccaaagcagggtctgtgctgacagagtaagtacttatgattgtggagaaaaaatttcaagctggttgtcaacattttttggccgtccttgtaatttgatcaaacaaagttcaaactctcaaaggaatgcaaagaagaaacatggaaaagatcaacttcctggtacaatggccaccctttctctggtgaatgaggcacagtatctgctgatcaacacatccagtattttggaacttcaccggcaactaaacaccagtgatgagaatggaaaggaggaattattctcactgaaggatctcagcttgcgttttcgtgccaatattattatcaatggaaaaagggcttttgaagaagagaaatgggatgagatttcaattggctctttgcgtttccaggttttggggccttgtcacagatgccagatgatttgcatcgaccagcaaactgggcaacgaaaccagcatgttttccaaaaactttctgagagtcgtgaaacaaaggtgaactttggcatgtacctgatgcatgcatcattggatttatcctccccatgtttcctgtctgtaggatctcaggtgctccctgtgttgaaagagaatgtggaaggtcatgatttacctgcatctgagaaacaccaggatgttacctcctaaaaaaaatttttagcatacattaaagtttctcttttacagtgatctctattattgttaagatctgcaacttggttcagtagaacttgatgttttgaataaggagagctctttttctttagaggcagggaatgctctcacctgcttccttctgcctttgacttctcaccctgcaaatttgcactggctgtgctcaggagagcacttctgaggcctcaggaacgaatgctgcacccacatccagtgaggctcctgtaggtatttgaagtataa

SEQ ID NO: 410744 - DNA, 2887 bp, Homo sapiens
ctggatggactagccggggccatggccggcgcggcggcggagtcagggcgggagctgtggaccttcgcgggttcccgggacccgagcgcaccgcggctagcctacggctacggcccgggcagcctgcgcgagctgcgggcgcgcgagttcagccgcctggcaggaactgtctatcttgaccatgcaggtgccaccttgttctcccagagccagctcgaaagcttcactagtgatctcatggaaaacacttatggtaatcctcacagccagaacatcagcagcaagctcacccatgacactgtggagcaggtgcgctacagaatcctggcgcacttccacaccaccgcagaagactacactgtgatcttcactgccgggagcacggctgctctcaaactggtggcagaggcctttccatgggtgtcccagggcccagagagcagtgggagtcgcttctgttacctcaccgacagccacacctccgtagtgggtatgaggaacgtgaccatggctataaatgtcatatccatcccggtcaggccagaggacctgtggtctgcagaggaacgtggtgcttcagccagcaacccagactgccagctgccgcatctcttctgctacccagctcagagtaacttttctggagtcagataccccctgtcctggatagaagaggtcaagtctgggcggttgcgccctgtgagcacgcctgggaagtggtttgtgctgctggatgcagcctcctacgtgagcacctcgcctttggacctgtcagctcaccaggccgactttgtccccatctccttctataagatcttcgggtttcctacaggcctgggcgctctgctggtccataatcgtgcggctcctctactgaggaagacctactttggaggagggacagcctctgcgtacctagcaggagaagacttctacatcccgaggcagtcggtagctcagaggtttgaagatggcaccatctcattccttgatgttatcgcgctaaaacatggatttgacaccctagagcgcctcacaggtggaatggagaatataaagcagcacaccttcaccttggctcagtatacctacatggccctgtcctctctccagtaccccaatggagcccctgtggtgcggatttacagcgattctgagttcagcagccctgaggttcagggcccgatcatcaattttaatgtgctggatgacaaagggaacatcattggttactcccaggtggacaaaatggccagtctttacaacatccacctgcgaactggctgcttctgtaacactggggcctgccagaggcacctgggcataagcaacgagatggtcaggaagcattttcaggctggtcatgtctgtggggacaatatggacctcatagatgggcagcccacaggatctgtgaggatttcatttggatacatgtcgacgctggatgatgtccaggcctttcttaggttcatcatagacactcgcctgcactcatcaggggactggcctgtccctcaggcccatgctgacaccggggagactggagccccatcagcagacagccaggctgatgttatacctgctgtcatgggcagacgtagcctctcgcctcaggaagatgccctcacaggctccagggtttggaacaactcgtctactgtgaatgctgtgcctgtggccccacctgtgtgtgatgtcgccagaacccagccgactccttcagagaaagctgcaggagtcctggagggggcccttgggccacatgttgtcactaacctttatctctatccaatcaaatcctgtgctgcatttgaggtgaccaggtggcctgtaggaaaccaagggctgctatatgaccggagctggatggttgtgaatcacaatggtgtttgcctgagtcagaagcaggaaccccggctctgcctgatccagcccttcatcgacttgcggcaaaggatcatggtcatcaaagccaaagggatggagcctatagaggtgcctcttgaggaaaatagtgaacggactcagattcgccaaagcagggtctgtgctgacagagtaagtacttatgattgtggagaaaaaatttcaagctggttgtcaacattttttggccgtccttgtaatttgatcaaacaaagttcaaactctcaaaggaatgcaaagaagaaacatggaaaagatcaacttcctggtacaatggccaccctttctctggtgaatgaggcacagtatctgctgatcaacacatccagtattttggaacttcaccggcaactaaacaccagtgatgagaatggaaaggaggaattattctcactgaaggatctcagcttgcgttttcgtgccaatattattatcaatggaaaaagggcttttgaagaagagaaatgggatgagatttcaattggctctttgcgtttccaggttttggggccttgtcacagatgccagatgatttgcatcgaccagcaaactgggcaacgaaaccagcatgttttccaaaaactttctgagagtcgtgaaacaaaggtaagcgtgattgcaaaatatgacacctggtttccaatcctggtgttatcaataccagaactatgttcataatagcacagagttatttttttaaatgggggatttgctgcccatccaaagctgttgggctgccattaacctatccttgtttgtagtttcattttatttttcctttccatccaagttctcactttttttgttttacttcatgtatttttatgctttccaatcttgttgaagagatatggagtacaaaaaaaacaagtaattctgttgtcttgatcattattttctttaacacagagagctcatgaagagtaaagtgccttaatgtgaatagagtagctgcata

SEQ ID NO: 410745 - DNA, 2454 bp, Homo sapiens
ctggatggactagccggggccatggccggcgcggcggcggagtcagggcgggagctgtggaccttcgcgggttcccgggacccgagcgcaccgcggctagcctacggctacggcccgggcagcctgcgcgagctgcgggcgcgcgagttcagccgcctggcaggaactgtctatcttgaccatgcaggtgccaccttgttctcccagagccagctcgaaagcttcactagtgatctcatggaaaacacttatggtaatcctcacagccagaacatcagcagcaagctcacccatgacactgtggagcaggtgcgctacagaatcctggcgcacttccacaccaccgcagaagactacactgtgatcttcactgccgggagcacggctgctctcaaactggtggcagaggcctttccatgggtgtcccagggcccagagagcagtgggagtcgcttctgttacctcaccgacagccacacctccgtagtgggtatgaggaacgtgaccatggctataaatgtcatatccatcccggtcaggccagaggacctgtggtctgcagaggaacgtggtgcttcagccagcaacccagactgccagctgccgcatctcttctgctacccagctcagagtaacttttctggagtcagataccccctgtcctggatagaagaggtcaagtctgggcggttgcgccctgtgagcacgcctgggaagtggtttgtgctgctggatgcagcctcctacgtgagcacctcgcctttggacctgtcagctcaccaggccgactttgtccccatctccttctataagatcttcgggtttcctacaggcctgggcgctctgctggtccataatcgtgcggctcctctactgaggaagacctactttggaggagggacagcctctgcgtacctagcaggagaagacttctacatcccgaggcagtcggtagctcagaggtttgaagatggcaccatctcattccttgatgttatcgcgctaaaacatggatttgacaccctagagcgcctcacaggtggaatggagaatataaagcagcacaccttcaccttggctcagtatacctacatggccctgtcctctctccagtaccccaatggagcccctgtggtgcggatttacagcgattctgagttcagcagccctgaggttcagggcccgatcatcaattttaatgtgctggatgacaaagggaacatcattggttactcccaggtggacaaaatggccagtctttacaacatccacctgcgaactggctgcttctgtaacactggggcctgccagaggcacctgggcataagcaacgagatggtcaggaagcattttcaggctggtcatgtctgtggggacaatatggacctcatagatgggcagcccacaggatctgtgaggatttcatttggatacatgtcgacgctggatgatgtccaggcctttcttaggttcatcatagacactcgcctgcactcatcaggggactggcctgtccctcaggcccatgctgacaccggggagactggagccccatcagcagacagccaggctgatgttatacctgctgtcatgggcagacgtagcctctcgcctcaggaagatgccctcacaggctccagggtttggaacaactcgtctactgtgaatgctgtgcctgtggccccacctgtgtgtgatgtcgccagaacccagccgactccttcagagaaagctgcaggagtcctggagggggcccttgggccacatgttgtcactaacctttatctctatccaatcaaatcctgtgctgcatttgaggtgaccaggtggcctgtaggaaaccaagggctgctatatgaccggagctggatggttgtgaatcacaatggtgtttgcctgagtcagaagcaggaaccccggctctgcctgatccagcccttcatcgacttgcggcaaaggatcatggtcatcaaagccaaagggatggagcctatagaggtgcctcttgaggaaaatagtgaacggactcagattcgccaaagcagggtctgtgctgacagagtaagtacttatgattgtggagaaaaaatttcaagctggttgtcaacattttttggccgtccttgtaatttgatcaaacaaagttcaaactctcaaaggaatgcaaagaagaaacatggaaaagatcaacttcctggtacaatggccaccctttctctggtgaatgaggcacagtatctgctgatcaacacatccagtattttggaacttcaccggcaactaaacaccagtgatgagaatggaaaggaggaattattctcactgaaggatctcagcttgcgttttcgtgccaatattattatcaatggaaaaagggcttttgaagaagagaaatgggatgagatttcaattggctctttgcgtttccagttctgggcacacaggggatctcta

SEQ ID NO: 410746 - DNA, 2227 bp, Homo sapiens
ctggatggactagccggggccatggccggcgcggcggcggagtcagggcgggagctgtggaccttcgcgggttcccgggacccgagcgcaccgcggctagcctacggctacggcccgggcagcctgcgcgagctgcgggcgcgcgagttcagccgcctggcaggaactgtctatcttgaccatgcaggtgccaccttgttctcccagagccagctcgaaagcttcactagtgatctcatggaaaacacttatggtaatcctcacagccagaacatcagcagcaagctcacccatgacactgtggagcaggtgcgctacagaatcctggcgcacttccacaccaccgcagaagactacactgtgatcttcactgccgggagcacggctgctctcaaactggtggcagaggcctttccatgggtgtcccagggcccagagagcagtgggagtcgcttctgttacctcaccgacagccacacctccgtagtgggtatgaggaacgtgaccatggctataaatgtcatatccatcccggtcaggccagaggacctgtggtctgcagaggaacgtggtgcttcagccagcaacccagactgccagctgccgcatctcttctgctacccagctcagagtaacttttctggagtcagataccccctgtcctggatagaagaggtcaagtctgggcggttgcgccctgtgagcacgcctgggaagtggtttgtgctgctggatgcagcctcctacgtgagcacctcgcctttggacctgtcagctcaccaggccgactttgtccccatctccttctataagatcttcgggtttcctacaggcctgggcgctctgctggtccataatcgtgcggctcctctactgaggaagacctactttggaggagggacagcctctgcgtacctagcaggagaagacttctacatcccgaggcagtcggtagctcagaggtttgaagatggcaccatctcattccttgatgttatcgcgctaaaacatggatttgacaccctagagcgcctcacaggtggaatggagaatataaagcagcacaccttcaccttggctcagtatacctacatggccctgtcctctctccagtaccccaatggagcccctgtggtgcggatttacagcgattctgagttcagcagccctgaggttcagggcccgatcatcaattttaatgtgctggatgacaaagggaacatcattggttactcccaggtggacaaaatggccagtctttacaacatccacctgcgaactggctgcttctgtaacactggggcctgccagaggcacctgggcataagcaacgagatggtcaggaagcattttcaggctggtcatgtctgtggggacaatatggacctcatagatgggcagcccacaggatctgtgaggatttcatttggatacatgtcgacgctggatgatgtccaggcctttcttaggttcatcatagacactcgcctgcactcatcaggggactggcctgtccctcaggcccatgctgacaccggggagactggagccccatcagcagacagccaggctgatgttatacctgctgtcatgggcagacgtagcctctcgcctcaggaagatgccctcacaggctccagggtttggaacaactcgtctactgtgaatgctgtgcctgtggccccacctgtgtgtgatgtcgccagaacccagccgactccttcagagaaagctgcaggagtcctggagggggcccttgggccacatgttgtcactaacctttatctctatccaatcaaatcctgtgctgcatttgaggtgaccaggtggcctgtaggaaaccaagggctgctatatgaccggagctggatggttgtgaatcacaatggtgtttgcctgagtcagaagcaggaaccccggctctgcctgatccagcccttcatcgacttgcggcaaaggatcatggtcatcaaagccaaagggatggagcctatagaggtgcctcttgaggaaaatagtgaacggactcagattcgccaaagcagggtctgtgctgacagagtaagtacttatgattgtggagaaaaaatttcaagctggttgtcaacattttttggccgtccttgtaatttgatcaaacaaagttcaaactctcaaaggaatgcaaagaagaaacatggaaaagatcaacttcctggtacaatggacctaaaggacgggtaccgag

SEQ ID NO: 410747 - DNA, 179 bp, Homo sapiens
cttcgggtttcctacaggcctgggcgctctgctggtccataatcgtgcggctcctctactgaggaagacctactttggaggagggacagcctctgcgtacctagcaggagaagacttctacatcccgaggcagtcggtagctcagaggtaaccttgccacaggggaggggtcagaggag

SEQ ID NO: 410748 - DNA, 302 bp, Homo sapiens
tgttgggattatgggggtgagccaccgtaccaggcccatggcacctctcttaatttataaattgaactggatgtgaagtaataatgtcagctagttgagataagagggttacagttaggcgtgagccaccgtgtctggccatacacatccctgctgaagcccgcattacccttcccctatgctatagaagccctgggtcgggggggtgggggtgatggcacagggatccaccatcttatcttggtgccatccctgacttgccttctgttcataaacgcctattaaatgtttctttctgagaa

SEQ ID NO: 410749 - DNA, 389 bp, Homo sapiens
tgttgggattatgggggtgagccaccgtaccaggcccatggcacctctcttaatttataaattgaactggatgtgaagtaataatgtcagctagttgagataagagggttacagttaggctgggcgcagtggctcacacctgtaatcctagcactttgggaggcctaggcggactgatcaccaggtcaggagattgagaccatcctggctaacatcatgaaaccccatctctactaaaaaatacaaaaaattagctgggaatggccaggcgtggtggctcacacctgtaatcccagcactttgggaggccgaggcaggcggatcatgaggtcaggagatcaagaccatcctggctaacatggtgaaaccccatctctgctaaaaataca

SEQ ID NO: 410750 - DNA, 750 bp, Homo sapiens
ataggaaactcgtccctttgatgtgatggaacacagggaaataatttttttttttaatttaaagaaacatagtcttctttctattggtttgaggcaatagctttttagagttaggtccagttagcatatggctcttttggttttatcatcttctcttctccatttaccgtctcccactcttccaaaatagaagagaattctaaactttaaatcatactgaaaagttttgactaaaaatctctttataatccttaatggtatcaaaattaacattagttttcacaaattaacctttccttgctctaaaaatcagagaactaagaaggctttgaaaagaataaagtccttaaaaagaaaccaagaacagtatataaaagattatttatttagaacagaatacttagagggtgagaactaatatcatttggattttttattaggtcatagggaggttctgtccatgcaaagtgatgtagtattttgaattcttgcaataatcacagatcaaaattgaggttaaatattgttgttttctttttcacccaggcctgggactggcaggctgcatggctttgtggctgaggctggaagcagagcctatcaaagtcccctctcttgcaaaaaaaaaagaaattcttttctgtttttgaagaaaggttaaggttgatatctcagcaaagctacttgaaggaagtgattggtcttgacccagcacttgtaatgcagtacttacaaaatcatccagattct

SEQ ID NO: 410751 - DNA, 336 bp, Homo sapiens
atcatgccattgcaccccaggcctgggtgacagagcaagactccatctcaaaaacaaaaacaaaaacaaaaacaaaaaaaaaatgtactggaagttctagctagtgctaaacggcatgaaaaagaaacaaatggcacgcagattggaaagggagacataaaactgcctttatttgcagatgatatgattgtttagaaaaatcccaaagcatttacatgcaggtttagctaagtctcaggatacaaggtcagtatacaaaagtccattgctgtcctatgtaccaattgaacaactggattttgtaataagaaaaacaataacatttacaatagcacc

SEQ ID NO: 410752 - DNA, 421 bp, Homo sapiens
gctggatacatacttttattagtgggtttacatattaaaatggatatataagagattaaggaagttgttagagttaaatggcaggtaaatattggattctggaggaatgtccaaagagaccacgggaggatgccagtaaagaaggaggcacctaggattttcctctaaccagttagaatgttcagaacagcctcattcttactcctttttttctccctctccttgcctcctgctttatctgtgtcagttacgtcatttgctttgatgattcccaaacacattgtcctcgtccatgcctctgtcctcctttccttaatgccctctacctggaatgccctttccttcatccttcgaagccgagcttaaatgccacttgcctatgttacatttctttcttcttttttttttttttgagatggag

SEQ ID NO: 410753 - DNA, 525 bp, Homo sapiens
taattaggttgagatgaggtcaagaggctggggccctcatgatggaatttgtgcccttacaagaagaaatactagatagttttcgatctctctgtgccatggggacacagcaagaagacagtcatctgcaagccaggaagagaactctcaccaggaaccaaatcatcaggaactgtgagctaaatttctgttgtttaagccacccaggctacgatgtactgaatgtttacatccccccaaatttgtatgttgatatcctagccctcaaggtgatggtattaggaaatattagggcctttgggaggtgattaggttatgaaggctgagccctcatgaatgggattagtgccctcataaaagaggccccagagagctggtttgccccttccactatcttagaacacagcaagaagacaaccatatacaaggacgaagcccctcaccagaaaccaaagctaccagccgtttgatcttgaacttccaagtttccaaagctatgagaaataaatgtttgtttataagtca

SEQ ID NO: 410754 - DNA, 1025 bp, Homo sapiens
acacaaggggccagaagaggtaggggtttgtttccagtgccagccccagaaatgtgacccattgtgctttttaccaagttcctcctctagctcaccagggacctgggggcgggcctgccagcggccactccctgtgctccccttccaggctgatgcctccctgcctgcccacaccggggtactccacgtctctacactttgtgcgtgctcctctctccacgaagaaggccaattctcctccttctctggataacttcgactaattcaccagactcagcaaaggctctgcctccctgcaggaggccatccctgatcctcgccactcctgccccatctatgccaggcatgtgcctccagggagccacagcaccctctaaagagagcaacaccaaatcagtgataaccgatcgtttccttcaaccagagttaaatgtctgcagaatgcccaccaggcatggtattacagcagagatccccactggaccaacaactcccactgggtccccagcaccgacacatccgaggtaccacaaccggtgactgctgagctgaactaaggatgcaatgggatgaaagccaatggggaaatgtgcctcaaatacttattaacccctggtacaggaggcctggctgctgggattattcctagatcctctgtgacttctctgaccatgtcacacactaaccttcccagtgaaccttctgctctgagcaggcctggccttctgcactcctgcaaatgccagtggcttttctatctctgagctactgggtctgctgctcccccaggctgaaatgccgtccctatgccattcttttctttgtccatccaaatccccagttattaaaaaaaggagaaaaatttaaaaggggttacctgttcttaaaaacaaacaaacaacaacatcaaaaacaaaaacagtcccacatcctccctgaagctttcctaaaaactaaggctcacactgttctctcccaactgaactgcaaaataaagtattaacatacacaatatcatcttattt

SEQ ID NO: 410755 - DNA, 421 bp, Homo sapiens
ttccattttaatggttgaatattttctcaatatgtgtttttacattattaagtttaacatttctttgtacatttactggtttgaatttactttgtgaatcacctcttcatgttccctgtccagttcttccatttttcccccttatatctttgtaatagctccttaaaatctttggtttatgtcttcaaatattttcccccagtttttcatttaccttttatttttatttatattttataatgaacagtagttgccctttttaatgtagccagcctatctttttttatttcttttatgctcataaacagcttccccttgtttattttttccttttttttttttctttacagaggtaatcaagttaaccttctccatgttgataccacagttgtcaccattttcttctttttttgagacagag

SEQ ID NO: 410756 - DNA, 864 bp, Homo sapiens
gctttcaggctgctgagcctgttccttggctggggtcggtagggcttggagccagccgttcaaagtcacccctgggaagcgcccgcaacccttggggacgcctctcctccggctgccccccttccctggaatccaggtgtcactggggccggggaggggctaggagctcggatttctgctttgggaagtttttacaagcccaccctccccctgccttgggtccccgagccaagaatttcagaaatccggggcacaaaaacgccagtgtttgcggtcaaggattaaaggcgcgaggtgtctttatttaatctgctccgccctgctcgggtttgcacgagaaaccaagcctgggagcgacggtccacgcaagcggagacacagcattatcccctggtcactggacgctggggtctagtgcctaatacgttaagctgcttctccccatcatcaagaaactgccgcatctgccatataaaggagatgtttctcattcgcccccactcatctcttcccccatgaaaacctcttccattttcaaaggatcttcggctctacttttcaagcaaattcaacaaatcagtgtatgcctgtgtaactggtaaatagtgaagggtaattatttcatgtgcttctaactcagaaacaatggaatattaacagcggttttctgaagatccagttggacaattttcattttcatcatataatggacatttatctcctacctgcattatccactgtcttccctcggagaccacaaatttcactgaaggcagcatctatgtcttattcatgcttgtgctctctacctcccctgacccagaaggacttattcttctttctgcacattttagtagatgtgtt

SEQ ID NO: 410757 - DNA, 1232 bp, Homo sapiens
agagagtctcactggagtgcaatggcatgaatctcgcctcactgaaacctctgcctgcctcagcctcccacgtggctgggattacaggcgcgcaccaccacgcccagcttatttttgtatttttagtagagacggggtttcaccacattggccgggctggtctcaaactcttgacttcagatgatccacccgtctcggcctcccaaagtgctgggattacaggcatgagccaccgtgcctggcctttgttaaaatattttagtgctttacaaacacttaatatattgcaaaaaaacaaaaacaaaaacctcattaaaacctactttatctctttacatgtaaaaatcttctgaatccttccccctctgccatcccctaaagttcttttattggtagtcaagaacaagctttaagccatactctacacaaacaccaatacaccgaaacacaaggtaacactctgccaatatgtttggatagactaagttaaatacttgaatggcttattcactttattactaagttgaccaattttttaaaaaagcaacaacacagctaaggttcttcctcaaacatcacctaaactaaaaaaaaagtgtgatacatgactacatttcaacacaagcacagacacaatgactcatcatttgcctatctaggaatttaactgaaggcagtaatcagagaagtgggcagatatgaaatcataatcttgtttacagtaggaaaaggctgaaaacctcccaagtattcattgataggggattatttgtcaatgaaggtatacctacgcaatcaatataacaactgcagaattataaacagacataaaaacatattcctgacacattgctgaataaaagaacaggtaaaaaacagcaacacagaatcccatttttcaaatacatacatatgtaatttgtatacacatttatatgcatacagaaaaaaaagtatatattccaaaatgttccagggtcatggaatttaaaaactttacctatttacgaatatggcctacttttgaaatcatgaagaaaaacaagttaaaaagttatttttatacttatctatcactcatcactcattttcttttttcttttttttggagacagagtcttgctctgtcacccaggctggagtacagtggtgcaatctcaggtcacagcaacctccacctcctgggttcaagcgattatcctgtctcagccttccgagtggctgggattaca

SEQ ID NO: 410758 - DNA, 1107 bp, Homo sapiens
agggtcaatcagaaaagagcagattctttccctgtgattcacatattttgcagaagcttctggcttggaatttctatcgcaagtttcaaatctcacagcagaaatgtttacacattgcagtttggctgaattcagaggaagctttcctggatctctgatgagaatgagaattgtggtcatgggaagcatatggccatgacattcatcccttactcaagataagctgaggagcaaggtcaacacattgcctcagacctcaaatgaagactggaacatatcaccctaaccgcatgggactaggatggggtgagcactggggcaggagcagtggtgtgtgatggaggggtggaggaatctttctccactccaagatgggatcagaaatgtaggaggaagccaaaaagagcaagctcaccactcttggcatattttttccaccttgacattgatagctagacctcactcctggttgggaaattttctaagctaccaagaataggaaaaaaatcaaccataactaaagccctttgagatattcttccttgtcttcatgaacaggacaatattaaaacattacagaaagtctggaaaacaaagggaaaaaaaaagctgatagccctgcccttcaaatatacaactcattgcatttttagtaatgccccctttcagtttttaatctatttgcatatataatatattagctagctaaaattggaacataaacaatatatatcttgcttattcatcttacaacttaatacagaaattttctgttactttattactttttataattatttttaacaactgcttaatatttctcagatagagttttaagtattattaccctacaaataggtgaaagtaatgatgaatagcatttagtatagccagtcctggatagacacagaaagaaaatgatacatttttgtttttctcctccttcaaattctgccaaatgccactcatcagcaatataatagtgaaataaagtccatattcaggtatttgatttggagttgctggagatttttggtagatttaattcttcacatgattaacccactgttattagcaaggcttggaccctttgaccacaaaaaaact

SEQ ID NO: 410759 - DNA, 676 bp, Homo sapiens
gtctacagctcccagagtgagcaacgcagaagatgggtgatttctgcatttccagtcgaggtaccgggttcatctcactagggagtgccagacactgggcgcagggctgaaaaagcacgagtgtccgcactatgacaaaagaaaagcggcgtctcctcaaaacaccaccatgttcccctatgagtctggtgagccaagacactaagaaactgcaggaaacgagagagttctcggggtgggggtgtccatggatgaagcaccgaacaaactggagcccgcaaggccggcgcccagccactcaacaccaccgaagccgccgcttacctttcgcggggtcacctcctctcctcgcccgagacgccccgccccgcttcgccgccccgcctgctagagagagcggcggagggcgccccgcccggcgccacagcgtcccctgtcttccggaggctgcggcgcagcggcgcggggctgcggggacccatccagtgctagcctttccggttctgaggacctcgcgcccctccttggggtctgcgggctgaagtgtgcaagggacgtttttgctttcttccctttttgacctttagttttccacctcccaacttcaaattacgttccagttcggtgtgtatgtttgtataaataaaaggagacatctcctagaagtatgtttatt

SEQ ID NO: 410760 - DNA, 703 bp, Homo sapiens
atcccagcattttgggaggccaaggagggcagatcacctgaggttgggagttcgagaccagcctgaccatcatggagaaaccctgtctctactaaaaatacaaaattagccaggtggggtggtgcatgcctgtaatcccagctacgagggaggatgaggcaggagaatcacttgaacctaggaggcagaggttgcagtgagcccagatcacgccattgcactccagcctgggcaacaagagcaaaactccatctcaaaaaataaaaaataaaaaataaataaatacatacataaaacaaaaccccaaaaccatgtacatcatttgtcctgacttatttacagtggtttagatgaacagactgagactagcatgtgatgccttctgagtggctggccctagcagtaggtttgttttgtttggtatctttgaatatatcaaatggtatattgaacaggcatttccttccagtaaataattgggcaggcaaagctattaacttccaaccagggcattatttctgctctgcccactctagttggctcaacagactgaaaattgttaagtggtcattctgtatcagtcccacctctctctgccccaggataacttttacggtcacaaacaagaagacagcacaaggactatggctaacaacacatcatcatctcaactcaacatgaaaaccagggctgggctgcctgc

SEQ ID NO: 410761 - DNA, 178 bp, Homo sapiens
acagtggtatttggtgatacaccatcttaggtgtatctatgaacacagaaatagtggatttgggagccatggacaatgtggagaccactcacagaccaggagcctggaaactaagtctcctactcctggcccctgttcttccccctgcactgtgttaacaatggacttggaagaaaac

SEQ ID NO: 410762 - DNA, 439 bp, Homo sapiens
aaggtgggagggaaagtgactctgatcttcaactcaaagaacaaagagaagtcaaaagtcatttaggacctacttctggggatatttccaaaagaattgaaagcaagctctcgaagagataccctcacattcatattcataccaacaatactcacaagtggaagcaacccaaaagtccaaattaatggattaacaaaatgtgtatgtatatacaaacaatggatactattcaaccttaaaaaggatcacttgaggtcaggagtctgaaccagcctgaccaacatggtgaaaccccatctctactaaaaatacaaaatcagccaggtgtggtggtaaatgtctgtaatcccagcaacttgggaggctgaggcaggagaatcgcttgaatctgggaggcagaggttgcagtgagcagagatcgccccattgcactgcagcc

SEQ ID NO: 410763 - DNA, 421 bp, Homo sapiens
tgttgggcaagaggtgtaggaaagtctggggaagtatctgattaattccaacctttccttagctcccactccctgagtgagtctgtgcataataaaaaagcagagggccccggactcaaatgcttgtgtcacttatacaagatgtggagagataaaataagcacagtaaggtgagttgtctcgaggttgtcacccaccatacagtgcccaacatctccttgcctctaactgctcacctgacagcctttcctgctgctgcaggtttaacacagggtactggcattgcggcccctcccttggtggttttatgttgaccatctgaaagcatccttcctgaaaatgagagctaggtttcttctttgttttctttgttactaataagagcttgatgtatgattaaaacttctaaaaaactggaagg

SEQ ID NO: 410764 - DNA, 488 bp, Homo sapiens
tttccactgggaaccagggatgggtaagccttgggcttaggaaaaattagtaattagagcagcaatgccctagactcatttattccagggcccctttgtaagagaaccttttaactttatataaaactaggtaattctgcacttatgctgttcttcatacgtcaagacagcaaaatcctctcacctctctactttcatgtatactttgaatagataatgcattcaaatgactcaacactcaagtgccagagtggagagatgtccagtgaaaagcttcctccgcctctgtccctttcttgtctgggggagtccccattgcctgtttcttggtagccttcagagagtctgttcatatgagggacatgcatatttatcctccctcccccacctcttctacaaatggtgccacatcataccatgcggacacgcagcaagcacctcatccttcatttttgtggctacataaatgtttcgttgaacggatgcag

SEQ ID NO: 410765 - DNA, 366 bp, Homo sapiens
tgggtcttgtgatgttgcccaagctggtctcgaactcctgggcttaagcaatcctcccatctcagcctcccaaactgttgggattacaggcacgagccaccacatccagcctaaaaacagtttttaaagggtacagtgtgataccgtttatgggaaccactttttagatgagacaagcccagttgtaaattaatggtgaataatttggttttcatatttggtttgggacaatggagcaggttatgttgggtgggaggaggagagagcatgggtggagaaccattcctttactgtcttgtgtgagtaaataaacctctttaagctcctgatatagcataccagagtgacttgggtggtgtctacatt

SEQ ID NO: 410766 - DNA, 416 bp, Homo sapiens
taattgctgagtttctagctcacatagagagatggtgtccttcattgatagaagaaacaatagaagaataccaggtgtgggcaggtacagcccttgagtttacatttggatacattgggtttgaagtgcttttgaaatacctaagaggttatgtcaagtaggcagttgagtatgtgggtaggtagctcagaggaagctactggcttggttaaaaagttgggagtcagttgtgaataggtggcattcaaagcgtttgcctaggataagaacatggagtgagcagacaaagtggcttggtactgaggctttagcaggtgggtagtcgacgtctgagcctacaaagagactgagaaggagtagccagcaaggtgttccagaaaaacaccagaaaagtgtagaattgcctgaaccaaagg

SEQ ID NO: 410767 - DNA, 383 bp, Homo sapiens
gcccggccgcccgctctccccggcgcccgccgccgccgctcgcttttttaatgtccacagacagtgaaaaggaactcggcgttagggggctgccaccgtgtcggaggcgaggcgaggaagggagctggaataacaaagggaggtaatggggtagattggatacctctggggtcttggaagaagctatgacttatttactgtctactatgtgaaatgactggactcttctatggacccagtggagctcagacaagggtccaggccctgacactgccccagagcaggggtgcagcacctatgaggatgccaagctcaggtcatcgccctgcggtgtctcagccaactgggcctcgaacagccccataaacttggacataaacaca

SEQ ID NO: 410768 - DNA, 499 bp, Homo sapiens
cagtctggaattcctgaaagctcagaaaactgctgcttagggaggtaatggggtagattggatacctctggggtcttggaagaagctatgacttatttactgtctactatgtgagttttgggcatccttctatcagcccttatcccagggcaggaagaacagccttgatcctggatcccaggcacagctgggtgtcagacctggaggagaagctcccagagtgaccaagatagaatcggcatgcagatgggaagataagacccagaaaacagaaaggacatgtttaaggccatgcagcaagttagtgcctgacctgaatattgaaagaagaatattgaggatcaaagagaccaagactgcaagcgtaaaaactaagattggaaccaaagccagttcttcttgatcccagggtctgcgcccttcttctgttccatgtttcattgttcttggtggacctggggatcaatagctagaagttaaaggacaaactgatttggga

SEQ ID NO: 410769 - DNA, 209 bp, Homo sapiens
cctctttggacacacacgcgccgcccacgcacgcgctcccctccccggcaggcgggggcggcttcggccgggagccggcggacccgcttcggattccaggtgtggcagtgactccgcgctccacgttttgcaggctgccaccgtgtcggaggcgaggcgaggaagggagctggaataacaaaggcaagttggggagagcgcaagggggc

SEQ ID NO: 410770 - DNA, 916 bp, Homo sapiens
cctctttggacacacacgcgccgcccacgcacgcgctcccctccccggcaggcgggggcggcttcggccgggagccggcggacccgcttcggattccaggtgtggcagtgactccgcgctccacgttttgcaggctgccaccgtgtcggaggcgaggcgaggaagggagctggaataacaaagggaggtaatggggtagattggatacctctggggtcttggaagaagctatgacttatttactgtctactatgtggtggatggtgtttgaagtgaattgaattaggggacacccagctggcatctgctgcagaactgatgactcgcttgctggtgggcagaaatctccataatctttctttagcagatgaggtcactgaggctcagagaggctgaagccacttgctcagagccgcacagcaagcccaccaccctgaacctccagattaccaactcagcattgtgtcctgacagtgtcatcatagatggtcaacaccgtcacctgggcagcactgaagcccagagcgggagagactggctcaagaccatggcctctcctggtctgacagtctcagatgcagtcatggatggctttctggaggaggtggtacctggtctgtgggaagtaggggtcagcatcctggtctctgggagcatctgctccagatggtttccctggggcccccagaagcaggtgtttgcgctaacagctctgcaagcagagagcttcagtgcatggcccttcttgcccttgttcccaggcacatgctgttcccctggggctgaataccccacttacttgtaaatcccagtgctctcctgttcattctgcagtgccagcacaagtctcctccttggggaaggctttctggacttcccagcccactggccattgttccgtcttgcaggtgccccc

SEQ ID NO: 410771 - DNA, 409 bp, Homo sapiens
acttagaaaaaggcaagtggagaattcctctagctgtctgtcactcggccctgggccctgggtctggtgagcaagcaggcaagaaggcaggaagaggtcagctgtctggacgtgagcatccctgccactgctctctcctgccctggacacagctcgtgcttctctgctcctctaactccccagcctcacatctccaaagaaaggcagctagctctccttacagccctgactgtgggatttcctcatggtaaataaaccaatttataaagtaggtttccaaagaaatgagacggctgtacacacacacatacacccctgaaacatacaccttctaactggcgtcctccagagcagctgtcttgggaagaggcacctttgacaccaacaatgatgtagaacaacttctaga

SEQ ID NO: 410772 - DNA, 603 bp, Homo sapiens
ggagtgcaatggctgtgatgactgcatcctgctcaggttgtgggacatggggttaaaacactgtcacggcaaagacactggccttttacctgagtacaggatagtagccctttgtcctctaagatgctctgtccctggggccagcaaacacctcccaagggagaggagagaaagaaccccgagtagagccagccgagtagagccagccgagggcagataggtcttgtagggctgtgggagccactgcaaccctgggagcttcctgtcagctcaagcccagtgcccagagtgtccaagtgccacctggatgccctgcagtgtccactgtgctgggttctcaaggtttttctctggggggggtctgcggggaacctggagctgctgggtaggaggtgggcttgtggctcagctgtgtccagtggctggctgtggagcgcctcctctgctccagtaatattttcatgggcaagaaagaccactactttcttggccaccgcttcctggagcttgtgttcctggaagccagccataaataagccggccataaacgagggtaaacaggtgcctgagtaaacacaccagagcaaatgagtcatatgggcc

SEQ ID NO: 410773 - DNA, 430 bp, Homo sapiens
agccgtgagccatcgcgcccggcctggagtttctactgtgcaccaggcactacctttacatgtattgttttatttaatcctcagtcagccgtgtttggtaggtgcagttagtatatttccattttcatctgcgcaaacagattcaggaactttgtaatttacataaggtcacattcatcctaattcacaaaatcaagatttcacacctattcctttttctttccagtgcctgtgctttttctctcataccaaggagaagtaataagcctaacgttttaaacctcacaaaagtacatacagaaaagtaaatagcctaattttgcaactaatacaaatggcgctgtacttctttggtgatggtagatttataatttttgaagtatggtagattcaaatgaaccactgaaaaggcatttagtttcttgtccca

SEQ ID NO: 410774 - DNA, 426 bp, Homo sapiens
aaatgatatacgttactgtatatcattaacttgtttttgagaacacaggaaaccatgaaacgcacaaagaagttaattgtgaagacatgcaggatggttttaaacaaacaggaagcggactaagctgatttgcttatttaactattaagttactaagttagccattctaacaaattgccaagtgaagagaacaaacatactgaatctagtgactcaatgaccaatacaatttttaactaagggcgcgcgcgcgcgcgcgcgtgtgtgtgtgtgtgtgtgtgtgtgtgtgttggatagctagggaaggaagaagagtagagatgaagaacaaaggggaaaataaaaattaaatgagacaaaagagggacctggtaaggtcttagtgggtcgtgaactgaggataatcattaattcaactctgaaccc

SEQ ID NO: 410775 - DNA, 835 bp, Homo sapiens
ttgcagtgagccaagatcttgccactgcactccagtctggacaacaggagtaaaactctatctcaaaaaaaaaaaaaaaaaaattcatactagacattctggacagggcactatcagaaatcagtctaagctttaatatttccatctgtataatacaagttatattcaaaagcctcttatgctaatagttatgtgtgaaatatttagagtcagaagttggtaaaccgtgctgtgaggtcagtatataccacttatcttttatgcctctgttactgtcttcaggaaggagggaatggatgaaggcagacaggcaagtatgatcaaatagagatccacctccaaaaattaaagggtttttaaaattttaaagtagctataaacatatttttttaattatttttacttgataccaaaaaaatttaagttgatttttaacaaggcaagtatagatagttgatctaccaaattttgcacagaattcttcaagaggcagacagtatttgataaaaaattatttgcatatctattgtgtcaacaaagcaagttacaaaactagtttatataagaaacaaaatctgtgtgtacgtgtatgtatgttgtttgtagggacagaaaattcatgggaaaataaataagcaacagtgactgtctcaaggacagaagggactttttacagtatgtatattaccatctgtgtgtttttcaattaaaatcagcccgtcaaagtaagtgtaatacacagtattagacttagtaaaaggattggctaggcacagtggctcatgcttgcaatctcagcactttgggaagttggcgtgggaggattgcttgaggc

SEQ ID NO: 410776 - DNA, 518 bp, Homo sapiens
tcattgatgttatgaaaaaaagtacgattttataggctcaaagtataaatgcaactttacaaaattatggttcaatatgattcactggtgatgtttagatggtgtcataatctgaacactaaaggcagaactgttaagactagtggaatgtagacattactttaaaatatttcacagaagaatgaatgattggacacaaaatccatacccattatcaaaagattttcaacattacatttgaaagtgaaaaagagaaaaggctgttagattttttaaaatcttcaagtacagtttaaaggaatagaattactcaaattctggttaacagcaggaaaatagttctactgattgcagaaaaactagtgcatgctttttttgccattagtttctctgtgttcatgggaggaaaatttctcattatggtgaagaacaagaattggatgatctttttaagtaactgtatatagctacttgaagcataacattataaaattttaatatttattgtattccatgat

SEQ ID NO: 410777 - DNA, 410 bp, Homo sapiens
attctaaaatcatctccatttatattggtttatctttttaagacactttgttgtttcagagctaccttgccatgaagattcattaccttttctttgctcttttcttccttggccagctgtctacctcagtttatcttcttcagcaagttcttctttcagttctgtaatcccaacaatttgggaggccaaggaactgaagatgcttatgaagtcattagtatcatggactgtaaaaatcaaacactgtgtaattctcagaatacaactagacactgctctcatgggaaggagattgaactatgtgtcttgcgtcttggaaaaaatgcaaagcgactcactaaccatgaagaaacagcaaattaggaagacaggatgatcaatttccttgtcttattaaaaaataaagtctg

SEQ ID NO: 410778 - DNA, 159 bp, Homo sapiens
gggcactgtaaagactaaatgagataaggctgtggaagaccccagcatctccccagggtccacagaaggtactgaattaaatgttaatttttttccttgtatgggaagatacttattcctttgtctcttctgactgcataaatactgaattgtatgtat

SEQ ID NO: 410779 - DNA, 394 bp, Homo sapiens
tcttctgaaaatttactgagaagttacacatgaaggaaccactgttagcttgaatcctttaaaatctcagcaattatggcccaatcttcaggacgtcaaaagtaaacaagcaggtcttataattaagaaaagcaggtaaacagaataacattaatgtgtaaatcaacaaaacaaaacatcttaaatattatacatatctaatttcaagtcttcaatcccaaatatactaataatactccagaaagaaatgttggaggaaatcagtgaaactaaatgtaaagccaaaaagtaacccaattattttacagaaaaaagtaaatatattgggtttttttttttttgagacagagtcttgctctgtcacccaggctggagtgcagcagtgcaatctcga

SEQ ID NO: 410780 - DNA, 298 bp, Homo sapiens
ttactgttccgtttctaccaggaacctggggctctactgagcttatgctaaaaataagaaaatctagaatatatttattaagaaaggggaatgatcgtgtacatttttataaaagcaagcagtgtggaattttagaataccacttttaatctttaaacttttccataactcttgagtgaacaatgtcataactcaaattctttcatttctcaaataactactgttagcaatttggtgtatattttggtttacattttctgtcagctagtagcaatgctattgaatactaaggaatttt

SEQ ID NO: 410781 - DNA, 450 bp, Homo sapiens
ctcttgaccctacattcaaatacctagaatcataaaaacattgggccccaagagagcttagaatcatttaatccagtccctcatttgtcagatagggaaataaaagttcatttggtaaattgacttgcccaaggtcacccagcccgttaagggcatatggggaaatggaaaccagagctcctgacttcaggtcgaatattcactcccatgcatagaatgagcagcacaacattacccttagaaatgagggctttgggccaggcaccatggttcactctataatcccagcactttgggaggccaaggtggccaggtgtggtggtacacacctgtagtccagctacttgggaggctgcgatgagaggattacctttgcctgggaaggtcgaggctatagtgagctgtgatagtgttactgcactccagcctgggaaacacagtgagatcccg

SEQ ID NO: 410782 - DNA, 376 bp, Homo sapiens
tttttttttggaatggggtctcactctggcatccaagctggagtgcagtggtgtgatcatggctgactttagcctcaaactcctaggctcaagacttcatgtcacctcagcctcccaagtagctgggaccacaggtgtgcaccattacacccagctagtttttaaatttcttgtagacacaggtcttggtatgttgcctaggttggtctcaaactcctgagctcaaccagtcctcctgcctaggcctcccaaagtgttgggattaaaggtataagccaccatgcctggccccagagctttcccaaatccaagaaaagatcaaaattttgaagtttgtaagttttaaggaggactgcagctgtgaaacttcaagata

SEQ ID NO: 410783 - DNA, 386 bp, Homo sapiens
gataaataaacaaattatgtcaataggtgaccatttactgagttcttcctgtgtgtcaagcactgtgctatgtgggtaaatggttatctcgattaatcctcacaacagggaggttagtgctgcttttattcccgttttgcatgtagggaagctgtacagtggtagcgtcactgcctgagcacctagaattctttgctaacagggttgtgtgtgaataatttaattcgtctcttaagatctcaacacactccctccctggcccctgctgtaaacatcctacactgattggaatagaatacatagttcttttcttccaacatggtgtgttctattgatacaagttgtgaattgtggcgacaaggccattttgtattgagaaccattct

SEQ ID NO: 410784 - DNA, 455 bp, Homo sapiens
tttttgagacggagtctcgctctgtcgcccaggctggactgcggactgcagtggcacaatctcggctcactgcaagctccacttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcacccggccggaatatttttaatttggaagccagatcttgtctctaccctgccaaacaccctgcaaaggattccctcctttcacaaagaattaagagccaacatctttaccatagcttacaaggccccacacaatctggctcccattttgcctgacctcatgtcccaccat

SEQ ID NO: 410785 - DNA, 514 bp, Homo sapiens
aaaagggcagtctcttcaacaaatggtgttgggaaaattgaatatccacattcaaaagaatgaaattagatgcttaccttaaactgtatacaaaaattacctcaaaaaagatcgaagtcctaaatgtaagacctaaaactataaaactcttagataaaaacataggaggacattggatttggcaatggatttcttgggcgtgacaccaaaaacaggcaacagaagtaaaaatagatggatgacatcaaaatttaaaacttctgtgtatcaaagaacacattcaacagagtgaaaaggcccataaaatgggtgaaaatatttgcaaatgatatatcctgtaagaggctaatatccagaatacataaggaaatcctaccattcaataacaaaaaacaacctgattttaaagtgaagaagtcaagaaaataagatagactacatactgggagaaaatttttgcaaaagatatatctaataaaggactgttatccaaagtcgacgcaagaactctaaa

SEQ ID NO: 410786 - DNA, 504 bp, Homo sapiens
atgtaaatttaccagagatatttctttaatgagtaaattggctcaatgtatgcattaattgattcataagtctttgaggatctctgatatcaaacaaataagcaagagtcactaaaatcaagaatttattgagaacctactttaacccatttttaaggtcactactgtgtcagttccatttcaaagctagtctcaacctttaaaatacttatactctagttagaggcaaggaataaatacatgaagtacaatgaaaagagctaagtgacaatgcaaaacaaccaatccataaaactgtagatcagagtcatctgggctgaagtaccttgttctgacaggtcatacaactgtacttatccctataaatacctaaggcaaaaatacctatttcttacttcctgcaaagaaattatataaaattatctttcccccaatctttactgtctgtcggcaaaagtgaggcagacttatggttctgagtgagcactaccatttaaaagaaaa

SEQ ID NO: 410787 - DNA, 464 bp, Homo sapiens
gccaccacgcccggctaatttttcaatctttttttttttggtagagatggaatctttctatgttgcccaggttggtcccaacctcctggcctcaagcaatcctcctgccaaagtactgggattacaggtgtgaaccatctcatccagcccaaaattctttctcaagcaaaggcgccttgcccagaggggaaaatgcagatgttttattccctccctctcctcaggcatcaggtattctgccattttgaggcacctggctcccttacctcagatccttttccaggttattctttttgccttcttgcctatttcctgccaaaccatatcctgtttttgtttttgtttttgtatcgagacgagtctcactctgtctcccaggctggagtgcagtggcgcaatctcgactcactgtaagctctgcctccgtcgacgcggccgcgaatttagtagtagtaggcggccgc

SEQ ID NO: 410788 - DNA, 1082 bp, Homo sapiens
ggcgggggcaaggttggagccccgggacgaagaagggacgcgggtcagcgaggcctgaagagtgggaggagatgggacccggctgtagagtgcccagaggtctaggccaggggccgcgctgccgcaggaagatgcgagagtttggctttggtgatctggtccacccggggccagtcttgccccctctgccaccgcagcgtagggcctcctgcattccgtttctctggccggaagggtctagtgttcatccctctcaggctttggcctcctcccactctcccgccctggggcccattcgtttaggaagaatgggagagccggtcgtggcccctgggcggggtaaaggagggaggcttggtaaacctctgctggggaggacccagtacagtggcagctccttgtcggggaaagaacggatctgcgtcacacgctcttacaggggaaccctaaggggcctgaggggtagggcttggtctccacccagagggaaggagaaatttttcgagtcgtaaagaaatgtatcagaagccatggaacatttacagccgcacacgctgggtctcccaacaaacagatccccaaaatattttccagtgctgtactcgtggcatagacccagacccacagaccaggaggaagcgctagagatgtcaacagccaacaaaaacagtgctttacacacttgtaaaattgtgacctacaggggctgggcactgtggctcacgcctgtaaccccagcactttgggtggccaaggtgggaggattgcttgagccccaggagtttgagatcagcctggcaaacatggtaaaatcctgtctctactaaaaatacaaaaattagctgggcgtggtggtgcatgcctgtaatcccagctacctgggaggctgaggcaggagaattgctggaacccaagaggcggaggctgcagtgagccgagattgcgccattgcacttcagtctcggccacagagcgagagtccgtctcaaaaaaaaaaaaaaaaaaaaaaaaaaaggaattagcttggcatggtggcgtgtgccttgcagcgagctgtacgtgatcagtgccactgcactcca

SEQ ID NO: 410789 - DNA, 401 bp, Homo sapiens
ttttaaaatttttggcctgaggttccagtatgtgaaaatctgttattttttcctcttaatttaccaaactgatgatattgtcattcctctgtcagaaaacaattggaaacaaatgcccattaaataggggactacacagaaaaaaaaggaaaaaaaaatacgatctatatttgatgaggaaaaaagtcaaaatgtggaaaagccacagcccatgtgtgttatgctgatttattaaggttatttgaggataaaagacataaaatttatttattttgcttacagtgattaggctttttaaaacataagggactgaagttcttgcaatttggaaatataaataatgtgcaagctatagcactatactaataagcataattccttccatttaacctaccaagcga

SEQ ID NO: 410790 - DNA, 447 bp, Homo sapiens
gaataagaagctgaaggttctactctcatgtgtgctactattttctcatgatcttaggcaaatcagctaagtacgtgcagaatcaatttcctcatttataaaacaaattataatcaatgccagttatcacaacatgcctatagttctatgtatataaatgctttgtaaatggcattaaatggtacaaaaatgtaactatcagggaagaaaacaaacagtttaaattataactttttttttacaactattttggaagagtacttaaggtaaacaatcattcaacaaaatatttattgagcacctacaatgagtcttgctctgttgcccaggctggagtgcagtggtgcaatctcagctcactgcaacctctgcctcccgggttcaagcaaattcttatgcctcagcctcctaaaaagctggaattacgcccagctaatttttgtgttt

SEQ ID NO: 410791 - DNA, 329 bp, Homo sapiens
gacagcatggctgtcttggtagaggctaatatagctggtgactttaaattgaagtcaatgcaaatttattatgatgaaaattttaggacctttaagagttatgttggccaggcgcagtggctcatccctgtaatcccagcactttgggaggccaaggcaagcggattgcctgagctcaggagtttgaaaccactgtgggaaacatggtaaaaccccatctctactaaaatacaagctgggcatggtggcacgcgcctgtaatcccagttactcgggatgccaaggcgggagaattgcttgagcacaggaggcggaggttgtagtgagcc

SEQ ID NO: 410792 - DNA, 357 bp, Homo sapiens
catcactaatttgttttttctttcatcattttcagttcagtaagcattttataaagccaatgtagttaattcatctgaattgggccctgcagcctaagtggagaggaggaaacaaaacaaaacagttgctgcttttaaggcacagaattaaggtctgacgcagtagaactgcttaatgctgatgctgcctgagagcaaacaggaaaggtctcatgcaattaaaaacctttataaatttgtatttttgacaataaccatatattttttcctattaaaaatcttataaaaacgacatattttaaaaaattccaggaattacatcttcatttgagatgagccttttgcaagatgatttat

SEQ ID NO: 410793 - DNA, 534 bp, Homo sapiens
ctgtgtcagcaattgcttttggtttttaaagttataggttgctactacatggatgtgactaagaaaatacatagattatcttaaaatgggcatgatgtaaaagactcaatcagtagggtaactaaaaactttgtagtactctagctttggaaatctgagaggcctatatagttcatttgagtgtttgatcaaattcttattgagattacagcctgtgcaaaatatttgtgatgcatttttaagtttacttaagtacactttgaaattctttaaaaattttaaaatctttaaaaggacacaagagtgtaccacattgagattaaaatgtgtttattattaatttgtacataatactataacaaataattgttctcaggtatgtttaaggccttattttaaaagttgattcttcaatttctaatttaaaataagcttttagtttttctcaactatgtatatgtaatgattataaatgcctagagtagtgtttcccagacaactagaaccacacacaaattagtaccaccaaaaaaa

SEQ ID NO: 410794 - DNA, 368 bp, Homo sapiens
atcagctcggcaccacttgtgtgctcacctgtgtgctctctgtgttttcacctaaaaacctagctatggaaaagcaaggactcagctgggcacagtggctcatgcctgtaatcccagcacttagggaggccgaggcgggtggatcacctgaggccatgaatttcctgtcatttaagccattttgggatggggcttctagtggttgctgtggaaagccactgggcacagtgagtagaagatggtctttctaaggcatagagagatcctgagaccagaagaagagcttcccctctcgatcctcatagaaaaacactgtgacggcaacgagtggtttccaataatcatttcttcttcagaaagttttggcc

SEQ ID NO: 410795 - DNA, 524 bp, Homo sapiens
ctatttcctgactttttttttttttgagacggagtcttgctctgtcacccaggctggagtgcagtggcgcattcaagtgattctcctgtctcagcctactaagtagctgggattacaggcacctgccaccacttccagctactttttacattttttagtagagacaggatttcgccacattggccaggctggtctcgaactcctgacctcaagtgatccacccaccttggcctcccaaagtgctggcattacaggtgtgagccgccatggctggcctatttcctgactttttgtttgtgttttgtgagaccatgaatttcctgtcatttaagccattttgggatggggcttctagtggttgctgtggaaagccactgggcacagtgagtagaagatggtctttctaaggcatagagagatcctgagaccagaagaagagcttcccctctcgatcctcatagaaaaacactgtgacggcaacgagtggtttccaataatcatttcttcttcagaaagttttggcc

SEQ ID NO: 410796 - DNA, 357 bp, Homo sapiens
cgttgtagtcagggaatcacgactctgtgtttataagaaaaaagaacgatggagcaggaccatcaccaagtagagactatgaaaatgtcatttttttggctgggcgcggtggctcacgcctgtaatcccagcactttgggaggctgagacaggcagatcatgaggtcaggagatcgagaccatcctggctaacacggtgaaaccccatctctactaagaatacaaaaaattagccgggcatggtggcacatgcctaaaatcctagctactcaagaggctgagtcaggagaatcactggaacctgcgaggcagagcttgcagtgagccgagatagcgccactgcactccagcctgggc

SEQ ID NO: 410797 - DNA, 373 bp, Homo sapiens
ggactcaaagcagcatagacatgggatgctgaggggccaagtgagcagagcagagagtgagtgctgcaagtcctcggaggggtcaaccgggacccaagcatccagaaaaggcagggaccatgcaaaggggtccgaaaaatgggaccttcagtggaaagcactgagaagaccattattcaggtgaggtttgggataaattcattcccacgaactcccctttgaaaggctcgttcctctaagcatggatttcaaaccagtagtgtcaccatcacctggaagccctttattttattttattatatgttttgagacagagttttgctcttgtcgcccaggctagagtgcaatggcacaatgtcagctcactgcaacc

SEQ ID NO: 410798 - DNA, 1231 bp, Homo sapiens
aacagagtcccaggcaacaggggacagagagactggcccagcaggggctctctgggccaactgagcaaggtgacagggcccaggaaaggagctgttgcctgcacaagggcagatggagtcaaggaatcagtgttcatgggatcctggctgtccccacagtgtcgtggctgaaccttacaagaacagaagcaagtgaagcacaggtagccagccacctcaagggggaagtattgataacgaagggactcaaagcagcatagacatgggatgctgaggggccaagtgagcagagcagagagtgagtgctgcaagtcctcggaggggtcaaccgggacccaagcatccagaaaaggcagggaccatgcaaaggggtccgaaaaatgggaccttcagtggaaagcactgagaagaccattattcagtctctgtgcccagaatcactgtctgccaggctctggccaacctgtagcctctccgtgctgaaaacgacccgctaaaaaagccaagagggaaggacccagcacacagccgtgaaccacatatacacgaagagggcctaaagtgaaaaagataaactttaaatcaaacggaaactttttccagcaacttccactcttgtgatactgaactgaactgaagcagaagattttaagagttgcctgaatcctttggacctgcttattggcttaaaaagtctaattgtgaaattgacttaaaaattcctaattgtgaaagaaggggtctcttctttggcatggcactctcactaacaattttcttggtaagaggaccaacaaacagcaatagaaatagaaaactatggattgctaggtgagagtattttttaacctgcttcaatctacaactgcaaaatgaactggcccaatttaattagaaaaatttcagtttctgaccactgatctacattactgaaaggttacatgtgaaataaatgtggggtgtgtgtgtgtgtttgtgtctgaaattgaatcattttctaactcattcactataaaaaagaaatagacgggatcatttgaactctgcctttgcaatttatcatcttcgtgatcttagacaatctcttaatttctctaagcttccactttctcctctaaaatggagttgaactcaaagggctgacctaaagtttacataaaatgagaaaatgtaaggtactggggctgatacatagacagtattcaataaagctttatgaaatctgtattgt

SEQ ID NO: 410799 - DNA, 576 bp, Homo sapiens
ctatggcaagtctcaggtggctgctggcagctccttggggctccctgctgttttgggtcatgtctagtaacagagagcttctcttttccagcgtttcaggcaaaggttcctagcttcgcactaattggtctgggttggttgatgtgcctacctttgaacccattccctgtggcaaagggatgggaaattcactgactggcttagcctgggtcttgcgctgtatccctggacccagggatggagtcagccttctgagaccaacacagatccccaatttagaaatggaggctgagctgggctcggtggctcatacctgtaatcccagcactttgggaggccaaggcagtcagattgctttagctcaggagttcaagaccagcctgggcaacatagtgagacctctgccccttgtctgtacaaaaagttaagaagcaaagcatggtggcacatgcctgtggtcccagctagttggaaagctgaggtgggaggttggcttgaacccaggaggtcaaggctgcagtgagccgtattgtgccactgcacttcagcctgggcaacagagcgagaccctgtctc

SEQ ID NO: 410800 - DNA, 345 bp, Homo sapiens
tactgaaaatagaatctgcaatcaagggtgctgatattaaataaagatctctgaaaataagaagaggtattcttggggccaggcgcggtggctcacgcctgtaatcccagcactttgggaggccgaggcgggtggatcacctgaggtcgagagttcgagaccagcttgaccaacatggagaaaccccgtctctactaaaaatacaaaattagccaggcatggtggcgcacacctgtagtcccagctactcgggaggctgaggcaggagaaccacttgaacccaggaagcagaggttgcggtgaactgaaattgtgccattgcccttctgcctgggcaacaagagt

SEQ ID NO: 410801 - DNA, 414 bp, Homo sapiens
caggggcctgtgattgtgccactgcagcctggataacggagcaagactctctctctgtctctcaaagccctggtttgaagtgaagtgaaacacatcacttccactcacatgccattgtgaagaactagccgtggaccatacctagatcaagggtggctgggcaacaccttcacatcacaggagaggtagactgcattttggtggatagagactcaaagaattctgtgtagatcaggtaccttccagattaaagtgggatggggatgggggggcatgaatgtgtctatgtgtgtgtatgtataaaaaaaaatgctattgaaacttctaaaactaggcctagttttagaagtttcaatagcatgcaggagttcatataaggacgcagagcctgtcctcgtcagccccgcaggtcct

SEQ ID NO: 410802 - DNA, 881 bp, Homo sapiens
tgtaaagtgaatcaatatcaagagaccaaaccctacaactggacgaagagccacgggaaaactgaggtgttcccagaaagctgatgtatctccatgcattgtgaagtcccagctgatggtgacttcgcagcccaaagccatttgaatcagcagctcttttatgatggctgcaagtatactcattctttaacacttgcaaacaacatggcagaaaatagcaaatcaaggccacatgcatgcatgtgcgccaagcatctacacaaggcacacaaagtcagagaaataagaggctgcatgcttcctctccgctttttcactgtagaaaacattcgtcacaaaggaaacagccttctgatttatagaggtctcctttccacaatgcatgcctataatataaatattttatttaacctatgtgctgtagacccctaagtttttgtgacacccaaaattcatgtgttaaaatcctaaccccaatgtgttagtatcggcaggtcctctgggaaatgattaggtcatgaagatggaggtctcattaggtcataaaggtggaaccctcatgaatggggttggtgttctatgaaagaggccccagaggccaggtgcagtggctcacacctgtaatcccagcaccctgggaggccgaggcaggtggatcacctgaggtcaggagttcgagaccagcctggccaacatggcaagaccctgtctctactaaaaatacaaaaattagccaggcatggttgtgcacacctgtaattccagctactcgggaagctgaggcaggagaatcccttgaacctgggagacggaggttgcaatgagctgagatcgcgccacagcactccagcctgggtgacaagagtgaaactccatctcaa

SEQ ID NO: 410803 - DNA, 350 bp, Homo sapiens
ttttttttttgtagagacagggtttcgccattttgcccagggtggtctcgaactcctgggctcaagtgatctgttcgcctcaacctcccaatgggctgggattacaggcgcgagccacagttcccaacctttatttttaaaagctttacatataattcaacaccctttctcagcagctacttacccagtgtttaaaggtttaatgttcttcacagttatgtaattcttctatcactctgaactcaatcttagaaccttttttttctttttgagacggagttttgctctcgttgcccaggctggaatgcagtggcgcaatctcggctcaccgcaacctctgcctcccgggt

SEQ ID NO: 410804 - DNA, 472 bp, Homo sapiens
cttcctcacagttggtgacacctgcaggctgaagcagcattttctgtactttggcaccaccttgtggttcagctgaaaaaagtctagaaatgggccgcatccatcttgggctcattgagcatcatgaacagtcttgaagggccatctggcttttgttatctccttcagcctgagaagaaatgagatttgttactggatagggaatgtctcctataggctaaaccgcctgctgagaaatccaacgaggtaatggctccaatttgaactaagcagagagtcatgcagaaacatcaatccaggctgccgctgttctctattatttagattgaattgtgtctactttccacagatgactcggctcagccagagaacttggcatctctgtgtgctgttactgtaaaatggggagtgattgttttcagctgctccaagttaggaattagctcctggccattgataatacctcctggaa

SEQ ID NO: 410805 - DNA, 312 bp, Homo sapiens
tatgaactgacgattgtttcgccgaaaccaagtcactgcttatggcatgaccagtgctaggactgcgacggtggtgggactcgggtgggggatgcctgtgccacgtgtgctgatagaagttcccagactcttctgtcacttgagcaagactgccatagagccactgtgctcccagagtgctgtgctgtcatttggcctttgctagaactgaaccccatgtatagagtctgttttctgcctacttagcttgtgacactttgagtcaatgcaaataattgctggaaggtgttaatgctgttttgttttttgttt

SEQ ID NO: 410806 - DNA, 342 bp, Homo sapiens
ttttaagactactcaagtgcaatagtgagaagggcgaaaagagtagaataggggaataagggccaggcacgatggctcacacctataatcccagcattttgggaggccaatgagggcagaccacctgaggtcaggagttagagaccagcctggccaacatggtgaaaccccatctctactgaaaatacaaaaattagccacgtgtggtggcacacacctgtggtcccagctactcaggaggctgaggcaagagaactgcttgaacccaggaggtggaggttgcagtgacctgagatcatgccactgcattccagccctgggtaacaagaacaaaactctgtc

SEQ ID NO: 410807 - DNA, 3495 bp, Homo sapiens
gaggtgctggggagcagcgtgtttgctgtgcttgattgtgagctgctggggaagttgtgactttcattttacctttcgaattcctgggtatatcttgggggctggaggacgtgtctggttattatataggtgcacagctggaggtgagatccacacagctcagaccagctggatcttgctcagtctctgtcagaggaagatcccttggaggaggccccgcagcgacatggagggagctgctttgctgaaaatctttgtcgtctgcatctgggtgcagcaaaaccatccaggctggacagtggctggacagttccaagaaaagaaacgcttcactgaagaagtcattgaatacttccagaagaaagttagcccagtgcatctgaaaatcctgctgactagcgatgaagcctggaagagatttgtgcgtgtggctgaattgcccagggaagaggcagatgctctctatgaagctctgaagaatcttacaccatatgtggctattgaggacaaagacatgcagcaaaaagaacagcagtttagggagtggtttttgaaagtttcctcaaatcagatggaagattcaggagtccatagaaaggcttcgtgtcattgcaaatgagattgaaaaggtccacagaggctgcgtcatcgccaatgtggtgtctggctccactggcatcctgtctgtcattggcgttatgttggcaccatttacagcagggctgagcctgagcattactgcagctggggtagggctgggaatagcatctgccacggctgggatcgcctccagcatcgtggagaacacatacacaaggtcagcagaactcacagccagcaggctgactgcaaccagcactgaccaattggaggcattaagggacattctgcgtgacatcacacccaatgtgctttcttttgcacttgattttgacgaagccacaaaaatgattgcgaatgatgtccatacactcaggagatctaaagccactgttggacgccctttgattgcttggcgatatgtacctataaatgttgttgagacactgagaacacgtggggcccccacccggatagtgagaaaagtagcccggaacctgggcaaggccacttcaggtgtccttgttgtgctggatgtagtcaaccttgtgcaagactcactggacttgcacaagggggcaaaatccgagtctgctgagtcgctgaggcagtgggctcaggagctggaggagaatctcaatgagctcacccatatccatcagagtctaaaagcaggctaggcccaattgttgcgggaagtcagggaccccaaacggagggactggctgaagccatggcagaagaacgtggattgtgaagatttcatggacatttattagttccccaaattaatacttttataatttcctatgcctgtctttaccgcaatctctaaacacaaattgtgaagatttcatggacacttatcacttccccaatcaatacccttgtgatttcttatgcctgtctttactttaatctcctaatcctgtcagctgaggaggatgtatgtcacctcaggaccatgtgataattgcgttaactgcacaaattgtagagcatgtgtgtttgaacaatatgaaatctgggcaccttgaaaaaagaacaggataacagcaattgttcagggaataagagagataaccttaaactctgaccaacagtgagcctggtggaacagagtcatatttctcttctttcaaaagcaaatgggagaaatatcgctgaattctttttctcagcaaggaacatccctgagaaagagaatgcacccctgagggtgggtctataaatggcctccttgggtgtggccatcttctatggtcgagactgtagggatgaaataaaccccagtctcccatagcgctcccaggcttattaggaagaggaaattcccgcctaataaattttggtcagaccggttgctctcaaaaccctgtctcctgataagatgttatcaatgacaatggtgcccgaaacctcattagcaattttaatttctccccggtcctgtggtcctgtgatctcgccctgcctccacttgccttgtgatattctattaccttgtgaagtaggtgatctttgtgacccacacccacaccctattcatacactccctccccttttgaaagtccctaataaaaacttgctggttttgcggcttgtgaggcatcacggaacctaccgatgtgtgatgtctcccctggacacctagctttaaaatttctctcttttgtactctgtgcctttatttctcaaaccggccaacacttagggaaaatagaaaagaacctacgtgaccatcggggcaggttccccgatacccaatgaccccagagcagtgcagccaccagggaaggtgagccagacacaggccgggacaaaacgcagacattttttaggggaataaagagggcgaggtaaagtttatggaactcagtgttaggaactttggcatctgtagctgagcacagcaggggaggggttactcaagatggcaagtgcgccaaggagaaggcagaaatgctggggcctggaataagggaggagaggggactggagagtgtggggaatggaaagaagcagtttactctagactaaagagtatattgggggaggaagagagggaggcacgtaggaacaagcaatgagaagaccaggaaaagaaagagctgaaaatggagaaagccacagttagaactgttggatacaggagaagaaacagcggctccactaaagacccgccccccggttggatgtccttccaagaatggaatccttccctggtgatggtctctcaccctgtcttaccagcatccactctcccttgtcctcccgggggtgtatctgagtcagccagtggcttcttgatgatggtggtggtggttgtagtgtgacaggtcccctttaggttatttaagggtgcatgtcccctgcttgaaccctgaaggccgggtaatgagccatttccatggtgcccagctgaggaccaggtgtctctgagaatccaaacatcctggagagtatctgagaaccaaccaagtaaaagtctcgttgctcatatatagtagacaaagagccagaaaattaactgaaaagcagtttagacattgggggaggctggatctctcgagctgtcttgctgagtgccctgtgtgtaagtcctaataaacttagctactcgccaagctggacttgtttaagtcattccttggtctcatggctcctttcccgctttgagggcaagttcctgtctcaagtttttgtcctaacagtggtaaaggtgattgtggtgatgtcagcagacagcaagaggacttgacatggggtcggccctgcttggggccagcgtacactgagggaccgatgacatttcaatgaaactccaaatgctatattggaaacgttgatgtgtgaagaaaaataaaagcaaaaccagatgccaggaacaagtca

SEQ ID NO: 410808 - DNA, 935 bp, Homo sapiens
gaggtgctggggagcagcgtgtttgctgtgcttgattgtgagctgctggggaagttgtgactttcattttacctttcgaattcctgggtatatcttgggggctggaggacgtgtctggttattatataggtgcacagctggaggtgagatccacacagctcagaccagctggatcttgctcagtctctgtcagaggaagatcccttggaggaggccccgcagcgacatggagggagctgctttgctgaaaatctttgtcgtctgcatctggaaccaaaatcacttcccggaattgaccaactggtagactcgcctagaggggacgcactgtgtcctagttgaggctaacagtcagtatccagcctcaacattcagcagaggccccagatcagcgtctgagccaggccaacaatgaccaaggaggatgggatcctgggtgcagctcatcacaagcgtcgggacaagcggacttttccttggtgtgagagtgagggaagagggagctggaatgaggtgcagcaaaaccatccaggctggacagtggctggacagttccaagggtcctctgggcccatcccctccccctgtccctacagctggttacagcagctccttctgtgtccattatgtgaacctgctgcctggagttcttgttctttctgtgacctcccagtatccacatctcagcatggccctctgtcagctggctgctcatgactggccgaggttaagctgtgtttgtgtctgacagaagcgcccatctgatatgaccccagttcagattcatagcttgcagtttcatggggggttacagctgttctgaaggtctggttggttttgtttgcccgggaatgtttcaggtctggtttttattttaattttgctttaatattcaccatccccaccccatcaataaaacacaaatttagtgctgg

SEQ ID NO: 410809 - DNA, 3684 bp, Homo sapiens
gaggtgctggggagcagcgtgtttgctgtgcttgattgtgagctgctggggaagttgtgactttcattttacctttcgaattcctgggtatatcttgggggctggaggacgtgtctggttattatataggtgcacagctggaggtgagatccacacagctcagaccagctggatcttgctcagtctctgtcagaggaagatcccttggaggaggccccgcagcgacatggagggagctgctttgctgaaaatctttgtcgtctgcatctggaaccaaaatcacttcccggaattgaccaactggtagactcgcctagaggggacgcactgtgtcctagttgaggctaacagtcagtatccagcctcaacattcagcagaggccccagatcagcgtctgagccaggccaacaatgaccaaggaggatgggatcctgggtgcagctcatcacaagcgtcggggtgcagcaaaaccatccaggctggacagtggctggacagttccaagaaaagaaacgcttcactgaagaagtcattgaatacttccagaagaaagttagcccagtgcatctgaaaatcctgctgactagcgatgaagcctggaagagatttgtgcgtgtggctgaattgcccagggaagaggcagatgctctctatgaagctctgaagaatcttacaccatatgtggctattgaggacaaagacatgcagcaaaaagaacagcagtttagggagtggtttttgaaagtttcctcaaatcagatggaagattcaggagtccatagaaaggcttcgtgtcattgcaaatgagattgaaaaggtccacagaggctgcgtcatcgccaatgtggtgtctggctccactggcatcctgtctgtcattggcgttatgttggcaccatttacagcagggctgagcctgagcattactgcagctggggtagggctgggaatagcatctgccacggctgggatcgcctccagcatcgtggagaacacatacacaaggtcagcagaactcacagccagcaggctgactgcaaccagcactgaccaattggaggcattaagggacattctgcgtgacatcacacccaatgtgctttcttttgcacttgattttgacgaagccacaaaaatgattgcgaatgatgtccatacactcaggagatctaaagccactgttggacgccctttgattgcttggcgatatgtacctataaatgttgttgagacactgagaacacgtggggcccccacccggatagtgagaaaagtagcccggaacctgggcaaggccacttcaggtgtccttgttgtgctggatgtagtcaaccttgtgcaagactcactggacttgcacaagggggcaaaatccgagtctgctgagtcgctgaggcagtgggctcaggagctggaggagaatctcaatgagctcacccatatccatcagagtctaaaagcaggctaggcccaattgttgcgggaagtcagggaccccaaacggagggactggctgaagccatggcagaagaacgtggattgtgaagatttcatggacatttattagttccccaaattaatacttttataatttcctatgcctgtctttaccgcaatctctaaacacaaattgtgaagatttcatggacacttatcacttccccaatcaatacccttgtgatttcttatgcctgtctttactttaatctcctaatcctgtcagctgaggaggatgtatgtcacctcaggaccatgtgataattgcgttaactgcacaaattgtagagcatgtgtgtttgaacaatatgaaatctgggcaccttgaaaaaagaacaggataacagcaattgttcagggaataagagagataaccttaaactctgaccaacagtgagcctggtggaacagagtcatatttctcttctttcaaaagcaaatgggagaaatatcgctgaattctttttctcagcaaggaacatccctgagaaagagaatgcacccctgagggtgggtctataaatggcctccttgggtgtggccatcttctatggtcgagactgtagggatgaaataaaccccagtctcccatagcgctcccaggcttattaggaagaggaaattcccgcctaataaattttggtcagaccggttgctctcaaaaccctgtctcctgataagatgttatcaatgacaatggtgcccgaaacctcattagcaattttaatttctccccggtcctgtggtcctgtgatctcgccctgcctccacttgccttgtgatattctattaccttgtgaagtaggtgatctttgtgacccacacccacaccctattcatacactccctccccttttgaaagtccctaataaaaacttgctggttttgcggcttgtgaggcatcacggaacctaccgatgtgtgatgtctcccctggacacctagctttaaaatttctctcttttgtactctgtgcctttatttctcaaaccggccaacacttagggaaaatagaaaagaacctacgtgaccatcggggcaggttccccgatacccaatgaccccagagcagtgcagccaccagggaaggtgagccagacacaggccgggacaaaacgcagacattttttaggggaataaagagggcgaggtaaagtttatggaactcagtgttaggaactttggcatctgtagctgagcacagcaggggaggggttactcaagatggcaagtgcgccaaggagaaggcagaaatgctggggcctggaataagggaggagaggggactggagagtgtggggaatggaaagaagcagtttactctagactaaagagtatattgggggaggaagagagggaggcacgtaggaacaagcaatgagaagaccaggaaaagaaagagctgaaaatggagaaagccacagttagaactgttggatacaggagaagaaacagcggctccactaaagacccgccccccggttggatgtccttccaagaatggaatccttccctggtgatggtctctcaccctgtcttaccagcatccactctcccttgtcctcccgggggtgtatctgagtcagccagtggcttcttgatgatggtggtggtggttgtagtgtgacaggtcccctttaggttatttaagggtgcatgtcccctgcttgaaccctgaaggccgggtaatgagccatttccatggtgcccagctgaggaccaggtgtctctgagaatccaaacatcctggagagtatctgagaaccaaccaagtaaaagtctcgttgctcatatatagtagacaaagagccagaaaattaactgaaaagcagtttagacattgggggaggctggatctctcgagctgtcttgctgagtgccctgtgtgtaagtcctaataaacttagctactcgccaagctggacttgtttaagtcattccttggtctcatggctcctttcccgctttgagggcaagttcctgtctcaagtttttgtcctaacagtggtaaaggtgattgtggtgatgtcagcagacagcaagaggacttgacatggggtcggccctgcttggggccagcgtacactgagggaccgatgacatttcaatgaaactccaaatgctatattggaaacgttgatgtgtgaagaaaaataaaagcaaaaccagatgccaggaacaagtca

SEQ ID NO: 410810 - DNA, 2397 bp, Homo sapiens
gaggtgctggggagcagcgtgtttgctgtgcttgattgtgagctgctggggaagttgtgactttcattttacctttcgaattcctgggtatatcttgggggctggaggacgtgtctggttattatataggtgcacagctggaggtgagatccacacagctcagaccagctggatcttgctcagtctctgtcagaggaagatcccttggaggaggccccgcagcgacatggagggagctgctttgctgaaaatctttgtcgtctgcatctggaaccaaaatcacttcccggaattgaccaactggtagactcgcctagaggggacgcactgtgtcctagttgaggctaacagtcagtatccagcctcaacattcagcagaggccccagatcagcgtctgagccaggccaacaatgaccaaggaggatgggatcctgggtgcagctcatcacaagcgtcggggtgcagcaaaaccatccaggctggacagtggctggacagttccaagaaaagaaacgcttcactgaagaagtcattgaatacttccagaagaaagttagcccagtgcatctgaaaatcctgctgactagcgatgaagcctggaagagatttgtgcgtgtggctgaattgcccagggaagaggcagatgctctctatgaagctctgaagaatcttacaccatatgtggctattgaggacaaagacatgcagcaaaaagaacagcagtttagggagtggtttttgaaagtttcctcaaatcagatggaagattcaggagtccatagaaaggcttcgtgtcattgcaaatgagattgaaaaggtccacagaggctgcgtcatcgccaatgtggtgtctggctccactggcatcctgtctgtcattggcgttatgttggcaccatttacagcagggctgagcctgagcattactgcagctggggtagggctgggaatagcatctgccacggctgggatcgcctccacttgccttgtgatattctattaccttgtgaagtaggtgatctttgtgacccacacccacaccctattcatacactccctccccttttgaaagtccctaataaaaacttgctggttttgcggcttgtgaggcatcacggaacctaccgatgtgtgatgtctcccctggacacctagctttaaaatttctctcttttgtactctgtgcctttatttctcaaaccggccaacacttagggaaaatagaaaagaacctacgtgaccatcggggcaggttccccgatacccaatgaccccagagcagtgcagccaccagggaaggtgagccagacacaggccgggacaaaacgcagacattttttaggggaataaagagggcgaggtaaagtttatggaactcagtgttaggaactttggcatctgtagctgagcacagcaggggaggggttactcaagatggcaagtgcgccaaggagaaggcagaaatgctggggcctggaataagggaggagaggggactggagagtgtggggaatggaaagaagcagtttactctagactaaagagtatattgggggaggaagagagggaggcacgtaggaacaagcaatgagaagaccaggaaaagaaagagctgaaaatggagaaagccacagttagaactgttggatacaggagaagaaacagcggctccactaaagacccgccccccggttggatgtccttccaagaatggaatccttccctggtgatggtctctcaccctgtcttaccagcatccactctcccttgtcctcccgggggtgtatctgagtcagccagtggcttcttgatgatggtggtggtggttgtagtgtgacaggtcccctttaggttatttaagggtgcatgtcccctgcttgaaccctgaaggccgggtaatgagccatttccatggtgcccagctgaggaccaggtgtctctgagaatccaaacatcctggagagtatctgagaaccaaccaagtaaaagtctcgttgctcatatatagtagacaaagagccagaaaattaactgaaaagcagtttagacattgggggaggctggatctctcgagctgtcttgctgagtgccctgtgtgtaagtcctaataaacttagctactcgccaagctggacttgtttaagtcattccttggtctcatggctcctttcccgctttgagggcaagttcctgtctcaagtttttgtcctaacagtggtaaaggtgattgtggtgatgtcagcagacagcaagaggacttgacatggggtcggccctgcttggggccagcgtacactgagggaccgatgacatttcaatgaaactccaaatgctatattggaaacgttgatgtgtgaagaaaaataaaagcaaaaccagatgccaggaacaagtca

SEQ ID NO: 410811 - DNA, 281 bp, Homo sapiens
  misc_feature (39)..(39): n is a, c, g, or t
atttatttttttatctcacttaattatataaaaaaacanaaataaatcctagtagaacaaaggcagtcaagggtgcaaggatattagaagctgtgttctgtgagctttcatgaaggctgtggaaggatccaggcaggatggcctcaaattaagattttaatgactctttggtttagaaaacacactcttgctgttaacgctatcttatcaggtatcatttttgaattcacagatgaaagttaaaaaattcataattatacaaatacttgccttgtatgttt

SEQ ID NO: 410812 - DNA, 282 bp, Homo sapiens
atgtaatgacagcatcaattttaatttgcatttttctggttactgatgaggaggagcacctttgatttccttcttgtgacattcctgttcaagcctcttgtccatttactactgagttatacgtctttttcttgttgcgttgtgagaattcttcacatggtttgggtactgagtaattctttatctatttcaataccttccactattctgcttgacttctactctgccagtggtatcttttgtttttgtttttgttttgagatggagttttgcttttgttgc

SEQ ID NO: 410813 - DNA, 415 bp, Homo sapiens
gggtattttatgatgacaataacagaagcagcatctttacttggcttacatattattcagtggttctctaacaatctatttaactacactgaaaataatttcagcaataattggaaaacctgttttcaggctccgcactctataagaaataaggaagttgtaaaggtaagcctttgaccttgtgctacatatttagcacaaaaagcacatactgagattataatgtgtgcagatgtgtggctgtgataagtcattccaggtatgaaaaatacaactaaggcatagctactacctttaacatgcttatagtatgcaaagcattacattacataaagaatatttaaaacatgttattaaaattatttgaggactgatttctggaatagtgaagagctatgaacctggtccccaggaa

SEQ ID NO: 410814 - DNA, 395 bp, Homo sapiens
aaaaatgtttaatagagatgaggtctccttatgttgcccaggctgttctcaaactcccaagctcaagcaatcctcccaccttggccttccaaagtcctgggattacagccatgagccaccacacccagcctaaatactttttaatctacactaccagtaagtatttttcataagaaaccattattaaatgagtgattaaaaccaagaggggcagggcgtggtggttcacgcctgtaatcccagcactttgggaggccgaggcgggtggatcatttgaggtcaggagttcaagatcagcctggccaacatggtgaaaccccgtttctactaaaaatacaaaaattagccagacatggtggtgcacacctgtagtcccagctacttgggaggctgag

SEQ ID NO: 410815 - DNA, 370 bp, Homo sapiens
gcatttggtgaaattaaacatcccttcatgttaaaaactaaaatattgtagagaaggaacatacctcgaaacactaaaagacatatatgacagaccttgtatcatactcaatggggaaaagcagaaagcctatttctctgagatctgaaacaacatgaggatgcccactttcaccactgttatttgagattgtacaggaagtcctagctagagtaattagaccagagaaataaataaagtgcatccaagttggaaaggaagaagtaaagttatccttgtttgcagatgatatgatcttatatttggatacacttaagactacaccaaaaaactattagaacgtagaaacaaattctgtcaagttgcagga

SEQ ID NO: 410816 - DNA, 1290 bp, Homo sapiens
tgggttcgagttcaaggttgaggagcagtctggggacatcagctcttaatatttttcaagttttggagcaagtggtttctaggttctgagtgaagtgaaacagaatctctaggggcatgtggtaaagataatcccatactatgtactgcgtagagttaaagagaagaggcgagagcatgaagataaaccagtacaatcagtcgttcacataccactaactacaatgatactcccatttgcttcctgtgaagtagttactaataatcactgatgtcgctttttaatttcatacatcctttaactgtcttcatataggtattgaaagagtcaacataaaagccacatccattttctaattttgaacaatagttagagaaacctaatatcttctcatatttttgtcttgcttctgtctcatgagttcccaaaatagatatattatctgaatgaagagttcatgggcaaatgtcacacttttcttggtttggctaattatatttctgcttttgcttagaataagattaattttcctattctgctaataaaccacgtgatggcaaaatgccttattctgagaaaagaagcctttggtattttaaagaattgggaagctatttcagataagctatcatatgcatgaagattaatttattcatatgaaatgttcaataaccagaaaagactgttttaaataaaaccatttcacaattaagtttttttttggttatggacagtgatttcttctaagaaacaaagcgcctgtctatatgaagaataactaaaataatggttagcaaatattgattggatccagccaagtgagcagcatttttgagtttacagatgtggtaactttgaactatatttacgtgcttataatgaaaccttacagttggagtaatagctttgttcctgagtctcatgaatattttccagctcctttgtcctaaatttctgcctgacaatcatccatttcaaggaataaaaggatataataagtgataaacctatgctggaaatttttaatctaaaaagttcacatactgtttctaataaactgaaaactattagagaaagatggaggtattaaaacctgttaataaggaaatcaatggcaacatattttaaatggttttgaattttataaagattttcttttatagcactatgtcctttttcttttcttctccttgtttgatttccaacagctgagctatttacttgttgagttatttcatatctattattccatttagaactcgaacccagtgtgaagctcctctagatctt

SEQ ID NO: 410817 - DNA, 751 bp, Homo sapiens
gactcttttctatgttctatatacacacagaaatacacatgcaaagctgaacacatgtgtgaaacaaaattcagacactcaaattttccgccaacacgtgataaaatcttgcacaatagcttcctccacagaggaaaatgtctttactacatcttaaaaatggggtaaatgaatagttaggctcttcagtgtaataatcatgataaatattctcaatatgcgaaaatacaaacaaaggactttctctcccagcaaatttagacccacatgaaaatttaagcacaatcattttaaacgaatttatcctggagcttagtgggttcgagttcaaggttgaggagcagtctggggacatcagctcttaatatttttcaagttttggagcaagtggtttctaggttctgagtgaagtgaaacagaatctctaggggcatgtggtaaagataatcccatactatgtactgcgtagagttaaagagaagaggcgagagcatgaagataaaccagtacaatcagtcgttcacataccactaactacaatgatactcccatttgcttcctgtgaagtagttactaataatcactgatgtcgctttttaatttcatacatcctttaactgtcttcatataggtattgaaagagtcaacataaaagccacatccattttctaattttgaacaatagttagagaaacctaatatcttctcatatttttgtcttgcttctgtctcatgagttcccaaaatagat

SEQ ID NO: 410818 - DNA, 571 bp, Homo sapiens
tgtgagccaaagatttatgtcttcatttcttgcatttgaagtactcttggatgacatccttggcctgagactccttgccatagtccttaactactacacaactgcaaccaaccactttacagggtttcccttctctcaattttacagagcgctacccattcccctagtttcttgttgtcatcaaccttaattaagttgatttggtgctcagcacaaagggactccaccagcttgacatacataggcttatcacagttggatcaagcacacaaagatgggcttggcgcttgtctaaggctttggcagcttcacagattccacgtgctaggccatcgtggatgagggcggtcttcagcacctcttgtaaagcagtattaacatccattacacctccagcagcaatgcctccctcggccatggcagtgggttatgggtgaagctgaatcttgaacatacccaagcctccgcctccgcgcaactcggcagtggcagggaaagggtgattaacatattttttaatgttatatatatatataatactataatcttacaataagctgaagaaaagaaa

SEQ ID NO: 410819 - DNA, 2551 bp, Homo sapiens
aggagaaataacaggaggcgcagttactgatatagccaaggtgggacactactggagggagctagaagggatcagccagccatgcctccagttcaggtacttggcattgctaagctcagaacaggacttgccagtgtctagatgaaaaagaggagagatctcaagagggataaccaattggctggcaaagtaacaaatgaaaagtaacctgactctattgacctgcttaaccctgcatgggggggaaggatggaaaggagcagctgtttgctttgaaacggtggaacagttttgcagccttagaaaatggcatgtaacatacctaaccaaagacagcggactctgtcaacaacaggagaagctctatacgaaattcttggtctgcataagggagcatcaaatgaagaaattaagaaaacctacaggctggaaaatcccttcacctaaaggcacctggctcctcagctactaccaacaaggagtgttgggagcctcagaagcgggagacaaaccaaacaaaccaaagaagcaccgtaaagactctgaaaagtagattgttattggaaccactcacaaaagtaggctagaacctgcatgctaaacctaaagggggctgcctgctaaaataaaacaacttaaatagaacccattatctcccaacatgataaccaaaatatccagatacaaacaaaatgacccatcctacaaagaagcaagaaaatcacaacttgaataagaaaagacaatcagctaactcctgtgctgagatgaaccagatgttggaactatctgaaaagcattttaaagtaaccatcataggccgggtgcggtggctctcgcctgtaatcccagcactttgggaggccgaggctggcggatcacgaggtcaggagattgagaccatcctggctaacacagtgaaagcccatctctactaaaaatacaaaaattagccgggcttagtggcaggcgcctatagtcccagctactcgggaggctgaggcaggagaagggcgtgaacctgggaggcggagcttgcagtgagccgagatcgcgccactgcactccagcctgggcgacagagcaagactgtctcaaaaaataaataaataaataaagtaaccatcataaaaaattcaacaagtaacgacaaattctcttgaagcaagtaaaaaaaaatggaaattctcagtgaagaaataggaattaacaaaaaagaaccaaatggaaactatagaaccaaaaaataacacaaataataaaactaactggatgagcttaatagtacagtggagatgacagagaatagaaattgaggacagatcaatagaatgttcccgatctgaacaaccgataaacaataaactgaaaacagagtctcagaaacctgtgggacaataacaaagatccaacatttatagcattgacatcctagaaggagaagagtgaaacaatgggactaaaagagtactaaaagaagtaatggctggaaattccccacatttggcaaaaaatagaaacctacagattcaagaggctgagagaactccgacaggataaacccaaagcaatcaatgccaagaaacattataattaaatttctgaaaactacagacaaagaaaaaaatttgaaagcagccagggagaaacaatgcatggccaaacacccatttgaatggcagcatatttctcatctaaagcaacagcagcctgaaggaagtgacaaaagatttttcaactgatgaaagagaagaactgtcaacagaaaattctgtatctggtgaaactatatttcacgagtgaatggggaaatacgttctcacataaagggaatctaaaagaattgtcactagcagatctcttcttaaagaatggctaaaggaagttcttcgaaagaaaggaaatgataaagaaaggatcttagacgatcaggaagaaggaaagaacaagggagaaagcagaaatatggaaaattggccctgaaacaccatccagacaagaatccagatgatccagctgctactgagaagtttaaagaaatcaacaacgcccacgcaatacttaccgacatttcaaagagaagcatatacgacaagtacggatcgctgggactctacgtggccgagcagtttggagacgaaaacgttaacacctacttcatgctgtcgagctggtgggcaaaggccctgtttgtcatcgttggcctcttgacgggctgctacttttgctgctgcctgtgctgctgctgcaactgctgctgtggacactgccggcccgagtcatcagtgccagaagaggacttctatgtgtccccagaggatctggaggagcagatcaagtctgacatggaaaaagatgtggactttccagtttttctccagcctacaaatgcaaatgagaaaacacagctaatcaaagaaggatctcgaagttattgcacagactcttgatattgagccctcagagagtccacagtccctcctctcagttcagtcttgtctccagatggtcgtaggggagcgtgtggggcataaagtgctgtgaacttttc

SEQ ID NO: 410820 - DNA, 1389 bp, Homo sapiens
aggagaaataacaggaggcgcagttactgatatagccaaggtgggacactactggagggagctagaagggatcagccagccatgcctccagttcaggtacttggcattgctaagctcagaacaggacttgccagtgtctagatgaaaaagaggagagatctcaagagggataaccaattggctggcaaagtaacaaatgaaaagtaacctgactctattgacctgcttaaccctgcatgggggggaaggatggaaaggagcagctgtttgctttgaaacggtggaacagttttgcagccttagaaaatggcatgtaacatacctaaccaaagacagcggactctgtcaacaacaggagaagctctatacgaaattcttggtctgcataagggagcatcaaatgaagaaattaagaaaacctacagaaaattggccctgaaacaccatccagacaagaatccagatgatccagctgctactgagaagtttaaagaaatcaacaacgcccacgcaatacttaccgacatttcaaagagaagcatatacgacaagtacggatcgctgggactctacgtggccgagcagtttggagacgaaaacgttaacacctacttcatgctgtcgagctggtgggcaaaggccctgtttgtcatcgttggcctcttgacgggctgctacttttgctgctgcctgtgctgctgctgcaactgctgctgtggacactgccggcccgagtcatcagtgccagaagaggacttctatgtgtccccagaggatctggaggagcagatcaagtctgacatggaaaaagatgtggactttccagtttttctccagcctacaaatgcaaatgagaaaacacagctaatcaaagaaggatctcgaagttattgcacagactcttgatattgagccctcagagagtccacagtccctcctctcagttcagtcttgtctccagatggtcgtaggggagcgtgtggggcataaagtgctgtgaacttttccatcttgttgttttatttttgggttaggaaaacatgattgctatataattttctcagtatgcagactttctctctgagtagaatttcttatgaaacacattcaatttgggtgaataaaggcctgaagagttattttaccctccttgcctgatgtaggacagtggaattgtacagcctttatgaacctgccctttatgtgtggcggatctgattcctaactgaccaaagtaatattccagaacaaaagccacttttcttacatttaacacaatattcatatctaccacgaacatgatcatcaaaatatatgagaacttataaagagtttttgtgtgtggagcctcttccgtgtcaatattcaataaagttatagaaatgtttc

SEQ ID NO: 410821 - DNA, 542 bp, Homo sapiens
cccaaagcaatcaatgccaagaaacattataattaaatttctgaaaactacagacaaagaaaaaaatttgaaagcagccagggagaaacaatgcatggccaaacacccatttgaatggcagcatatttctcatctaaagcaacagcagcctgaaggaagtgacaaaagatttttcaactgatgaaagagaagaactgtcaacagaaaattctgtatctggtgaaactatatttcacgagtgaatggggaaatacgttctcacataaagggaatctaaaagaattgtcactagcagatctcttcttaaagaatggctaaaggaagttcttcgaaagaaaggaaatgataaagaaaggatcttagacgatcaggaagaaggaaagaacaagggagaaagcagaaatatgggtaaatacaaaagactatccttttcctcgtgagtggtgtgtgtcctcccaccctcgatggtggtgtgttctcgctcctagcctgtactttgtattcccttaacagtatatcttaaagataattccaaggaaaga

SEQ ID NO: 410822 - DNA, 1007 bp, Homo sapiens
aggagaaataacaggaggcgcagttactgatatagccaaggtgggacactactggagggagctagaagggatcagccagccatgcctccagttcaggtacttggcattgctaagctcagaacaggacttgccagtgtctagatgaaaaagaggagagatctcaagagggataaccaattggctggcaaagtaacaaatgaaaagtaacctgactctattgacctgcttaaccctgcatgggggggaaggatggaaaggagcagctgtttgctttgaaacggtggaacagttttgcagccttagaaaatggcatgtaacatacctaaccaaagacagcggactctgtcaacaacaggagaagctctatacgaaattcttggtctgcataagggagcatcaaatgaagaaattaagaaaacctacagaaaattggccctgaaacaccatccagacaagaatccagatgatccagctgctactgagaagtttaaagaaatcaacaacgcccacgcaatacttaccgacatttcaaagagaagcatatacgacaagtacggatcgctgggactctacgtggccgagcagtttggagacgaaaacgttaacacctacttcatgctgtcgagctggtgggcaaaggccctgtttgtcatcgttggcctcttgacgggctgctacttttgctgctgcctgtgctgctgctgcaactgctgctgtggacactgccggcccgagtcatcagtgccagaagaggacttctatgtgtccccagaggatctggaggagcagatcaagtctgacatggaaaaagatgtggactttccagtttttctccagcctacaaatgcaaatgagaaaacacagctaatcaaagaaggatctcgaagttattgcacagactcttgatattgagccctcagagagtccacagtccctcctctcagttcagtcttgtctccagatggtcgtaggggagcgtgtggggcataaagtgctgtgaacttttc

SEQ ID NO: 410823 - DNA, 449 bp, Homo sapiens
aattgtgtttgagcacaagggtgttggcaataggggcgcccatagttaattagtaacagagagcagtagataaaacagatgcttccagcttggccggacactagtcagccttctgttctccctaaagagggccctgaaacatgagtactcaatgcacttatgtcttggctgacttttcatcccaagaagctagaccccagtgtcactcttcccttctccattcagccaatggcttgataccttgagtggatctgacaatgtaatgctcactactcccaccccagctggtatcaaacattcagaccagatgtgagctccactgggcttgataatagctcctagactcattcactcttttcttcattcaaaatgttgaatgagctgggtgcagtggttcacacctataatcccagcactttgggaggtcaaggcaggcagattgcttgagc

SEQ ID NO: 410824 - DNA, 851 bp, Homo sapiens
ctcctgcctcagcctcccgagtagctgggattacaggaaggcaccaccatgcgtggctaattttgtatttttagtagagacaaggtttctccatgttggtcaggctggtctcgaactcccaacctcaggtgatccacccgcctcggcctcccaaagtgctgggattaccagcgtgagccactgcacctggtcaagtattatggttttttaatagtatgcacacatgggacaaaactcaactggtataaaagggtatgcaggagaaaaaaagcaaacttccctctctcccttttctgtccaccagccatcctgttctcctccctaaactcaattatggttgcctgttttttatataagttttccatgaatttataaatacatcacgtgcatatatcctgtcagtcaatattaagaaattactaggttattttgtgtttatgtgtgcactattagatttaatgagttatgctagttgttgcctcttatatccacattcagtcttcattgtctgttctgtaataatagatctgggccctgtaaatacctctcccatgacagtaagcacagagtgaaactttgtcaatcgagggtgctgctgacacactgaaggggcaagggctgcttttcctggttccattgtgctcctctaggcagacacctgcaacacctgtgccatctgcaataccagctcctgtagcacatacactctgcctctgcagcacctcgttctggctgcacacttcttgggcggtgcctaacttcagcagcacccaatggtcagcagcgcacagtacccccacatgaatggcttcccttgacatgcacaaggtcccttctctgcaaagtgcccc

SEQ ID NO: 410825 - DNA, 424 bp, Homo sapiens
attacaggcatgagccactgtgccactgtgcccagccaactgttattttcagttgcctttgattttactcattaaattaatccgctaggcatgagtttagagatatagttagacatttgagaagcagcaagttgtaggataaatataaaatcattaattacttagcacattgtagctcttttgctgtgaagttctttggagcaagtactcagagtttgtggtatgagcgtcctcttacttagcagttgatgaacaactatgtgcaaaactttatacgatgattcactcaagcaagttatcaagatatttaaaggcatgttcttaacccttgaaaaaagtaatgctggctggacgtggtggctcacaactgtgatcacagcactttgggaggctgaagcggatggatcacttgaagttgggagtt

SEQ ID NO: 410826 - DNA, 235 bp, Homo sapiens
atcacccggaaacagagctggcacttatgttaaattggcatcttcataaaggaatgacagcacctgatgaactggctattcaagccttagaactttctctgatggaaagtgtgtgcaatactgcaggtgttgtcatcgatggatatcctgtaactaaacatcaaatgaatctcttggaagctaggtcaatcattcccatggtcatctttgaattgagtgtgccttccaaggagat

SEQ ID NO: 410827 - DNA, 1594 bp, Homo sapiens
tccctccccccactcccccctcccccgcccgccggggcaggggagcgccacgaattgaccaagtgaagctacaactttgcgacataaattttggggtctcgaaccatgtcgctgaccaacacaaagacggggttttcggtcaaggacatcttagacctgccggacaccaacgatgaggagggctctgtggccgaaggtccggaggaagagaacgaggggcccgagccagccaagagggccgggccgctggggcagggcgccctggacgcggtgcagagcctgcccctgaagaaccccttctacgacagcagcgacaacccgtacacgcgctggctggccagcaccgagggccttcagtactccctgcacggtctggctgccggggcgccccctcaggactcaagctccaagtccccggagccctcggccgacgagtcaccggacaatgacaaggagaccccgggcggcgggggggacgccggcaagaagcgaaagcggcgagtgcttttctccaaggcgcagacctacgagctggagcggcgctttcggcagcagcggtacctgtcggcgcccgagcgcgaacacctggccagcctcatccgcctcacgcccacgcaggtcaagatctggttccagaaccaccgctacaagatgaagcgcgcccgggccgagaaaggtatggaggtgacgcccctgccctcgccgcgccgggtggccgtgcccgtcttggtcagggacggcaaaccatgtcacgcgctcaaagcccaggacctggcagccgccaccttccaggcgggcattcccttttctgcctacagcgcgcagtcgctgcagcacatgcagtacaacgcccagtacagctcggccagcaccccccagtacccgacagcacaccccccagctctgcccatgcctctccttctgaaccttgggagagggctgaactctacgccgtgtttacagaatgtttgcgcagcttcgcttctttgcctctccccggggggaccaaaccgtcccagcgttaatgtcgtcacttgaaaacgagaaaaagaccgaccccccacccctgctttcgtgcattttgtaaaatatgtttgtgtgagtagcgatattgtcagccgtcttctaaagcaagtggagaacactttaaaaatacagagaatttcttcctttttttaaaaaaaaataagaaaatgctaaatatttatggccatgtaaacgttctgacaactggtggcagatttcgcttttcgttgtaaatatcggtggtgattgttgccaaaatgaccttcaggaccggcctgtttcccgtctgggtccaactcctttctttgtggcttgtttgggtttgttttttgttttgtttttgtttttgcgttttcccctgctttcttcctttctctttttattttattgtgcaaacatttctcaaatatggaaaagaaaaccctgtaggcagggagccctctgccctgtcctccgggccttcagccccgaacttggagctcagctattcggcgcggttccccaacagcgccgggcgcagaaagctttcgattttttaaataagaattttaataaaaatcctgtgttt

SEQ ID NO: 410828 - DNA, 1819 bp, Homo sapiens
tccctccccccactcccccctcccccgcccgccggggcaggggagcgccacgaattgaccaagtgaagctacaactttgcgacataaattttggggtctcgaaccatgtcgctgaccaacacaaagacggggttttcggtcaaggacatcttagacctgccggacaccaacgatgaggagggctctgtggccgaaggtccggaggaagagaacgaggggcccgagccagccaagagggccgggccgctggggcagggcgccctggacgcggtgcagagcctgcccctgaagaaccccttctacgacagcagcgacaacccgtacacgcgctggctggccagcaccgagggccttcagtactccctgcacggtctggctgccggggcgccccctcaggactcaagctccaagtccccggagccctcggccgacgagtcaccggacaatgacaaggagaccccgggcggcgggggggacgccggcaagaagcgaaagcggcgagtgcttttctccaaggcgcagacctacgagctggagcggcgctttcggcagcagcggtacctgtcggcgcccgagcgcgaacacctggccagcctcatccgcctcacgcccacgcaggtcaagatctggttccagaaccaccgctacaagatgaagcgcgcccgggccgagaaaggtatggaggtgacgcccctgccctcgccgcgccgggtggccgtgcccgtcttggtcagggacggcaaaccatgtcacgcgctcaaagcccaggacctggcagccgccaccttccaggcgggcattcccttttctgcctacagcgcgcagtcgctgcagcacatgcagtacaacgcccagtacagctcggccagcaccccccagtacccgacagcacaccccctggtccaggcccagcagtggacttggtgagcgccgccccaacgagactcgcggccccaggcccaggccccaccccggcggcggtggcggcgaggaggcctcggtccttatggtggttattattattattataattattattatggagtcgagttgactctcggctccactagggaggcgccgggaggttgcctgcgtctccttggagtggcagattccacccacccagctctgcccatgcctctccttctgaaccttgggagagggctgaactctacgccgtgtttacagaatgtttgcgcagcttcgcttctttgcctctccccggggggaccaaaccgtcccagcgttaatgtcgtcacttgaaaacgagaaaaagaccgaccccccacccctgctttcgtgcattttgtaaaatatgtttgtgtgagtagcgatattgtcagccgtcttctaaagcaagtggagaacactttaaaaatacagagaatttcttcctttttttaaaaaaaaataagaaaatgctaaatatttatggccatgtaaacgttctgacaactggtggcagatttcgcttttcgttgtaaatatcggtggtgattgttgccaaaatgaccttcaggaccggcctgtttcccgtctgggtccaactcctttctttgtggcttgtttgggtttgttttttgttttgtttttgtttttgcgttttcccctgctttcttcctttctctttttattttattgtgcaaacatttctcaaatatggaaaagaaaaccctgtaggcagggagccctctgccctgtcctccgggccttcagccccgaacttggagctcagctattcggcgcggttccccaacagcgccgggcgcagaaagctttcgattttttaaataagaattttaataaaaatcctgtgttt

SEQ ID NO: 410829 - DNA, 478 bp, Homo sapiens
gtctattcatttgttaaaagaacagattggaccaaattatttctaaaatccgaatctctgtcattactatgtgaccttgggtgtaataccaacttttgtgtcacttttcctcatctgttaaattgttaagtgggataatagttgttgaccttatctatccattcctttcttcctccctccctttctcccttctttacttcctagaatcaaattagataatatacatgagagcactttaaaacttaaaaatttggtgtgtaaccacaggcgtagttacagtatctaagggggtgtaggtttgccgctattgcatgcatattatgtgccaagcccattgctatgtctttatgatacattatccttcccagatttacataaggtggttgtcatacacctgctacagacaagaaacctggaatccatgggagtaaaggaacttgtttaaggtcaaaagacaaatagaagaatttagggtttg

SEQ ID NO: 410830 - DNA, 378 bp, Homo sapiens
cgatattttttcatctattcacttttctaccttttttgtggttaaaagatatggtctggttccttaaagtggaaaattcttaaccatttctggagttacttaacgcctagaaaactgctgcatgtttattggtttatatgctggaagatggcccattgcagaattaaaatggaaatgtagacagaaaggagaggacatgagtggatgagggcattgatcgcggccagcctggtttggattgccctacatctctcttgtgctggcatctctgcagcgacatctctttccagtgtatagagtcttatataggacctgttagactctgctgaggtttggtcgtgttttttcgttttattttgttttttctttgaaatagag

SEQ ID NO: 410831 - DNA, 205 bp, Homo sapiens
ggatctggtaagtattcttctatcatttgatgtccataaacatatggttcacattaaatattaaatatagagtaatagtaaatgatggttttgggttttaaagccgttagaaattagtttatggaggttataagataacttttttcccctattactgtaaacactcatttcttcatggtgatgacattgaaaatcttctcttcta

SEQ ID NO: 410832 - DNA, 247 bp, Homo sapiens
gcgtcaaatgcttaatggagcaagtggggtacttgggaaacatctcgcacccctttctgtggctgtagaactagatggtggaagttgaattaaatcccaagaatgggcttggggaatggcatcaaagctgtgttccacatgtccatctctgtgtacttgttatgttccagaggctctatttggccctggttataaccaaaccttcaaagccctaggccctctaactccatggtttcttctgaacgta

SEQ ID NO: 410833 - DNA, 789 bp, Homo sapiens
ggacaacagagcaagactctgtctcaaaaataaaaacctgcctttgtggaacttacattctagcagctatgaagagaacaagttagtgtgatagaagacagctttggtattgggaagggtacagccacttctgactgggtggtcagggccggctcctctgaggagacttggaaggtaaggaggagccaaccctgtggagagctgaggaggagcattctgagtagagggaatggcaagggcaaaggccccttgtgtttaggaaaaggaaggttgaccagtgtggccgcagaggagggagtagcagggagacagtgagtgggctggaaggggagccagggctgcgccctgtaggccaccagaaggaggagtctgtattttgtaataggagcagtaggaaacttgtggaaggttttgagcaggacagtaaagtgacctgatttgtaaaggaccttaggatccagttggcccatcttccctgtccctgtcccatcttccctccctcctgcaacacagatacatcccatcaaggcacccctgccaaatggcgaagccagtctggctgatggaggtgaggggtctccaaaggttgccctagaacagtctcagcgggctgttaggtaggcggataacttgaggggggggctgacctgagatgtagggatcctggcttacaggattcgaaccccgtatggcaccaggtcggttgattcctgtgcgtaaatgtaagttgccggtttccactgagcatgggacgatattgatctgagtcctaccctagaccgccgtgtt

SEQ ID NO: 410834 - DNA, 426 bp, Homo sapiens
tgcagtgagctgagatcacaccactgcactccagcctgggcgacagagtgagactctgtctccaacaaaacaaaacaaaaaaattcatataaaaatacaggtaaaatgtttcaagtaattagaatattctggcactggtccatgcgtgttggctcatgcctgtaatcctaatactttggggggctgaagtgggcggatcacttgagcccaggagtttgagaccagcctggacaacatggtgaaaccctgtctctgcaaaaaatgcaaaaattagccaagtgtggtggtgtatacccatagtcccagctacctgggagggagtttgaggtaggaggatcagttgagcccaggaggtcgagggcggtgagccgtaatcacaccactacactccagcttggacaacagagcaagactctgtctcaaaaa

SEQ ID NO: 410835 - DNA, 434 bp, Homo sapiens
ccatagtcccagctacctgggagggagtttgaggtaggaggatcagttgagcccaggaggtcgagggcggtgagccgtaatcacaccactacactccagcttggacaacagagcaagactctgtctcaaaaataaaaaaaagtataccagcactattgtcagcagttgggatacagtggacaaaaccagcaaaaagcctgcctttgtggaacttacattctagcagctatgaagagaacaagttagtgtgatagaagacagctttggtattgggaagggtacagccacttctgactgggtggtcagggccggctcctctgaggagacttggaaggtaaggaggagccaaccctgtggagagctgaggaggagcattctgagtagagggaatggcaagggcaaaggccccttgtgtttaggaaaaggaaggttga

SEQ ID NO: 410836 - DNA, 579 bp, Homo sapiens
catgaggcctggctaagtgtttgtatttttgatagagatggggtctcattatgttgcccaggctggtctcgaactcctgagttcaagcgatctgcccaccttggtctcccaaagtgctgggattacaggcgtgagccactgtacccggcccttcctcccttacgcgtgcttttcctctcttcccctaatttatgatggtgcaaaatcaatgggtgttcagtagaagcagtacttggagcacccatacgaccattctgtttttcactctcagtattccataaactacacaagctattcaacactttataacaaaacaggctttgtgttagatgactttgcccaactgtaggctaatgcaagtgttccgagctaagttaagctataacgttcagtaggttaggagtatgaagtacatttctgacttaataatattttcaacttatgatgagtttatggggacaaaaccccatcattaagaaacatctgtgtatgagacacataaacacactcacatatctccataatgaataaattaccccaatacctcagtgtgcatgtcagaaaaacaaggacattctc

SEQ ID NO: 410837 - DNA, 364 bp, Homo sapiens
cctgtgtgctttaggatataaaaatccacagttgatgtctcattctgagtgctacttagaggcaatctagtctaggtaattctgaacatagaattttagaataacagtgaccttacagatcatcctatctaactcttaaatgatgctggattaaatcttcacattttatataatgaagaaattcaattatttcacaataatattgtaattcttcttttgaaagtgtaaagacagggcgccatttttcccaggctggtctcgaactcctgtgctcaagccatccacctgcctagcctccctaagtgtttggactacaggcgtgagtcatggtgccgtcgacgcggccgcgaatttagtagtagta

SEQ ID NO: 410838 - DNA, 955 bp, Homo sapiens
tttttcttttaaggcaggagagacaaagaatgagctttaaagtgcatgtttacagaaatgatcaagggtttgacggtgtggtaaaagcacaggccactaacccagactccatcaggggaatggagaggccctgtactccgctctttgatgccacctgacctggaccagccctccacgctgcatgcttttaaaagcgaggcgagttgtgcatttccacttgtgcctgttctccccaccaggtccaagcctttcaattacctcctttaaaactcccttagagtccccaaggagtgcagcctccctctgctcccgacactctgtctacacccagaagcctcagggccttcaaagacctactcagtgtctgcactgtgctaaaccctggagacaacgaagtggattctctcccatttgtattctcatgacatggtcactttcaccccatgaactccgaggttattctgtgtaaatttttctcaactagactttggctcatttggggtccagggcccagtctcctgcacgggtaatagctaggggtaatcaagtcttcgctacagaaatgtaggacagcggcgttgtgacgatattcccaccacgctccgcgccgctctccagccccaagacccctcgtttccttcagggaccgccctttggtgcttccgcgacgctggaaaccggcagagattcctaccaccgtattgcctgcagcctccagtcctttttcgggtttcttgtaccctgaggccctggtgggtctgcctatcctccttcagggctcgtcccttcaaaaaaaatctgcacgcctctccccaccatcggatgacaactccagttgccatcggtgcatcctgtgtttacggaaagtggcccaagaaagccctcaaaagtataccttaaaggccatcttagggcagtgaagcagccagttttttctttgggggagggcggccgc

SEQ ID NO: 410839 - DNA, 1004 bp, Homo sapiens
tttttcttttaaggcaggagagacaaagaatgagctttaaagtgcatgtttacagaaatgatcaagggtttgacggtgtggtaaaagcacaggccactaacccagactccatcaggggaatggagaggccctgtactccgctctttgatgccacctgacctggaccagccctccacgctgcatgcttttaaaagcgaggcgagttgtgcatttccacttgtgcctgttctccccaccaggtccaagcctttcaattacctcctttaaaactcccttagagtccccaaggagtgcagcctccctctgctcccgacactctgtctacacccagaagcctcagggccttcaaagacctactcagtgtctgcactgtgctaaaccctggagacaacgaagtggattctctcccatttgtattctcatgacatggtcactttcaccccatgaactccgaggttattctgtgtaaatttttctcaactagactttggctcatttggggtccagggcccagtctcctgcacgggtaatagctaggggtaatcaagtcttcgctacagaaatgtaggacagcggcgttgtgacgatattcccaccacgctccgcgccgctctccagccccaagacccctcgtttccttcagggaccgccctttggtgcttccgcgacgctggaaaccggcagagattcctaccaccgtattgcctgcagcctccagtcctttttcgggtttcttgtaccctgaggccctggtgggtctgcctatcctccttcagggctcgtcccttcaaaaaaaatctgcacgcctctccccaccatcggatgacaactccagttgccatcggtgcatcctgtgtttacggaaagtggcccaagaaagccctcaaaagtataccttaaaggccatcttagggcagtgaagacacaccctttctggcaccagcccgcccagccggcttcgcacttagaagcagccagttttttctttgggggagggcggccgc

SEQ ID NO: 410840 - DNA, 309 bp, Homo sapiens
cttcgaaagcgtcgacatctgtgaatttataatgggcatgaacttaccaaccactggaatgattaggtcagctggccggaacactacttttaaaagtgaagtccattaataatcaaaagattactggctgaaagtgaagtgaaggcaaaaggagttggatggtctgagaggaccttttaccccatcgatagtagtttttacatagcagtaatactaaagcttaatctttggtgggttgttgttctctctggagagatacttggcctgccacaaaaggaggagctgcttctctgtccagtgctggccaga

SEQ ID NO: 410841 - DNA, 680 bp, Homo sapiens
ggccaaagtattgatgcacctactgtgaatctccacatcgagtgataaaaagcctattctaaaaggttatatgttgtataattccattgatgtaatatttatgaaatgacaaaattctagaactggattagtggcttccagtggctaaagagcagaagagagtaggacggacatggatgtggctaatgaaagagtgacatgtgggatccttgtggtggtggaaatactctatcttggctgtatcgatgtcaataatctgtatgtggtattgcactagctgttcaaagtgtcattgttgtgggaaacttggtcaagggtgaatgggatctctgtagtatttcttacaactgcttgtgaatctgtaattatctcttaataaaaagttaaatatgaatggactgacttctattagaagacaagattggaaagtgccttaaaatacaggtgataacaagtaactcttcaattgttaaaggggaagatgaaagtgaagagatgggcaaaaagataccatacaaacaaaaaacagaatggcagtgttgatatcagatcagttgagactaacagttgaaagcagtaaacatattacggacatattattgataaaagacatttatgaagaggataaactgtgaaggtgtacagacactaaaccatagttgctaaacacatacaaccaa

SEQ ID NO: 410842 - DNA, 448 bp, Homo sapiens
gctcccggccttttttttttttttttttttattgctgggtgtaggaaggtgtacatgttaacttttgggggtactaccaaattgtcctctgaaaagatgttggtccagtttatgctgatgtcagcaatatatgagaatgaacgtttattttctcacctcctccagctgggagacagagcaagaccctgtctcaaaaacatttaaaaataagtaaataaaatttttaaaaaagaatgtctatctggaatttatgattaaatgttagctctaaatttatggttttccaattggagtaccagtataccacaacactaaatggccatcttttcctcactgatttaaaatgctttagttatcatatatgtaatttttcatgtaactattgtctgggctgtctgttgatgtgtttgtctattcatttcttttattatattctattaccttattg

SEQ ID NO: 410843 - DNA, 1535 bp, Homo sapiens
aagaatgtcacaaagtttacagtcgcacatcaaaccgtgaaagacaggagaattcatactggagagaaaccataaaaatgtaagagtttgtgacaaggcttttgggcatgattcgcacctggcacaacatgctagaattcacactggagagaaaccttaccagtgtaatgagtgtggcaaagcctttagtaggcagtcaacacttgtttaccgtcaggcaatccatggtgtagggaaactttactaaggtaatgattgtcacaaagtcttcagtaatgctacaaccattgtgaatcactggagaatccataaggaagagagatcatactagggtaataaatgtggcagatttttcagacattgttcataccttgcagttcatcggtgaactcaacgctggagagaaaccttacaaatgtcatgactgtggcaaggtcttcagtcaagcttcatcctatgcaaaacataggagaattcatacaggagagaaacctcacatgtgtgatgatagtggcaaagccttcacttcacacctcatgagacatcagagaatgcatactggacagaaatcttacaaatgtcatcaatgtgccaaggtcttcagtctgagttcactccttgcagaatatgagagcattgacttgagtttgtattgacttaacattgagttcaagcattaattgacattagtgtttatgttaagaggattgggccaggcacatcagcttacacctgtaatctgagcgctttgggaggccaaggtgggtagatcacttgaggtcaggagtttgagatcagcctggccaacagacgtgagccattttcccagcctgttttttgtttctttaaaaaaactgatagggatttttatggatatcatgttgaatctaaatcacattgggttattatataatcatttcacaatattaatttttccaagctatcaatatgggttgtagctcaatgtttttaatcattttgatcaatgtttgtagatttcaaggtacaaacttctgacctttgtacgtttatttctaagtatttctttaagttctccagcaaatggaagtgttttaaaattttcttttaaaattgtttattgttaaagtatggaaattcaactaatttttggtgctgatactgtattgtgcaaatccactgactatgttacttagttccagtagtattttggttggctctttgtgattttctacacagaagattatgtcatctacaaacaaatataattttacttcttaaaaaacaacaaagaacagtcagcagacacagaaaaaagagaacaagacaggaagcgaagagacacagcaaagcaacagagcaaacgcgagacaaacaaaagaaaaggggaggtgggcgcgccccccgaccgcagaaaatacaataacacacggcgggggggcgcaagacaaagagaaagcagcgcacgcgcgccaacaaggcaagaaggagggtggtcaaccaaaagcagcgggccgccgcccaacacagggggggagacgtcaagcacagaaacg

SEQ ID NO: 410844 - DNA, 755 bp, Homo sapiens
aatctaaatcatatgtgaaatgattatataataacccaatgtgatttagattcaacatgatatccataaaaatccctatcaggatttttatggatatcatgttgaatctaaatcacattgggttattatataatcatttcacaatattaatttttccaagctatcaatatgggttgtagctcaatgtttttaatcattttgatcaatgtttgtagatttcaaggtacaaacttctgacctttgtacgtttatttctaagtatttctttaagttctccagcaaatggaagtgttttaaaattttcttttaaaattgtttattgttaaagtatggaaattcaactaatttttggtgctgatactgtattgtgcaaatccactgactatgttacttagttccagtagtattttggttggctctttgtgattttctacacagaagattatgtcatctacaaacaaatataattttacttcttaaaaaacaacaaagaacagtcagcagacacagaaaaaagagaacaagacaggaagcgaagagacacagcaaagcaacagagcaaacgcgagacaaacaaaagaaaaggggaggtgggcgcgccccccgaccgcagaaaatacaataacacacggcgggggggcgcaagacaaagagaaagcagcgcacgcgcgccaacaaggcaagaaggagggtggtcaaccaaaagcagcgggccgccgcccaacacagggggggagacgtcaagcacagaaacg

SEQ ID NO: 410845 - DNA, 191 bp, Homo sapiens
cttcagtctgagttcactccttgcagaatatgagagaattcattttggaggtagttggtccatatgcaatgagtagagcaaaccatcaagcattaattgacattagggtcaattcagcattgacttgagtttgtattgacttaacattgagttcaagcattaattgacattagtgtttatgttaagaggat

SEQ ID NO: 410846 - DNA, 470 bp, Homo sapiens
gaagtattggcatgaataatcaaaaaacaaaaaacatgctttgtaataccttaaattatccacatgtatcatctggataatcatttaacccttttccatactgcccagctttattccaggaaccacctccagctattaaaaaaggtttcagaaattcagagttatttttattcaggcaaagaagtaccaagtattgtgactagttagataaggggtggggggaagacagtagatggtggatcattaggcatattataagaataaaactagttttatagtgcctcatttttacttacccattcacatattttgcttacatttcgtagcatcatttaataatttacaaagaaagttgtattacattgtttagattttgtacatacaggttagctaggtttttagtaaagtgaccttgtgaatgttttagaagggcaagggaaattatgacccctggttaggaaaaaaaaaaa

SEQ ID NO: 410847 - DNA, 2004 bp, Homo sapiens
aacttacggctaggtacgaggctcccgtgttaaacaggaagtcaccacgggtgactggatgtgatgcacaggccttcggaaaggaaatgcagctgagatccagaggacgtggaaggctccccctcactaaagctagagcaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatcccagaccctcaggtgaactggattccgtgtcaagacccccacagatttggtcacacaccagtacaagcaagactcagctgcctggccaaggacaactctatctatgtcttggcaaatttgggggacaaaaagccatgtaattcccgtgactccacatgtcctcctaatggctactttcaatacaataccaatgtggtgtataatacagaaggaaaactcgtggcacgttaccataagtaccacctgtactctgagcctcagtttaatgtccctgaaaagccggagttggtgactttcaacaccgcatttggaaggtttggcattttcacgtgctttgatatattcttctatgatcctggtgttaccctggtgaaagatttccatgtggacaccatactgtttcccacagcttggatgaacgttttgccccttttgacagctattgaattccattcagcttgggcaatgggaatgggagttaatcttcttgtggccaacacacatcatgtcagcctaaatatgacaggaagtggtatttatgcaccaaatggtcccaaagtgtatcattatgacatgaagacagagttgggaaaacttctcctttcagaggtggattcacatcccctatcctcgcttgcctacccaacagctgttaattggaatgcctacgccaccaccatcaaaccatttccagtacagaaaaacactttcaggggatttatttccagggatgggttcaacttcacagaactttttgaaaatgcaggaaaccttacagtctgtcaaaaggagctttgctgtcatttaagctacagaatgttacaaaaagaagagaatgaagtatacgttctaggagcttttacaggattacatggccgaaggagaagagagtactggcaggtctgcacaatgctgaagtgcaaaactactaatttgacaacttgtggacggccagtagaaactgcttctacaagatttgaaatgttctccctcagtggcacatttggaacagagtatgtttttcctgaagtgctacttaccgaaattcatctgtcacctggaaaatttgaggtgctgaaagatgggcgtttggtaaacaagaatggatcatctgggcctatactaacagtgtcactctttgggaggtggtacacaaaggactcactttacagctcatgtgggaccagcaattcagcaataacttacctgctaatattcatattattaatgatcatagctttgcaaaatattgtaatgttatagggcgtctctttatcactcagcttctgcatcatatgcttggctgaatgtgtttatcggcttcccaagtttactaagaaactttgaagggctatttcagtagtatagaccagtgagtcctaaatattttttctcatcaataattattttttaagtattatgataatgttgtccatttttttggctactctgaaatgttgcagtgtggaacaatggaaagagcctgggtgtttgggtcagataaatgaagatcaaactccagctccagcctcatttgcttgagactttgtgtgtatgggggacttgtatgtatgggagtgaggagtttcagggccattgcaaacatagctgtgcccttgaagagaatagtaatgatgggaatttagaggtttatgactgaattccctttgacattaaagactatttgaattca

SEQ ID NO: 410848 - DNA, 2147 bp, Homo sapiens
tgtgggggtcactgctggcattagtaagagtttgggtgatagagatacaagttggagtgctctgaaagggaatgggagaggaggaactggcaacagcaagagggactgatcttttgaggagttttgctttaagagagagatgaggattaaagcaatatttggaagggcatgtttggaaaggtcaaaagaggttttaattttattttttaaagatgggaggtactagaggatatttcattgctgatgggatgtttcagtagagaggagacccttgatgaggcaggagaccgaataatgaatttctggagcaatagataccgtgtgggaagcattcatcaagtgtataatcatctgtggcttttaaagtatgatatttttaggcatagtttttgtattaacttaagttccacttaagtggttacagttgctatcgtttccatataaagtgactaaaatatttttttaaaattgaaatttcttaattataatttggtttagatttggtcacacaccagtacaagcaagactcagctgcctggccaaggacaactctatctatgtcttggcaaatttgggggacaaaaagccatgtaattcccgtgactccacatgtcctcctaatggctactttcaatacaataccaatgtggtgtataatacagaaggaaaactcgtggcacgttaccataagtaccacctgtactctgagcctcagtttaatgtccctgaaaagccggagttggtgactttcaacaccgcatttggaaggtttggcattttcacgtgctttgatatattcttctatgatcctggtgttaccctggtgaaagatttccatgtggacaccatactgtttcccacagcttggatgaacgttttgccccttttgacagctattgaattccattcagcttgggcaatgggaatgggagttaatcttcttgtggccaacacacatcatgtcagcctaaatatgacaggaagtggtatttatgcaccaaatggtcccaaagtgtatcattatgacatgaagacagagttgggaaaacttctcctttcagaggtggattcacatcccctatcctcgcttgcctacccaacagctgttaattggaatgcctacgccaccaccatcaaaccatttccagtacagaaaaacactttcaggggatttatttccagggatgggttcaacttcacagaactttttgaaaatgcaggaaaccttacagtctgtcaaaaggagctttgctgtcatttaagctacagaatgttacaaaaagaagagaatgaagtatacgttctaggagcttttacaggattacatggccgaaggagaagagagtactggcaggtctgcacaatgctgaagtgcaaaactactaatttgacaacttgtggacggccagtagaaactgcttctacaagatttgaaatgttctccctcagtggcacatttggaacagagtatgtttttcctgaagtgctacttaccgaaattcatctgtcacctggaaaatttgaggtgctgaaagatgggcgtttggtaaacaagaatggatcatctgggcctatactaacagtgtcactctttgggaggtggtacacaaaggactcactttacagctcatgtgggaccagcaattcagcaataacttacctgctaatattcatattattaatgatcatagctttgcaaaatattgtaatgttatagggcgtctctttatcactcagcttctgcatcatatgcttggctgaatgtgtttatcggcttcccaagtttactaagaaactttgaagggctatttcagtagtatagaccagtgagtcctaaatattttttctcatcaataattattttttaagtattatgataatgttgtccatttttttggctactctgaaatgttgcagtgtggaacaatggaaagagcctgggtgtttgggtcagataaatgaagatcaaactccagctccagcctcatttgcttgagactttgtgtgtatgggggacttgtatgtatgggagtgaggagtttcagggccattgcaaacatagctgtgcccttgaagagaatagtaatgatgggaatttagaggtttatgactgaattccctttgacattaaagactatttgaattca

SEQ ID NO: 410849 - DNA, 1973 bp, Homo sapiens
tttttttttttaggcagagtctggctctgtcatcccggctggagtgcaatggcacgatctcagctcactgcaacctctgactcccaggttcaacccattctcctgcctcagctactcgcttgaactcaggaggtggagattgcagtgagccgaaatcatgccactgcactccagcctgggtgatagagcgaggctccgtctcagaaaaataaaattaaattaaatttaaaaaaagcttacggactttggggtttatgggggggtatttggcttttaactgagagagagggaaagagagagaagggagagagaggagatgagagatgctatggacgtatgttacatattcctccacattttccttagaaatttacttccaattgccagatttatccgcttcctaggagattccctgcagttgaccatagccaaatctgttaccaacttagagggtttttatgagtcatttcttcaacaaataaggttttactggttttctcctatccatttgttgtagtaccacctgtactctgagcctcagtttaatgtccctgaaaagccggagttggtgactttcaacaccgcatttggaaggtttggcattttcacgtgctttgatatattcttctatgatcctggtgttaccctggtgaaagatttccatgtggacaccatactgtttcccacagcttggatgaacgttttgccccttttgacagctattgaattccattcagcttgggcaatgggaatgggagttaatcttcttgtggccaacacacatcatgtcagcctaaatatgacaggaagtggtatttatgcaccaaatggtcccaaagtgtatcattatgacatgaagacagagttgggaaaacttctcctttcagaggtggattcacatcccctatcctcgcttgcctacccaacagctgttaattggaatgcctacgccaccaccatcaaaccatttccagtacagaaaaacactttcaggggatttatttccagggatgggttcaacttcacagaactttttgaaaatgcaggaaaccttacagtctgtcaaaaggagctttgctgtcatttaagctacagaatgttacaaaaagaagagaatgaagtatacgttctaggagcttttacaggattacatggccgaaggagaagagagtactggcaggtctgcacaatgctgaagtgcaaaactactaatttgacaacttgtggacggccagtagaaactgcttctacaagatttgaaatgttctccctcagtggcacatttggaacagagtatgtttttcctgaagtgctacttaccgaaattcatctgtcacctggaaaatttgaggtgctgaaagatgggcgtttggtaaacaagaatggatcatctgggcctatactaacagtgtcactctttgggaggtggtacacaaaggactcactttacagctcatgtgggaccagcaattcagcaataacttacctgctaatattcatattattaatgatcatagctttgcaaaatattgtaatgttatagggcgtctctttatcactcagcttctgcatcatatgcttggctgaatgtgtttatcggcttcccaagtttactaagaaactttgaagggctatttcagtagtatagaccagtgagtcctaaatattttttctcatcaataattattttttaagtattatgataatgttgtccatttttttggctactctgaaatgttgcagtgtggaacaatggaaagagcctgggtgtttgggtcagataaatgaagatcaaactccagctccagcctcatttgcttgagactttgtgtgtatgggggacttgtatgtatgggagtgaggagtttcagggccattgcaaacatagctgtgcccttgaagagaatagtaatgatgggaatttagaggtttatgactgaattccctttgacattaaagactatttgaattca

SEQ ID NO: 410850 - DNA, 1349 bp, Homo sapiens
tttttttttttaggcagagtctggctctgtcatcccggctggagtgcaatggcacgatctcagctcactgcaacctctgactcccaggttcaacccattctcctgcctcagctactcgcttgaactcaggaggtggagattgcagtgagccgaaatcatgccactgcactccagcctgggtgatagagcgaggctccgtctcagaaaaataaaattaaattaaatttaaaaaaagcttacggactttggggtttatgggggggtatttggcttttaactgagagagagggaaagagagagaagggagagagaggagatgagagatgctatggacgtatgttacatattcctccacattttccttagaaatttacttccaattgccagatttatccgcttcctaggagattccctgcagttgaccatagccaaatctgttaccaacttagagggtttttatgagtcatttcttcaacaaataaggttttactggttttctcctatccatttgttgtagtaccacctgtactctgagcctcagtttaatgtccctgaaaagccggagttggtgactttcaacaccgcatttggaaggtttggcattttcacgtgctttgatatattcttctatgatcctggtgttaccctggtgaaagatttccatgtggacaccatactgtttcccacagcttggatgaacgttttgccccttttgacagctattgaattccattcagcttgggcaatgggaatgggagttaatcttcttgtggccaacacacatcatgtcagcctaaatatgacaggtaattcatgaccaggttaggtttcatcttatatttttaagtgcagagaaatgaatgcctcagttatgacttgtattaattttttgcttattggaaattcttactgtgtttgtcatagtttcacaatagaaaaaaaaagctagcacttgattataagctatggttatactaagacctttatgtgtattattcatttaattattacaataattatatgagatagatagtgtcatcccaattttgcagatgagaaaattgacatacagagagtgcaagtaatttgccaaatgctacccagctactactttcctcagtggccatggaagcctctatatcttgccctttgtctcctcctatggctgcatggcatatcctcgtgacatggctgctgtcttcctctagagcaattaatgagaggggacaagagagaaaaggaaagaagccacattgctatttatgactagttacccaccatcacttctgccatgttctattcattggaagtgagtcactaagtccagcccctcttcaaggggaaaggaa

SEQ ID NO: 410851 - DNA, 341 bp, Homo sapiens
aaacattctcccctctgtaaatactacatgaatgttatttttgctttcagaaatcactaaaccttggccatggtcacttcctcttttccaatctctgtggcagtttttgccctaataaccctgcaggttggtactcaggacagttttatagctgcagtgtatgaacatgctgtcattttgccaaataaaacagaaacaccagtttctcaggaggatgccttgaatctcatgaacgagaatatagacattctggagacagcgatcaagcaggcagctgagcaggtattctcttatttctgttaatcataatgtacacgaggggcatgggagctggtggaaga

SEQ ID NO: 410852 - DNA, 2014 bp, Homo sapiens
agaaatcactaaaccttggccatggtcacttcctcttttccaatctctgtggcagtttttgccctaataaccctgcaggttggtactcaggacagttttatagctgcagtgtatgaacatgctgtcattttgccaaataaaacagaaacaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatcccagaccctcaggtgaactggattccgtgtcaagacccccacagatttggtcacacaccagtacaagcaagactcagctgcctggccaaggacaactctatctatgtcttggcaaatttgggggacaaaaagccatgtaattcccgtgactccacatgtcctcctaatggctactttcaatacaataccaatgtggtgtataatacagaaggaaaactcgtggcacgttaccataagtaccacctgtactctgagcctcagtttaatgtccctgaaaagccggagttggtgactttcaacaccgcatttggaaggtttggcattttcacgtgctttgatatattcttctatgatcctggtgttaccctggtgaaagatttccatgtggacaccatactgtttcccacagcttggatgaacgttttgccccttttgacagctattgaattccattcagcttgggcaatgggaatgggagttaatcttcttgtggccaacacacatcatgtcagcctaaatatgacaggaagtggtatttatgcaccaaatggtcccaaagtgtatcattatgacatgaagacagagttgggaaaacttctcctttcagaggtggattcacatcccctatcctcgcttgcctacccaacagctgttaattggaatgcctacgccaccaccatcaaaccatttccagtacagaaaaacactttcaggggatttatttccagggatgggttcaacttcacagaactttttgaaaatgcaggaaaccttacagtctgtcaaaaggagctttgctgtcatttaagctacagaatgttacaaaaagaagagaatgaagtatacgttctaggagcttttacaggattacatggccgaaggagaagagagtactggcaggtctgcacaatgctgaagtgcaaaactactaatttgacaacttgtggacggccagtagaaactgcttctacaagatttgaaatgttctccctcagtggcacatttggaacagagtatgtttttcctgaagtgctacttaccgaaattcatctgtcacctggaaaatttgaggtgctgaaagatgggcgtttggtaaacaagaatggatcatctgggcctatactaacagtgtcactctttgggaggtggtacacaaaggactcactttacagctcatgtgggaccagcaattcagcaataacttacctgctaatattcatattattaatgatcatagctttgcaaaatattgtaatgttatagggcgtctctttatcactcagcttctgcatcatatgcttggctgaatgtgtttatcggcttcccaagtttactaagaaactttgaagggctatttcagtagtatagaccagtgagtcctaaatattttttctcatcaataattattttttaagtattatgataatgttgtccatttttttggctactctgaaatgttgcagtgtggaacaatggaaagagcctgggtgtttgggtcagataaatgaagatcaaactccagctccagcctcatttgcttgagactttgtgtgtatgggggacttgtatgtatgggagtgaggagtttcagggccattgcaaacatagctgtgcccttgaagagaatagtaatgatgggaatttagaggtttatgactgaattccctttgacattaaagactatttgaattca

SEQ ID NO: 410853 - DNA, 1390 bp, Homo sapiens
agaaatcactaaaccttggccatggtcacttcctcttttccaatctctgtggcagtttttgccctaataaccctgcaggttggtactcaggacagttttatagctgcagtgtatgaacatgctgtcattttgccaaataaaacagaaacaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatcccagaccctcaggtgaactggattccgtgtcaagacccccacagatttggtcacacaccagtacaagcaagactcagctgcctggccaaggacaactctatctatgtcttggcaaatttgggggacaaaaagccatgtaattcccgtgactccacatgtcctcctaatggctactttcaatacaataccaatgtggtgtataatacagaaggaaaactcgtggcacgttaccataagtaccacctgtactctgagcctcagtttaatgtccctgaaaagccggagttggtgactttcaacaccgcatttggaaggtttggcattttcacgtgctttgatatattcttctatgatcctggtgttaccctggtgaaagatttccatgtggacaccatactgtttcccacagcttggatgaacgttttgccccttttgacagctattgaattccattcagcttgggcaatgggaatgggagttaatcttcttgtggccaacacacatcatgtcagcctaaatatgacaggtaattcatgaccaggttaggtttcatcttatatttttaagtgcagagaaatgaatgcctcagttatgacttgtattaattttttgcttattggaaattcttactgtgtttgtcatagtttcacaatagaaaaaaaaagctagcacttgattataagctatggttatactaagacctttatgtgtattattcatttaattattacaataattatatgagatagatagtgtcatcccaattttgcagatgagaaaattgacatacagagagtgcaagtaatttgccaaatgctacccagctactactttcctcagtggccatggaagcctctatatcttgccctttgtctcctcctatggctgcatggcatatcctcgtgacatggctgctgtcttcctctagagcaattaatgagaggggacaagagagaaaaggaaagaagccacattgctatttatgactagttacccaccatcacttctgccatgttctattcattggaagtgagtcactaagtccagcccctcttcaaggggaaaggaa

SEQ ID NO: 410854 - DNA, 434 bp, Homo sapiens
aaagtaattaaatttttatttaggctcatgacaagcattgtttttataaaacccagaagaaaatgtagttgttctagaaaattatatggtttgtagaaaaaagggaaactagagactgacttttacctaggcactgttttcatagttcattttagtttaggaaaattatgattattggggatagaaaagagattcatatgtgctaggagttatataaggttatatttataagaatttttcaaacactttttggtaatattgatattgatataaatataaccttacaatattatgtactttttctataatctcatccttttttcataaattttatcattttttctcattgcttttgtgatttgtttggattatatttatttgcaattatttataacgttttaaggctttttcatgcatgtatatcatatcaccaa

SEQ ID NO: 410855 - DNA, 2540 bp, Homo sapiens
tcggcagatgccgcctggtccagctatcgtgctcggtattcagttttccggagcagcgctctttctctggcccgcggagcggtcccgcggccgagtaccggattcccgagtttgggaggctctgctttcctccttaggacccactttgccgtcctggggtggctgcagttatgtccgcgctgcgacctctcctgcttctgctgctgcctctgtgtcccggtcctggtcccggacccgggagcgaggcaaaggtcacccggagttgtgcagagacccggcaggtgctgggggcccggggatatagcttaaacctaatccctcccgccctgatctcaggtgagcacctccgggtctgtccccaggagtacacctgctgttccagtgagacagagcagaggctgatcagggagactgaggccaccttccgaggcctggtggaggacagcggctcctttctggttcacacactggctgccaggcacagaaaatttgatgagttttttctggagatgctctcagtagcccagcactctctgacccagctcttctcccactcctacggccgcctgtatgcccagcacgccctcatattcaatggcctgttctctcggctgcgagacttctatggggaatctggtgaggggttggatgacaccctggcggatttctgggcacagctcctggagagagtgttcccgctgctgcacccacagtacagcttcccccctgactacctgctctgcctctcacgcttggcctcatctaccgatggctctctgcagccctttggggactcaccccgccgcctccgcctgcagataacccggaccctggtggctgcccgagcctttgtgcagggcctggagactggaagaaatgtggtcagcgaagcgcttaaggtgccggtgtctgaaggctgcagccaggctctgatgcgtctcatcggctgtcccctgtgccggggggtcccctcacttatgccctgccagggcttctgcctcaacgtggttcgtggctgtctcagcagcaggggactggagcctgactggggcaactatctggatggtctcctgatcctggctgataagctccagggccccttttcctttgagctgacggccgagtccattggggtgaagatctcggagggtttgatgtacctgcaggaaaacagtgcgaaggtgtccgcccaggtgtttcaggagtgcggcccccccgacccggtgcctgcccgcaaccgtcgagccccgccgccccgggaagaggcgggccggctgtggtcgatggtgaccgaggaggagcggcccacgacggccgcaggcaccaacctgcaccggctggtgtgggagctccgcgagcgtctggcccggatgcggggcttctgggcccggctgtccctgacggtgtgcggagactctcgcatggcagcggacgcctcgctggaggcggcgccctgctggaccggagccgggcggggccggtacttgccgccagtggtcgggggctccccggccgagcaggtcaacaaccccgagctcaaggtggacgcctcgggccccgatgtcccgacacggcggcgtcggctacagctccgggcggccacggccagaatgaaaacggccgcactgggacacgacctggacgggcaggacgcggatgaggatgccagcggctctggagggggacagcagtatgcagatgactggatggctggggctgtggctccccccagcccggcctcctcggcctccataccctcctagaagggatggttctgggggcaaaggaggaggtggcagtgcccgctacaaccagggccggagcaggagtgggggggcatctattggttttcacacccaaaccatcctcattctctccctctcagccctggccctgcttggacctcgataacgggggaggggtgccctagcatcagaagggttcatggccctttcccctcctcccccctcagctgggcctggggaggagtcgaagggggctgcagagagggtagagaagggactttgcaggtgaatggctggggccccaaatccaggagattttcatcagaggtgggtgggtgttcacaatatttattttttcatttggtaatgggaggggggcctgggggtatttatttaggagggagtgtggtttccttagaaggtatagtctctagccctctaaggctggggctggtgatcagccccaacagagaaaatgaggagtttagagttgcagctggggaaggggtttgaaggaagttggaagtggggaggggtgggggcatctggtctcagaaatggaccagctggatgcagggcaggggactgagggtgcttgagtaggatgtgagacttcatgggcctgggttctgttgagttttttcagtatcaatttcttaaaccaaattttaaaaaaaacaaggtgggggggtgctcatctcgtgacctctgccacccacatccttcacaaactccatgtttcagtgtttgagtccatgtttattctgcaaataaatggtaatgtattggacccca

SEQ ID NO: 410856 - DNA, 1450 bp, Homo sapiens
tcggcagatgccgcctggtccagctatcgtgctcggtattcagttttccggagcagcgctctttctctggcccgcggagcggtcccgcggccgagtaccggattcccgagtttgggaggctctgctttcctccttaggacccactttgccgtcctggggtggctgcagttatgtccgcgctgcgacctctcctgcttctgctgctgcctctgtgtcccggtcctggtcccggacccgggagcgaggcaaaggtcacccggagttgtgcagagacccggcaggtgctgggggcccggggatatagcttaaacctaatccctcccgccctgatctcaggtgagcacctccgggtctgtccccaggagtacacctgctgttccagtgagacagagcagaggctgatcagggagactgaggccaccttccgaggcctggtggaggacagcggctcctttctggttcacacactggctgccaggcacagaaaatttgatgagttttttctggagatgctctcagtagcccagcactctctgacccagctcttctcccactcctacggccgcctgtatgcccagcacgccctcatattcaatggcctgttctctcggctgcgagacttctatggggaatctggtgaggggttggatgacaccctggcggatttctgggcacagctcctggagagagtgttcccgctgctgcacccacagtacagcttcccccctgactacctgctctgcctctcacgcttggcctcatctaccgatggctctctgcagccctttggggactcaccccgccgcctccgcctgcagataacccggaccctggtggctgcccgagcctttgtgcagggcctggagactggaagaaatgtggtcagcgaagcgcttaaggtgccggtgtctgaaggctgcagccaggctctgatgcgtctcatcggctgtcccctgtgccggggggtcccctcacttatgccctgccagggcttctgcctcaacgtggttcgtggctgtctcagcagcaggggactggagcctgactggggcaactatctgggtgaggggattcaagaaagcctggagccaggcatggtggctcacacctgtaatcacagcactttgagaggctgaggcaggaggatcacttgaggccaggagttggagcccagctggggcaacatagctagacgtcatctcaagaaagaaagagagagagagaaagaaagagagagagagagacagagaaagaaagaaggaaagaaggaaggaaagaaagaaaaagaaagaaagaaagaaagaaaagaaagaaatcagccaggcatggtagcgcccgcgcctgtagtcccagttactcctgaggctgaggcaggaggatcacttgaggccaggagttggaggccagcctgggcaacgtagctagaccgcatctctaccaaaaaaaaaaa

SEQ ID NO: 410857 - DNA, 2217 bp, Homo sapiens
tcggcagatgccgcctggtccagctatcgtgctcggtattcagttttccggagcagcgctctttctctggcccgcggagcggtcccgcggccgagtaccggattcccgagtttgggaggctctgctttcctccttaggacccactttgccgtcctggggtggctgcagttatgtccgcgctgcgacctctcctgcttctgctgctgcctctgtgtcccggtcctggtcccggacccgggagcgaggcaaaggtcacccggagttgtgcagagacccggcaggtgctgggggcccggggatatagcttaaacctaatccctcccgccctgatctcaggtgagcacctccgggtctgtccccaggagtacacctgctgttccagtgagacagagcagaggctgatcagggagactgaggccaccttccgaggcctggtggaggacagcggctcctttctggttcacacactggctgccaggcacagaaaatttgatgataacccggaccctggtggctgcccgagcctttgtgcagggcctggagactggaagaaatgtggtcagcgaagcgcttaaggtgccggtgtctgaaggctgcagccaggctctgatgcgtctcatcggctgtcccctgtgccggggggtcccctcacttatgccctgccagggcttctgcctcaacgtggttcgtggctgtctcagcagcaggggactggagcctgactggggcaactatctggatggtctcctgatcctggctgataagctccagggccccttttcctttgagctgacggccgagtccattggggtgaagatctcggagggtttgatgtacctgcaggaaaacagtgcgaaggtgtccgcccaggtgtttcaggagtgcggcccccccgacccggtgcctgcccgcaaccgtcgagccccgccgccccgggaagaggcgggccggctgtggtcgatggtgaccgaggaggagcggcccacgacggccgcaggcaccaacctgcaccggctggtgtgggagctccgcgagcgtctggcccggatgcggggcttctgggcccggctgtccctgacggtgtgcggagactctcgcatggcagcggacgcctcgctggaggcggcgccctgctggaccggagccgggcggggccggtacttgccgccagtggtcgggggctccccggccgagcaggtcaacaaccccgagctcaaggtggacgcctcgggccccgatgtcccgacacggcggcgtcggctacagctccgggcggccacggccagaatgaaaacggccgcactgggacacgacctggacgggcaggacgcggatgaggatgccagcggctctggagggggacagcagtatgcagatgactggatggctggggctgtggctccccccagcccggcctcctcggcctccataccctcctagaagggatggttctgggggcaaaggaggaggtggcagtgcccgctacaaccagggccggagcaggagtgggggggcatctattggttttcacacccaaaccatcctcattctctccctctcagccctggccctgcttggacctcgataacgggggaggggtgccctagcatcagaagggttcatggccctttcccctcctcccccctcagctgggcctggggaggagtcgaagggggctgcagagagggtagagaagggactttgcaggtgaatggctggggccccaaatccaggagattttcatcagaggtgggtgggtgttcacaatatttattttttcatttggtaatgggaggggggcctgggggtatttatttaggagggagtgtggtttccttagaaggtatagtctctagccctctaaggctggggctggtgatcagccccaacagagaaaatgaggagtttagagttgcagctggggaaggggtttgaaggaagttggaagtggggaggggtgggggcatctggtctcagaaatggaccagctggatgcagggcaggggactgagggtgcttgagtaggatgtgagacttcatgggcctgggttctgttgagttttttcagtatcaatttcttaaaccaaattttaaaaaaaacaaggtgggggggtgctcatctcgtgacctctgccacccacatccttcacaaactccatgtttcagtgtttgagtccatgtttattctgcaaataaatggtaatgtattggacccca

SEQ ID NO: 410858 - DNA, 448 bp, Homo sapiens
aagccaggctgagagcagccacagcgtttgtggaggacacagccccactctctgcccccaggtgccggtgtctgaaggctgcagccaggctctgatgcgtctcatcggctgtcccctgtgccggggggtcccctcacttatgccctgccagggcttctgcctcaacgtggttcgtggctgtctcagcagcaggggactggagcctgactggggcaactatctgggtgaggggattcaagaaagcctggagccaggcatggtggctcacacctgtaatcacagcactttgagaggctgaggcaggaggatcacttgaggccaggagttggagcccagctggggcaacatagctagacgtcatctcaagaaagaaagagagagagagaaagaaagagagagagagagacagagaaagaaagaaggaaagaaggaaggaaagaaagaaaaa

SEQ ID NO: 410859 - DNA, 663 bp, Homo sapiens
tttcatactcttcatctacaaaatgggaatagtatcacttatcctttcaggtttattgtgcaggtgagatacaaaacatctagctcaatgcctaatatagattaagcacacaataattggtagtttcttttaatagtaataaagtacatgtctttgaatatcattcttttttctctgctgcctaccaacaagtccaaaatcttggtatttagtactctctacaccctaacccaaaacattttctaaaatttgtctctagctatgacctgtcacataacatgccctccaccaatgtgggtcacttcattttctacttgtacatctatgattcttctcctccaggcttttgttcaaagtccttttcatctctagttactctgctcatgtttgaaagtcaaattcaagtgccactttctccagaaaactgcttagtaatttctcctttatcttctattttgttagtattaacatttattctgcttttaattgtagccagtttgtgtattgggttttttatatagtggctttctccctagattataaattccttaagagcacagcttgcctctcatttacctttcaaacccctgagagactgaaaatgtgctttgtacccaatgagcatgcaataaatgttccatgaataaacacaagaaaaaaaaa

SEQ ID NO: 410860 - DNA, 280 bp, Homo sapiens
agccactttcatgactttgtctcaaaaaaaaaaaaaaagtctcaatcattaaaacagtgtgatattaagatattaacagacagacccaaggaagaaaatagaaagtcccaaaataaatagagctatgtggagaattttaacttaaggaaaacgtgacatttcaacacaacaggaaaatgatagattattcaacaaatagtgcactgagtaggcatctgaggaaaaaaatgagattcacacttcatatacaaattgcaaatggatgaaatgtaaaaggaat

SEQ ID NO: 410861 - DNA, 914 bp, Homo sapiens
cagtggatacaaaggcatcattggcaccatagttaaaaaagatgaggtggcctaccagcatgaagactgacatggcatagatggtgtcagtgctgacagactctgtcagggtcttagcactggtgaaaagccataagtgaaagtaatgaagactagggcactcttcaggtcagcccaccgggtccacccactcttctgcccttcacctccatcagtgagatcaaacaaaacatacccaatcagtgaagaagccaggccagtcccaaaaagccattggggggccagaagaccctcatccatataccaccagataaccagaaaaacaaaaacactgcacagctgcgggatcaccacactggactcaaataccatagcccaatattggtatttccgagcatggatgtttttccagagctcttccaggaaccgccggtccacaaagttatcaggaaagggctgttgctcatacaagaccctctgccactttacctccttggtgtttgttacaggttgggtacacataatcctttcattcaaactcaggctagtttaatcatccctctcacagaggtccatgtggttcttgttgatgacattttgaaatgagacctccctggaaattccatgccttggttcactgcaacctctgcctcccaggttcacgccattctcctgcctcagcctcccaagtagctgggactacaggcgcctgccaccatgcctggctaatttttttgtatttttagtagagacggggtttcaccgtgttagccaggatggtctcgatctcctgacctcgtgatccacccgccttggcctcccaaagtgctgggattgtaggcgtgagccactgcgcccagaccagaactattttcaatttaaacttcctgaagtcttggtactcatggatttaa

SEQ ID NO: 410862 - DNA, 464 bp, Homo sapiens
cagtggatacaaaggcatcattggcaccatagttaaaaaagatgaggtggcctaccagcatgaagactgacatggcatagatggtgtcagtgctgacagactctgtcagggtcttagcactggtgaaaagccataagtgaaagtaatgaagactagggcactcttcaggtcagcccaccgggtccacccactcttctgcccttcacctccatcagtgagatcaaacaaaacatacccaatcagtgaagaagccaggccagtcccaaaaagccattggggggccagaagaccctcatccatataccaccagataaccagaaaaacaaaaacactgcacagctgcgggatcaccacactggactcaaatactatttcttattgaggtttaacctctatttccctagccctgtccttccactaagcttggtagatgtaataataaagtgaaaatattaacatttgaa

SEQ ID NO: 410863 - DNA, 1372 bp, Homo sapiens
gtcttaattgctgttctagttcagtcaagtattaaaaattcacactttgaaacagaaagtccttgccctctgtatctttccagaccctccttgtctgaaagtcttctctcatcctctgccctatgttgcaggaaagtgaccctgggaatttcccagtctaccttgtcagctgacttctgcatgggttcagccagtgggaggggaagcactggcaagattttggtggccaggaaaaagggaagccccagtgttggccaggcgtggtggctcatgcatgtaatcccagcactttgggagtccaaggcaggtggatcacctgaggtcaggagttcgagaccagcctggctaacatggtgaaaccccatctctactaaaaatacaaaaattagccaggcgtggtggcaggtacctgtaatcccagctactggggaagctgaggcaggagactcgctggaacccaggaggcggaggttgcagtgagctgagatctcaccactgcactccagcctgggtgatggagcaagactccatctccaaaagaaaaaaaaaagagaggccccagttcaggctagctctgtctgtcttgtggggcatctctgatggtgacggcagctcttgtctggctccagttcccaccagacaagcctgctgtgattccagtatctgctggtgtccctagcctctgggctccatgataccgctgtttccttttgttcctccagcctaggggagtggtgatctttagtttgccttgcctttttgtctcatggttggcttctcagcccttccatcacttttattactaactcctgttaaattctctcttgtttaaatacttagaatggtttctgtttttctagtaagaccttggatgatatactctgtaaaaaataaatgaataagagaagaaaaataattagacacaacaaagaaagagaggaaagaaagggagaagaaaaggggcaaaatgataaatataaataagttaaatataaggttgggtgcggtggctcacacctgtaatcccagcactttggatcacgaggtcaggagtttgagaccagcctggccaagatagtgaaaccccatttctactaaaaatacaaaaaaaaaaaaaaaattagctgggcatgttggcgcacatctgtagtcccagctactcaagaggctgaggcaggagaattgcttgaactctggaggcgaaggttgcagtgagccaagaccacaccattggactccactctgggcaacagaggtagactccatctcaaaaacaaaaaaaaagataagtatagaaagaggaacacagagccaggcacagtggctcacacctgtaatcccagcactttgggaggccgaggtgggcaaatca

SEQ ID NO: 410864 - DNA, 542 bp, Homo sapiens
actgggctctgtaaacctgagcctcattcttagaacctcttgagccccttgatgttgcccagtcaagtccatagtgactgtaggggctgaacttcaagggccacttttgcttatagccatcacctgagagcacctccagaatcaaaatggccttgggaagtacttgccccagagagagttttaaaaattattctgtcaatctgactcaattccttgtagatagttcatttccaggcatgtattttcttggagtttgttaaaaacaatggaaaaatcttatcttaaaagtacctcttgggccgggtgcggtggctcacgtctataatcccagcactttggaaggctgaggtgggcaaatcacctgaggtcaggagtgtaagaccagtctgaccaacgtggtgaaaccctgtctctacaaaaatacaaaaattaaccaggcatgatggcaggtgcctgtaatcccagctacttgggaggctgagatgggagaattgtttgaacctgctgcattccagcctgggcaacagagtgggactcaaaaa

SEQ ID NO: 410865 - DNA, 260 bp, Homo sapiens
gcatttcgtggtagtacattatcaaatataaactgggatctacatctattttatgtattcatgacacctttttgttaattttttgatacttctaggctacagggtttgtctgtgagttttttcagattgttgcaaatcttcaaatctttttcaattattgaaaaagaatccacgtataagtggacctacgcagttcaaacccatgtagtccaagggtcaactgtgtattttttttttttttttgagatacagtctcactc

SEQ ID NO: 410866 - DNA, 432 bp, Homo sapiens
tgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaagggtaggtactttgttgttaaagttaagcacaatttttctttcttttaatgtttagcttgatgcagactctttgtgggatactaatgttgggatataaacgatgctttgtgaacacccccaaaatatttgagcaattttttttctcccttaataagttcacggtgaggtttcaaagagcaagagaacttagttaaagacatttcagtaactggaagatacttctatcatgctagggcagagcaaagaacttggtacag

SEQ ID NO: 410867 - DNA, 529 bp, Homo sapiens
acaggtagtcctctgggtttatagacagagacctggaccagtggtttaatgcccagctcccacttcttccttgtgtttctgtaggctcatttacctccatatgcctaaggttctttctttgtttcctttggtttctcttctataaagtgagtgtagtgaacatcattccattgggatttttgtaggagcagcaaatggtagaatgcagttaacttaatatacatcttataggacgatggagacaatcttgtagacttaagtgcatcttaagagaaaaagtccttgatcttccaggaagtataaattgttatcctattttggtatttaaataatatatttataatcttttgttctggagttaatgtatgtgttttcagtagagaatattcatcgtttccccagtattttctcgctcacctgacctccaaactgtctgtgtgtcaatatatttatttttctccatagatatgtaattcctcaaagagagaatggcattcaagtgatttggcgcataggaattaaaaaaaaa

SEQ ID NO: 410868 - DNA, 421 bp, Homo sapiens
tcttgggtagtaaattgtcgttagatgaactcactaaaatttggaagatacagtcaggacaatcatctactgtgattgagaacattcatactattattgctgcagcggctgtgaaatttaattcagatcagcttaatcatttgtttgttctcattcagaagagctgggagactgagagtgatagagtaagacagaagcttttgagcctgattggacgaataggccgggaagctcgctttgagaccacttctggaaaggttttagacgtactctgggaactggctcaccttccaaccctgcccagtagccttattcagcaggccttggaggagcacctgacaatccttagtgatgcatatgcagtgaaagaagcaatcaagaggagctacatcatcaagtgcatagaagatattaagagggt

SEQ ID NO: 410869 - DNA, 317 bp, Homo sapiens
cagtcaaaccagttagtctgaaaataaatgtgaaagaggtcaaggagagaacctagagaattccagatattctaggaggttctcagagatcctttgtagtaaacctcccaaaggatttcctcagagaagcttacaccctttagtgggacagtttttgtgtctcctctgtcttcctggactcccctgaaagttattctaaaattagatccacagctttagataccctgaggcctgaattactgaacttggcggggggcctacagcaacaggacttctgcatgctcctactcgacagccctgtgcttagaaaaaaaagt

SEQ ID NO: 410870 - DNA, 396 bp, Homo sapiens
gattgaggatagtgaacatcttcattgtgtttgtaaactcaggaggaatgctcattcaatatgatgttaacagtgggatttttcataagtatctttgttcagaataagaacattcttttcattctagttttctgagagtttgtatcaagaaggttcttaagttttatcaaatgtctttttaaaatctatgtagatgatcatatggtgtttctcttttattctgttaatgtggtgaatacattgagttttggaggtaaaaccaatattatattcctaaaataaacaccatttggtcatgatcatcattcttttccacattgatgatttttgatttacttttcttgtttgtttaggattactacatctatatttatgacatatatttgcttgtatttt

SEQ ID NO: 410871 - DNA, 242 bp, Homo sapiens
aagcttttctcacctccaaatctttttctccattaaaatatattcaaatataattagtgtaacattaacatggaggaaattttgtaattgccagttgttctgtagccatggttacatcaaagatttatagcaagtaactcccggctgggcacgaacaagcagttagcaggagcagcagtaagaaaatgtttgtgtgcacgtgcaggtgtgctgacgtgaatgtttgccaaaaaaaaaaaaaa

SEQ ID NO: 410872 - DNA, 502 bp, Homo sapiens
aatgtgtaactagggttggggagagcgggctggagagagacagcacacaaagacaacagagagaagtcaaataggaaatttcaaaatgagaatcagctgatgtataaaaaagagcaaaataatttttttaccgatagaactgcaagatttagctttccaaaatgattcaattctccagaaaagaaaaattaatttaagcactcatctaagtaactagtataaagtgccaagcaaaaataaacatttattagatatagacaaatgcaaatatattcaatgctttcgtacaaatgtgaatatctgggggccttattatcatcttgttaatatatgccagtgaacaatttgtagacacaagacttgttttacaaactgggtaatatgttccatgaacgtaagccaggaatttaaaacttagtgtctatctcttcattctaagaaatgtttcagctaactcactgtgtgtgtgtgtgtgtgtgtgtgtgtgtgtgtgtgtgtgtgt

SEQ ID NO: 410873 - DNA, 1439 bp, Homo sapiens
gattacaaggcatgtgccaccatgcccggctcattttgtatttttagtagacatgaggtttcaccatgttgaccaggctggtttcgaactgctgacctcaggtgatccatccgcctcagcctcccaaagtgctgggattacaggagagagccaccgcgcccagcagacctgaacattttaacagtcactccccattcttccttcccccacctctgataaccactaatctacctaatatgcctatagatttgcctattttggacttttcaaataaatggaatcatatgtggcattttgtggctggcttccttgagtcaccatgatatttttaagggttatccatgttgtagtatgtgtcagtacttgaattccttttgttggtcttcgagtggctaaggaggggaaactgagcacaagaagagggcactttgagcacagagaaagctggacccgaaatctaccaacaagagcagaacctaaatattgatgaagaggggctgattctaggcacagcaggtggtggaagcctaatagttgtgcaggtgattttataatgttaaaagcacggagtggccacagttggatctgaccgagggaactgaatcttttcctccatgtgagagctgttgtcagcccaacaggggtatacatgtacctgggacagggcagcttcccattctgcaatagtggcatgatacccttttcctgagatgcattcagggttaaagaagatagttcacctacacgttagatttcccgtgaagataaaaagtcccaagttttgaaaagcagaaggaattctaaaaagaactgaaaaacaaaagcccatggggagagtgatgaaatgagtttctgagaaagactgtgaagaggggttcaaagcggccgctgacggactgcccgaacctagggcaatgaaagacctggggcaggaattgatgttgaccgtggcagaggcagtggacctggtgggcagcccagaggaaaaggcctttggcttgctgagagagctcttccagaactgagcaagagcatagtttgttgaagaatggagaggtccacagtccatctcctgtgccaaggattagtatttcatttcaagaagcgatttggtagtcacagagtgaatattattatttttccacaaattcattacctctttcccctcatgagtatcttagcattgaatttcctgactttatgatgaataaactttgttttagtgtttattaatgccctatttactttcccctgggtgaagttttggctagtaataagattttgtgtctctgctgtagtgaggcattgctgtagaaagccaggtctaagaaaaatgaattttgttcctttggggaagcataattaccttaaaaaagtttaaagtgtggttttcaacttagtaaaatcctattataaagaaaaacgtacatagcaaaaat

SEQ ID NO: 410874 - DNA, 388 bp, Homo sapiens
tgctgggattacaggcgtgagccaccgtgcccggcccccattggtgctattgttttatgtgatagagccagcttctcccttttctttggatttttaaacatactcttccttttacttagactattctccatcccaacacctttcctaaacttctttcacaccttagactagctgacactttactgagaaacctttcttttttataggttgctttttctatagactctcttagcatttactcattttattgtgaagtgtctgatcttatttaaatgacaagtataagaggatagaaactatttcatatttttctcacccagcaggcacaatttctgacatgtggtaagcactcagtaaatattgaactttagaggctaggacatttgag

SEQ ID NO: 410875 - DNA, 788 bp, Homo sapiens
ccttgtattttcgttgcccgggtaagtatttcactcaagagatagtttcaagaaagttggagatttcttctttcaaactagcaaagacatttttgcttttgtctcttgaaaatctccctcaaactaaaagaatgaaaatcaggaatgcagactgtatccttataaaccttggagacatctgtaaccctgacccatacaggacctaaagatagaaagcagatgaagtgatggcaaatgcatttgcagagagaagaagtgaagtcaagaataaaatgcctgcagggctcacagggagaggaccggaagcgattgatttgctcacagaatgccaggaaggctcagaaatgagagttccccagttccccagaggcataggtgaagcagaggctttaggatgggagtaggggtgggaaagtctgcaggaggtaaaggggagccccagaaggacttgagaagggaagttccctattgcagctctggcccaaggagaagagcccatctagaatagagctgaaggaggagggctccaggaggagtgtttctgggaggagcaggaatgaaactgattagaaaagaagaaaaaaagaatgggccgtactgggtttgaattctttctctgtcaccaatgaactgtgagtatgaggaaattagttaatgtctttggacttttcatttccttatttattaaataaaacattatatcatatggtattttgttattctgttgggtaaaagacagtacaaaacccagcaagtctacttccagatgtctaccccaaaaaatgaaa

SEQ ID NO: 410876 - DNA, 472 bp, Homo sapiens
tttttattattagtgttgtttggtgctaatacagctatttaaataaatccaatctcagtataaaaaaaggaaaacgtttgacagaatatttatagaatgcctttacattattgttttcaaagtagttaatatcttatttatattttaatttccaaaagaacatgttataatttgaaaagttttctgtaaagtttcttaatgttatagtttaataaataggttatctaaactatctttttcccccatgtagatagatatgtagaaaatgctaaagcatgttatactaaggattttaattttagacttattgtaaaaggagagcatcaggaaaaatagctaatgcatgtggggcgtaatacctaggtgatgggttgataggtgcagcaaaccaccatggcacacgtttacccatgtaacaaacctgcatgtcctgcacatgtatcccggaactcaaaatttaaaaaaagaaaaa

SEQ ID NO: 410877 - DNA, 593 bp, Homo sapiens
ccctagtgggaaggtctattaaattcttaattttaaatatatgactatcaaatagttcactgtcaagaaaggcacataccatataccaatcattttttaaggttaggaacaagcaacacaaaactcatattttaaaaataaaaaatatctccattttatactctactgagaggtacgttatggaaaataaaaggaagtgctaagagacaaatatatggagactgaggaaaaatgggagaaaagggacaaaaattgaaaaattgaccaaaaggtatggtgttatatagttaaaattaacttgaatactttatatttttctttttctcccactttttgagacagggtctcactttgtcgcccaggctggagtacaatggcacaaacacagctcactgcagcatcaatctcctgggctcaagcaacacagcaagaccccacctctccaaaaaaatttagaaaacagctgggtctgggtgtggtgattcacacctgtaatcccagcactttgggaggctgaggcaggaggatcatctgagcttaggagttccagaccagcctgggcaacatagtgagatcctgtctctattaaaaaa

SEQ ID NO: 410878 - DNA, 436 bp, Homo sapiens
ccctagtgggaaggtctattaaattcttaattttaaatatatgactatcaaatagttcactgtcaagaaaggcacataccatataccaatcattttttaaggttaggaacaagcaacacaaaactcatattttaaaaataaaaaatatctccattttatactctactgagaggtacgttatggaaaataaaaggaagtgctaagagacaaatatatggagactgaggaaaaatgggagaaaagggacaaaaattgaaaaattgaccaaaaggtatggtgttatatagttaaaattaacttgaatactttatatttttctttttctcccactttttgagacagggtctcactttgtcgcccaggctggagtacaatggcacaaacacagctcactgcagcatcaatctcctgggctcaagcaatcttcctgcctcag

SEQ ID NO: 410879 - DNA, 883 bp, Homo sapiens
tgaagctacagtagtcaagacagtgtgatattggcataatgacagacatgcagatcaatggaaccgaattaaaggcccagaagtaaagtctcacatagccaactgattttttgacaagagcgccaagaacctttaatgggagaaagaatagtctcttcaaaaaatgatgctgtgtcaattggacatccacatacaaaataatgaaattttatccctaccacatatcatatccaaaagttaactcaaaatgggtcaaagacccaaatgtaagagctgaaactacaaaaatcttggaagaaatataggcgtacatctctgtgaccttgggctaggtgtcttaaatatgatatcaaaagcatatcaacaaacaacaaaaaaaagataaattggacctcatcagaatgaaaagtttttgtgcttcaaagtgaaaagacaacatacagaattggagaaaatattttcaaattgtatatctgataagggacttgtgtctacaatatatgaagaattcaataaaaaagcaaatactccaattaaaaatagacaagatttgaaagaaagaaatttctccaaagaagataaacaaatagcaaataagcacatgaaaaagaggttcaacatcattagtcattagagaaatgcaagtcaaaaccacagtgaaatactatttcctacatactagagtggctaatatctaaaagacaagtgttggtaagaatgtggagcaattgtaaccttcatacattgctggtgggatctagaatgatacaatacagccaccttggaaaacagtttaaacagaattatcatttgacccagcagtcttactccttggtatatccccaagagatatgaaaatgtaagttcatataaaaatgtgtac

SEQ ID NO: 410880 - DNA, 1173 bp, Homo sapiens
gcggccgctcgggccccggctctcggttataagatggcggcgctgagcggtggcggtggtggcggcgcggagccgggccaggctctgttcaacggggacatggagcccgaggccggcgccggcgccggcgccgcggcctcttcggctgcggaccctgccattccggaggaggtgtggaatatcaaacaaatgattaagttgacacaggaacatatagaggccctattggacaaatttggtggggagcataatccaccatcaatatatctggaggcctatgaagaatacaccagcaagctagatgcactccaacaaagagaacaacagttattggaatctctggggaacggaactgatttttctgtttctagctctgcatcaatggataccgttacatcttcttcctcttctagcctttcagtgctaccttcatctctttcagtttttcaaaatcccacagatgtggcacggagcaaccccaagtcaccacaaaaacctatcgttagagtcttcctgcccaacaaacagaggacagtggtgagtcagttttaatatcaccattttgctgtttctttgtatttttcagacagatcagttgttgaaaattaatatattattacttcatactcagaggtcatgcaaatagaggcatccatgtcatacaggaatgaaaaatatgtaattatttggtggcaaagtctatattccttaactgaaataaatggtattgtctctagtgttggatttgacatttaaacctgtctgccaaacttgaaccacagtcatgtctaagcactagtttaaaataaatcaggattttaagacttgagcttgttcattatctaatgtgtgtcaggtaagactcattcttcacccttgagaaatctcctttctgagttatattatcagatgttgaacgttcagtgtgattgatatgtttcccctcatctacttcatttttggttgttgaatattagtattaaccattggaacagcgtaccctgtaagtaacatttgaagcatttaaagagaaatctgtggaattattgtgggtggtctataatccttaagtgcaacgaatattgttagtagacttaataagtaacccatctgtatacatcactactttttaaatgtctgtggttacttttgacaataaaaattccaaataca

SEQ ID NO: 410881 - DNA, 675 bp, Homo sapiens
actggtgaaaagattataatcaaaggctaaaattttatattctcttttgttaatgtcaggacaaagtccggattgaatataagtctgctttattttataggcctatgaagaatacaccagcaagctagatgcactccaacaaagagaacaacagttattggaatctctggggaacggaactgatttttctgtttctagctctgcatcaatggataccgttacatcttcttcctcttctagcctttcagtgctaccttcatctctttcagtttttcaaaatcccacagatgtggcacggagcaaccccaagtcaccacaaaaacctatcgttagagtcttcctgcccaacaaacagaggacagtggtgagtcagttttaatatcaccattttgctgtttctttgtatttttcagacagatcagttgttgaaaattaatatattattacttcatactcagaggtcatgcaaatagaggcatccatgtcatacaggaatgaaaaatatgtaattatttggtggcaaagtctatattccttaactgaaataaatggtattgtctctagtgttggatttgacatttaaacctgtctgccaaacttgaaccacagtcatgtctaagcactagtttaaaataaatcaggattttaagacttgagcttgttcattatctaatg

SEQ ID NO: 410882 - DNA, 1389 bp, Homo sapiens
aggtgaagtggatcttctcctcggtggtggacctgaagcagaccatcatccccgactataggaacatgattgggcagggggcctagggccaccctctgcggggtgtccagggccacccagatcccacacacgagccgtgggccatgctcagccaccacccaggccacaactgcccccgacctcaccgccctcaaccccatggctctctgtctttgcagtcgccctctgagccctgacacgccccccttccagaccctgtgcatagcaggtctaccccagacctccgctgcttggtgcatgcagggagctggggaccaggtgtcccctcagcaggatgtccctgccctccagaccgccagatgctcacacaaaaggaggcagtgaccagcatccgaggcccccacccaggcaggagctggccctggagccaaccccgtccacgccagcctcctgaacacaggcgtggtttccagatgcccgcagccagccagcctccattccgggcactcccgtgaactcctgacatgaggaatgaggttgttctgatttcaagcaaagaacgctgctctctggctcctgggaacagtctcggtgccagcaccaccccttggctgcctgcctacactgctggattctcgggtggaactggacccgcagggacagccagccccagagtccgcactggggagagaaggggccaggcccaggacactgccacctcccacccactccagtccaccgagatcactcagagaagagcctgggccatgtggccactgcaggagccccacagtgcaagagtgaggatagcccaaggaagggctgggcatctgcccagacaggcctcccagagaaggctggtgaccaggtcccaggcgggcaacactcagccttggtggggcctgaggacagaggaggcccaggagcatcggggagagaggtggagggacaccgggagagccaggagcgtggacacagccagaactcatcacagaggctggcgtccagccccgggtcacgtgcagcaggaacaagcagccactctgggggcaccaggtggagaggcaagatgccaaagagggtgcccgtgttcttgcgaaagcggggctgctggccacgagtgctggacagaggcccccacgctctgctgcccccatcacgccgttccgtgactgtcacgcagaatccgcagacaggaagggaggctcgagcgggactgcggccagcgcctgcctcggccgtcagggaggactcccgggctcactcgaaggaggtgccaccatttcagctttggtagcttttcttcttcttttaaattttctaaagctcattaattgtctttgatgtttcttttgtgatgacaataaaatatcctttttaagtcttgta

SEQ ID NO: 410883 - DNA, 783 bp, Homo sapiens
aggtgaagtggatcttctcctcggtggtggacctgaagcagaccatcatccccgactataggaacatgattgggcagggggcctagggccaccctctgcggggtgtccagggccacccagatcccacacacgagccgtgggccatgctcagccaccacccaggccacaactgcccccgacctcaccgccctcaaccccatggctctctgtctttgcagtcgccctctgagccctgacacgccccccttccagaccctgtgcatagcaggtctaccccagacctccgctgcttggtgcatgcagggagctggggaccaggtgtcccctcagcaggatgtccctgccctccagaccccaggagcgtggacacagccagaactcatcacagaggctggcgtccagccccgggtcacgtgcagcaggaacaagcagccactctgggggcaccaggtggagaggcaagatgccaaagagggtgcccgtgttcttgcgaaagcggggctgctggccacgagtgctggacagaggcccccacgctctgctgcccccatcacgccgttccgtgactgtcacgcagaatccgcagacaggaagggaggctcgagcgggactgcggccagcgcctgcctcggccgtcagggaggactcccgggctcactcgaaggaggtgccaccatttcagctttggtagcttttcttcttcttttaaattttctaaagctcattaattgtctttgatgtttcttttgtgatgacaataaaatatcctttttaagtcttgta

SEQ ID NO: 410884 - DNA, 883 bp, Homo sapiens
aggtgaagtggatcttctcctcggtggtggacctgaagcagaccatcatccccgactataggaacatgattgggcagggggcctagggccaccctctgcggggtgtccagggccacccagatcccacacacgagccgtgggccatgctcagccaccacccaggccacaactgcccccgacctcaccgccctcaaccccatggctctctgtctttgcagtcgccctctgagccctgacacgccccccttccagaccctgtgcatagcaggtctaccccagacctccgctgcttggtgcatgcagggagctggggaccaggtgtcccctcagcaggatgtccctgccctccagaccgccagatgctcacacaaaaggaggcagtgaccagcatccgaggcccccacccaggcaggagctggccctggagccaaccccgtccacgccagcctcctgaacacaggcgtggtttccagatggtgagtgggagcatcagccgccaaggtagggaagccacagcaccatcaggccctgttggggaggcttccgagagctgcgaaggctcactcagacggccttcctcccagcccgcagccagccagcctccattccgggcactcccgtgaactcctgacatgaggaatgaggttgttctgatttcaagcaaagaacgctgctctctggctcctgggaacagtctcggtgccagcaccaccccttggctgcctgcctacactgctggattctcgggtggaactggacccgcagggacagccagccccagagtccgcactggggagagaaggggccaggcccaggacactgccacctcccacccactccagtccaccgagatcacgagctggctcgagatcacgagctggct

SEQ ID NO: 410885 - DNA, 1497 bp, Homo sapiens
aggtgaagtggatcttctcctcggtggtggacctgaagcagaccatcatccccgactataggaacatgattgggcagggggcctagggccaccctctgcggggtgtccagggccacccagatcccacacacgagccgtgggccatgctcagccaccacccaggccacaactgcccccgacctcaccgccctcaaccccatggctctctgtctttgcagtcgccctctgagccctgacacgccccccttccagaccctgtgcatagcaggtctaccccagacctccgctgcttggtgcatgcagggagctggggaccaggtgtcccctcagcaggatgtccctgccctccagaccgccagatgctcacacaaaaggaggcagtgaccagcatccgaggcccccacccaggcaggagctggccctggagccaaccccgtccacgccagcctcctgaacacaggcgtggtttccagatggtgagtgggagcatcagccgccaaggtagggaagccacagcaccatcaggccctgttggggaggcttccgagagctgcgaaggctcactcagacggccttcctcccagcccgcagccagccagcctccattccgggcactcccgtgaactcctgacatgaggaatgaggttgttctgatttcaagcaaagaacgctgctctctggctcctgggaacagtctcggtgccagcaccaccccttggctgcctgcctacactgctggattctcgggtggaactggacccgcagggacagccagccccagagtccgcactggggagagaaggggccaggcccaggacactgccacctcccacccactccagtccaccgagatcactcagagaagagcctgggccatgtggccactgcaggagccccacagtgcaagagtgaggatagcccaaggaagggctgggcatctgcccagacaggcctcccagagaaggctggtgaccaggtcccaggcgggcaacactcagccttggtggggcctgaggacagaggaggcccaggagcatcggggagagaggtggagggacaccgggagagccaggagcgtggacacagccagaactcatcacagaggctggcgtccagccccgggtcacgtgcagcaggaacaagcagccactctgggggcaccaggtggagaggcaagatgccaaagagggtgcccgtgttcttgcgaaagcggggctgctggccacgagtgctggacagaggcccccacgctctgctgcccccatcacgccgttccgtgactgtcacgcagaatccgcagacaggaagggaggctcgagcgggactgcggccagcgcctgcctcggccgtcagggaggactcccgggctcactcgaaggaggtgccaccatttcagctttggtagcttttcttcttcttttaaattttctaaagctcattaattgtctttgatgtttcttttgtgatgacaataaaatatcctttttaagtcttgta

SEQ ID NO: 410886 - DNA, 367 bp, Homo sapiens
aagactattggaaaagcatatttgggatgtgtgaataccaagagttgctttttggacatactaagttgtagcacctatttgacatgtaaatggagatgtcaagcaaaccactgaatatacacctctggcttttaagagaagtctagctttaatctacagtgtgggctgtgtcagctcaatgtatatgaagactatatgtgttttgttgcttagctattcataccccaattccagtggaagataaaatgtttatttttcagttgttaaagcagaagtctgatatagcttggttatcttggatcattgccatctctaatcactgtggctcgggaaagggaagctctgattggccaggcctgtgtgccca

SEQ ID NO: 410887 - DNA, 305 bp, Homo sapiens
gttacattcctatggtatagttctggccacaaaaacatcaccaaagaagcacacttctaatacgaaacactgaaatacatgtgagctctacgtgcatttaagaaggtaagatcgcccgtgtgggaagtgatgagggcctctgcccggcccctccaccgtctgggatgtgaggagcgcctctgcccggccgctgtgcaaccttccaagtgtgaagtgacagccttgtgtgtgatctttctgccttccccaagtttgcattttcgacattaaagtttactttttaattaaagttttaaattggagaa

SEQ ID NO: 410888 - DNA, 585 bp, Homo sapiens
tgttgatgatgatgatacctaatgcaaatggagtacttgctgtgtgccaagcactgtgctaaggatgacttcatgtgcatcataccatttgtcttcataataaccctctgaagttggaactataactaaatctaaccccatagaagaggaaattgagacatagagaagcttaaaaacttgccaaggtcatgcatctagtaagtggtggaaccaaaatttgaactcaggtctgtttgtgccctaagcccagcttttaaccactaaactgtagtttctggcatcaagtattagggcactaataaacaacttagtacagggatagacaagcgttgggccaaatctggccatgcctattcatttgcctatttgtggctgcttttgtactactatggcagagttgaataattgaaaaagagacctcatggcctgcaaagttgaaaatatttactatctggacctttaccaaaaatgtttgccaatccctgctttagatggttctaaaggaaagatatggtagttaaatatttggaaatcatttacccccttatacatagaagaacacacatgtttagaaataaagattca

SEQ ID NO: 410889 - DNA, 380 bp, Homo sapiens
tgattttgacctctattataatagactctatgatatatcaaagtactttatagcagaggtttattatattttcaaattgctatatatattttatataaaattgtgttccataactgttatttaaatatgatgatacatgtgaaaatatcttacaacgtatttgtcattaaaagtgaagtatgatttttaaataatctgataagaaccacagaggaaactggagaggccacatctggagaactgttttcaaccaattatgatgatattaatgatggcagtgttgatgatgatgatacctaatgcaaatggagtacttgctgtgtgccaagcactgtgctaaggatgacttcatgtgcatcataccatttgtcttcataata

SEQ ID NO: 410890 - DNA, 310 bp, Homo sapiens
gaaccatgtaagaagtctgactgccctgctggagaaatcaaatggagaggtcaagagacaacatggagagagaacgcacagcccagctgagcccagctttccagttatccccaccaatgcgccacacatatgacggaagtcattttggtccctccaaaacaacctagccagccagctggataccactgagtgacctcagtagatgccacgtgggacaggagaattctctagtgagctttgcccacattccttacccacacagtcatgagtataattaaatgattattgttttaagccccaagttttgggg

SEQ ID NO: 410891 - DNA, 401 bp, Homo sapiens
ctcaggatgtgcccttgggaactaaagcaggtgatggccaaacaccccagaaacacgccttctgggcccgtgtctgtggcttcaatgccatcctcctcatgtgtgtcaacatattcttttatgcctacttcgcctgacactgccatcctggacagaaaggcaggagctctgagtcctcaggtccacccatttccctcatggggatcccgaggccccaagaggggcagattcccctcacagctgcacagcagctcggtgcccaagaactggccaagccagcaaagcgggagccctgaaaaattaggggggaaatgggagaaaataatgtgacatttcaaaaacagcaccaaagcagtcagcattggaaggaaaattagatttctgacggacatcctgatgtt

SEQ ID NO: 410892 - DNA, 787 bp, Homo sapiens
ctgatcaccttttgctgtaccttcaaatggcatttcttcaatgtgtgtacatctctgatgtctctgtgtatccaaatttcttcttgtaaggacattatcagattggattagggcccaccgcaatggcctcactaaatccaatcttttttgacatatgcatatagaagttcctagacttcagtgctgaggagacagaggctacaggcatccatatgtctgtctctggggtcttcttaggaagaggcctctgatgaagagaacaaagctcttgtttgatatcccagcttgagcaagaggaatgggacaagttcgtggcagccaccagccgccaggagatggctgaagtagacaatcaatttccaggttattgggaaattcaagaccaatcaatagaattatctggagataaactctctgggacagtgttcatcaagttgcagtgccctgtttgagtccgagttagtgttagtcggagatacagtgaagtctaaggaggatgaggaagagtgattggtgatagcagataaaagaaaaatgaatcagtgggataaatggagatgaccaagtttgggagaagacaatactatgagagaaggtgtccagagacagagtgagacacagatataggaacaggatcctgggccttcctgctccaggaaaagcatggaaaaggcaagttgtgagggcagaagacagtcccacaagaacatgaaattcagtcatgcaaagggctgggaaggcagaaacacagtggtgagagtgagccagaaaggagatgtggggagca

SEQ ID NO: 410893 - DNA, 437 bp, Homo sapiens
atttgtggtcttctctctctttttgatctgtgcaatggctggagatgtagtctacgctgacatcaaaactgttcggacttccccgttagaactcgcgtttccacttcagagatctgtttctttcaacttttctactgtccataaatcatgtcctgccaaagactggaaggtgcataagggaaaatgttactggattgctgaaactaagaaatcttggaacaaaagtcaaaatgactgtgccataaacaattcatatctcatggtgattcaagacattactgctatggtgagatttaacatttagaggtgacagcatcccccacactggcagtgaattttttgtgctacaaacttggcaaaagtctgtgaaaagaagtttcaacttcatgtgttattaactatacaaatattagttgaatgaattgttgaattacatg

SEQ ID NO: 410894 - DNA, 940 bp, Homo sapiens
atttgtggtcttctctctctttttgatctgtgcaatggctggagatgtagtctacgctgacatcaaaactgttcggacttccccgttagaactcgcgtttccacttcagagatctgtttctttcaacttttctactgtccataaatcatgtcctgccaaagactggaaggtgcataagggaaaatgttactggattgctgaaactaagaaatcttggaacaaaagtcaaaatgactgtgccataaacaattcatatctcatggtgattcaagacattactgctatgaaatccaatcttttttgacatatgcatatagaagttcctagacttcagtgctgaggagacagaggctacaggcatccatatgtctgtctctggggtcttcttaggaagaggcctctgatgaagagaacaaagctcttgtttgatatcccagcttgagcaagaggaatgggacaagttcgtggcagccaccagccgccaggagatggctgaagtagacaatcaatttccaggttattgggaaattcaagaccaatcaatagaattatctggagataaactctctgggacagtgttcatcaagttgcagtgccctgtttgagtccgagttagtgttagtcggagatacagtgaagtctaaggaggatgaggaagagtgattggtgatagcagataaaagaaaaatgaatcagtgggataaatggagatgaccaagtttgggagaagacaatactatgagagaaggtgtccagagacagagtgagacacagatataggaacaggatcctgggccttcctgctccaggaaaagcatggaaaaggcaagttgtgagggcagaagacagtcccacaagaacatgaaattcagtcatgcaaagggctgggaaggcagaaacacagtggtgagagtgagccagaaaggagatgtggggagca

SEQ ID NO: 410895 - DNA, 186 bp, Homo sapiens
ctgatcaccttttgctgtaccttcaaatggcatttcttcaatgtgtgtacatctctgatgtctctgtgtatccaaatttcttcttgtaaggacattatcagattggattagggcccaccgcaatggcctcactgtaagttaattacatctttaaaggttgtgtctccatatacagtcacattctga

SEQ ID NO: 410896 - DNA, 485 bp, Homo sapiens
tacacatgacttcaattcttttaattttttttcaaatgtaccctggaacaaagcacatacttttttcaaagaaagcttagcacataatataaccaaatttgagacccttcaattagtatacattattaggatacagttttacattgattttaattgcttatcttcctttcttccagtttctttcaacttttctactgtccataaatcatgtcctgccaaagactggaaggtgcataagggaaaatgttactggattgctgaaactaagaaatcttggaacaaaagtcaaaatgactgtgccataaacaattcatatctcatggtgattcaagacattactgctatggtgagatttaacatttagaggtgacagcatcccccacactggcagtgaattttttgtgctacaaacttggcaaaagtctgtgaaaagaagtttcaacttcatgtgttattaactatacaaatattagttgaatgaattg

SEQ ID NO: 410897 - DNA, 340 bp, Homo sapiens
tttttttgagaaagagtctcgctctgttgcccaggctggagtgcagtggcgcaatcttgggtcactgcaacctccacctcccgggttcaagcgattctcctgcctcagcttcccaagtagctgggactacaggcacgtgccaccacacccggctaattttttgtatttttagtagggatggggtttcactgtgttagccaggatggtctcaatctcctaacctcgtgatctgcccaccgcagcctcccaaagtgctggaattacaggcgtgagctaccgtgcccagcctacatcttatactttcatgtctttgatagtaacccttcaacctaaatctgtg

SEQ ID NO: 410898 - DNA, 93 bp, Homo sapiens
acgagtggtcaagcgcaaggtcaaaagcgcagggactggtttaaggtctgattgtagcatccttaaatcaccatgcccataccctcacagcca

SEQ ID NO: 410899 - DNA, 184 bp, Homo sapiens
taaattgccatcatattatgagtagatcaagtcttgaaactgattacagttgtcatattaataacactaataatacaaagcattagctgagtattctttacgtgctaaaaactgtgctagaaactttacacagattatttcattgaaacctcacagcaagtccagaaggggacgctattacaat

SEQ ID NO: 410900 - DNA, 671 bp, Homo sapiens
ttctcaagtcccactctaaacagaaaatatttagatttaggattagaaaatactgggtgaagtccaaggcatctgtaactgtaataacactctcccttgaattccaatgatcagtcaggtttgggaagttctggtttcaataacttgttcaaggtcacacagaaccctaaatagagccagaaactaactcaaatcttttgagtccaagttaaatatattttcattggactcctgctgtccatttactgacaatatatgatggggtaggatgaagaggtggggagaaaagtagcaattttagttttttcatttttattttttaccatattctatgacatggttttaagattaaatgagctaacatccatagagtgcttagaacagtatctggcacatggtaattaggtgtaacggttcaacgaataagtctccattgtccagtcatggcattcactttgcctggggttacattaggtaacattttattggatatcgactttttctatgaagaaaaaaatgtatgtaaataaaggtggaatctttagcctttatttgtcatggaagccctgaatttgtatagctgaaaatatttctatattgtttcttttcatcttttctgatatattaagaaaatgttaatgatatacttattaaataaaattgtggatgta

SEQ ID NO: 410901 - DNA, 691 bp, Homo sapiens
aagctcaaacctaccatttggtgctttctaaaattagttctattgccagaaacccaatatccactgtgcttggctccccagtcaagtgtcctgtgaactaacatcaatcctcactgccctgtgtatatgaaagagctttcagctgttttcatggtttttctaacagttccccagttgggattagagcctttgtttgaatcagcctactagaataacctgcttatcttttgccagtcctttaataggagtgggaccctccttcctgccttttcaaaagcttggttctggatccaaacaatacttatagtacttagttataggtatatattagtatacatgacttaactgtctgaatattgccactgcctctgatcttactccatcctgtagagtaacatcttgtagagagcatcttggggcagaagaggatacattttcagtatgagaaccagactccttgtcttactctcatgagtcctggtctcctcctggtactactattccactgctgaggtctcagcatgccatatagctgagtttgtcagagttaatgagggtttaatcagaatcccaaatcaagtacagtccagtccaacctatttgagaactttatctttcttgttacttcatttattatagttgacttcaaaagagcaatggaaaaggcacttcagaatatgcaaaaaatgta

SEQ ID NO: 410902 - DNA, 452 bp, Homo sapiens
cttttcctcctaacatttaaccccatttccagtatgactgccagcagctgagccaacctaaaggtccagagttggggctcaatgcttaatttgttcttagaatatcttggcctgtttttttatttttggctccgtctcaaaaaagaaaaaaaaattattaagaatttttcgccaggcatggtggctcactcctgtaatcccagcactttgggaggccgatgcaggcggatcacatgaggccaggagttcgagaccagcctggccaacatggcaaaacctttactgaaaatacaaaaattagccgggcatggtggcacacatttataatcccagctactcaggaggctgaggcaggagaatcacttgaacctgggaggtggaggttgcagtgagctgagatcacaccactgcactccagcctgggtgacagagcgagactctgtctcaaaaat

SEQ ID NO: 410903 - DNA, 458 bp, Homo sapiens
aggagagcgcctgcgcgggagggtgaccacaggcggccgggcgggatgtcctgtccgccgtcttcagcccagccgccaccacccataagctatgaggaggagtttacgaccacctggactactaccacctgcgtgacttcccggcctgaggggtccgcgcagcaaaggcctgacgctgctggagcaggcgctgcgcacctaccggctggcgcctggtaggcacgagtgcagggtcgcccagaagctcctcaatggccggcgcaagtgccagccagcgccagctgcagccctggccgcgcactcgcctcagctgagcctggggccttcaccatctctgtcatctggagaatttgttcccatcaggaatctcccacctggcagtgggaccatgctagtagcctgtccatttcctgcagataaaaaagagaggtatcggtaatacatgcatatatataaaa

SEQ ID NO: 410904 - DNA, 654 bp, Homo sapiens
aggagagcgcctgcgcgggagggtgaccacaggcggccgggcgggatgtcctgtccgccgtcttcagcccagccgccaccacccataagctatgaggaggagtttacgaccacctggactactaccacctgcgtgacttcccggcctgaggggtccgcgcagcaaaggcctgacgctgctggagcaggcgctgcgcacctaccggctggcgcctggtaggcacgagtgcagggtcgcccagaagctcctcaatggccggcgcaagtgccagccagcgccagctgcagccctggccgcgcactcgcctcagctgagcctgggtatgtgcaccccccaacacttcccccagccatgttcccgggacctcgggagcgtcccccaccgcccggtgccattcgtgctgggcagggtcggccccctttgaggctgccccgcgttagggagctgcaccgcacccccaccagcttgacctctgactgccgttgcaatagcattaaagcctttggaactttgtagggccttcaccatctctgtcatctggagaatttgttcccatcaggaatctcccacctggcagtgggaccatgctagtagcctgtccatttcctgcagataaaaaagagaggtatcggtaatacatgcatatatataaaa

SEQ ID NO: 410905 - DNA, 419 bp, Homo sapiens
gggtgtggtggtgggcgcctctaatcccagctacttgggaggctgaggcaagagagtcgcttgaacccgggaggcagaggttgcagtgagcgaaattgcgccactgcactccagcgcctgggtgacagagtgagactcagtctaaaaaaaagaaaggaaaaaagaatgagattagagagggccttcattcctcctggaagaacacctgatgtacctgaaatctttgttggtgacaggaaatatgtcgatagcatagggtttcactgttgcctcccacacagggccttcaccatctctgtcatctggagaatttgttcccatcaggaatctcccacctggcagtgggaccatgctagtagcctgtccatttcctgcagataaaaaagagaggtatcggtaatacatgcatatatataaaa

SEQ ID NO: 410906 - DNA, 545 bp, Homo sapiens
cggccgcccccgcgactgcgccacgtctgaggcggctgtggccacgtctgaggcggctgtggccgcgtcggtgtccgcgtcgaggagccggggcagggcacgatggcggactgggctcgggctcagagcccgggcgctgtggaagagattctagaccgggagaacaagcgaatggctgacagcctggcctccaaagtcaccaggctcaaatcgctcgccctggacatcgatagggatgcagaggatcagaaccggtacctggatggcatggactcggatttcacaagcatgaccagcctgcttacagggagcgtgaagcgcttttccacaatggcaaggtccggacaagacaaccggaagcttctatgtggcatggccgtgggtctaattgtggccttcttcatcctctcctacttcttgtccagggcaaggacgtgagccagtgggagctggtgtctgtgggtgccaagggcagccagcggtcttccctgcctggtgttttgggctccacaggacttacctacaaaatactcctttgcaatgat

SEQ ID NO: 410907 - DNA, 778 bp, Homo sapiens
ggctcactgcaagctccgcctcccgggttcacgccattctcctgcctcagcctcccaagtagctgggactacaggcgcccgccactacgcccggctaattttttgtagaaaatgaacaatttttatctatgtagggctcctgattgtgaagtggaataatttaataaggcttaaccctgggccaaaaatatcctctaggcagtttgtttctgtttgttctgaatccatgctcacaatatctttctgatgactcttttggctttgtgggtgcctgatgctgggaagggagagtctctggacatgggtcacaacccacagatataaacgagagacttagtgttcctggtttgtatgtcagttacacgtgactggtgtaagtctagccccaagagatactcatggtataataactaaattggatttggggcctgcaaagctgaggtctagaatgagagctgtgaaatggagagagccaaatgaggccttggttttaagctgtagcagaacttacttccattaccaggcaaaacagctaaatctgtagtaattaatatatgtgactactaaaataataaagataactgaagagaatttcacattttacaaagcactttcatgacctatttgattatcatgataataaaggtactattaccgttttaagaagaaagttgaggtttgtgacttgactaatgaggtcaaaactcaggtattcccacttctgactttgttcaattcatttttgtttctcatagtaagagtagggccactgtttatg

SEQ ID NO: 410908 - DNA, 362 bp, Homo sapiens
ggtcctgaggttctgacaatcctgaatcatgctttcggattcctcagagggcaaaatacacccacaataactttagtatttattgtattctgattcttttcaagtcagggatcttacacgatgattttttatttaccaaaatatatgtttaaatctgaacactatacagtcggatggtaccagagcaaaatgagaacatctgaggggaatcacaggttcacagaacagcagaacaaaagggacctcaaagattctcacacccaatcatctcatgtcacagagggggactgtgaagccccaaaagattaagtcactttcccaaagtcacatttagttaatgtgagagccaggcttagaattca

SEQ ID NO: 410909 - DNA, 655 bp, Homo sapiens
cccacctcaagactctggtagctgagacacaggcacacaccactacatccagccaatttttgcatttttttggagagatggggtctccctatattgcccagtctagtctcaaactcctgagctcaagcaatctgtctgcctagccctcccagaatactgggattacaggcatgagccactgcatccaaccaagaatgaattattttcctaatttaaaaaaaaaatactgagaagttttacaaaaaggagatacaccctctggtctaccacactgaatgatctgtcattctctcttggattagccttggtatgtcagggacctgcaccttttcttccaggcctttccatctatccggagtgacctaccagagacaggacagtttgaccagcaagcttctgatcactcttcaacacccagcaagaagtcttatcctccatgcagccttctaagacctctctaagcacaggtatcagatcctcctctggatcactctgtcttgttactgcatttatctcactggatttcagtgacgtgtgtagacaactaatttgtgcctgcctgatctgtgagctcttcattcaaagcagttggctcctgagtacaggataaacccctagaattgaataaatttggtcttacctcatcactggtaag

SEQ ID NO: 410910 - DNA, 504 bp, Homo sapiens
cacctgccatgccgtgaggacattcaaactgcctatggagaggtccacatagtgaaaaactaaggcccctgccaaaacccatatcagataccatcagcataatgtcatcgatgcagtggaccagtgtgacatggggaacataaagatggtcacgatttttgcagacttcatatgcaaagtattataggcctttccatctatccggagtgacctaccagagacaggacagtttgaccagcaagcttctgatcactcttcaacacccagcaagaagtcttatcctccatgcagccttctaagacctctctaagcacaggtatcagatcctcctctggatcactctgtcttgttactgcatttatctcactggatttcagtgacgtgtgtagacaactaatttgtgcctgcctgatctgtgagctcttcattcaaagcagttggctcctgagtacaggataaacccctagaattgaataaatttggtcttacctcatcactggtaag

SEQ ID NO: 410911 - DNA, 473 bp, Homo sapiens
tgcacgctgattactaaggcatctaaagtacagttatttcctactcatcagatcagataccatcagcataatgtcatcgatgcagtggaccagtgtgacatggggaacataaagatggtcacgatttttgcagacttcatatgcaaagtattataggcctttccatctatccggagtgacctaccagagacaggacagtttgaccagcaagcttctgatcactcttcaacacccagcaagaagtcttatcctccatgcagccttctaagacctctctaagcacaggtatcagatcctcctctggatcactctgtcttgttactgcatttatctcactggatttcagtgacgtgtgtagacaactaatttgtgcctgcctgatctgtgagctcttcattcaaagcagttggctcctgagtacaggataaacccctagaattgaataaatttggtcttacctcatcactggtaag

SEQ ID NO: 410912 - DNA, 487 bp, Homo sapiens
attacaggagtgagccactatgcctgcctggccaccttacttcttttcttataaacaggtctctctatcccaaagcctgatgtgatttccttactggagcaagggaaagagccctggatggtttcaagggacataccgggaggatggtgcccaggtgagtaaggactgagcagatggggaaggcactgctgtttagaacccagcccatcagggaggcagcgccgtaaaggtattggttggggaatctcttctgcaaggtcccatgtaagagttgtggcctaagacacatggagaaaagtcaagataccacccccccacccacaaacacactcttttttaaaaattttttttaatttgagagagagtcttgctcagtcacccaggctggagaacagtgatgcgattttggctcactgcaacctccgcacccaggttgaagcgattctcctgcctcagcctctaaaggaactggcattataggcacctg

SEQ ID NO: 410913 - DNA, 200 bp, Homo sapiens
gaacctcactgttaacttctctaccatagtgttaaataatacccactagacaggtctttgaggtgattcagggaactgccatatgcaaagggacccgcaaaagtgggttgctggctgggcacagtggttcaagcttgtaatcccagtgctttaggaggccaagccggaggattgcttgaagccaggagttcaaaaccagc

SEQ ID NO: 410914 - DNA, 450 bp, Homo sapiens
ctcataggacagtggcatttataagcctctgtcctatagtatttataagcttatttttgcagtgtattatttgtatacatcttttgtttcttctgtttcttaaagtcaaggaccttcttatacctctgcttatctttttcatagtgccttgtacattaatattttttcagtttaaacaatgttgaatgaacaaataaatgaatgggcatggcctctgaggtaatgtgtttcctctttcatctaaatctttgtttctcaatcctttctaactcatgccttcttttgaaaatgtaagtttccttacaccccttccacctttcagtatctcctcccaaaagaccaggcccgcagcccccatctcccttgatgggacaagctcgacttttcctacagatcctcaacagttgagattattttatcaagctccactttcatgtggtatgttataaa

SEQ ID NO: 410915 - DNA, 113 bp, Homo sapiens
cttggggcagcagacagactgcttcccacttgttggtgttgggtcattgtcatccctgatcaccaggaccctgtgtggctgtggcgtcctcctaaagcgacgagtgaatccag

SEQ ID NO: 410916 - DNA, 511 bp, Homo sapiens
gactgtgctatgatctaaagcctctcatatctgtgcagcaacctggggtgagtcactgtcactaacatggaacagatgccaggtagtccctttggacaaaaggatgaggcccatccatgtagaaagcatcttaatcagtgactgtcttatgggccctctttgtttcccatctgttttattatcagaatatataattttcccccaagttttcatcttgaatctctcaaacctacagaaaatttgaaatttgacagtaagcacctgtatatccttcctctagtttgtcttattgttgacattttatcatgtatgctttatagacaggatttttcctgaaccatttggaatatgcatatacttcatccctcagttcccagcatgtaccctaagaataaagattttcttctgcataattacaatgccataattactccaaagaaatttaacagatgatattattacatagcctgtattttataataaaatttccctcaaagtgccgttagccatt

SEQ ID NO: 410917 - DNA, 411 bp, Homo sapiens
ctgctaagactgaatcttgttcactttcctagtgccagcacctggtataggtcagtcacacagaaggtgctcagtaaataaataaatgttaactctgattaactcatactgattagaaactctgattggaaaataggtacaaatgaataactaaaaataggaaaaggaattgcttgttactttataaacacaatttgttcagggagagtatttttcaaaatgcaaggcaaaatggtgatgacaaggtcacagactctgggagacgctgaaaaaaaccaacctcccacatggcttgtgagatcagcagaggcaagagccaaatgcatgagtcatgcccagcaattctgaggcagggaccaatcagaggtatgtgctgtcctcgtcactgtccgactgaactcttcattcatt

SEQ ID NO: 410918 - DNA, 446 bp, Homo sapiens
ggtgggaatgacaactttggtcatggaggaaacttcagtggtcgtggtggctttggtggcagccatggtggtggtggatatggtggcagtggggatggctataatggatttggtaatgatggaagcaattttggaagtggtggaagctacaatgactttggcaattacaacagtcttcaaattttggacccatgaagggaggattggaggcagaacctctggcccctatggtggtggagaccaatacttagccaaaccatgaaaccaaggtggctatggctgttccagtagcagcagtagctatggcagtggcagaagcttagcaggataggagagccagagaagtgacagggaagctacaagttacaacagatttgtgaacccagcaaaacacagtggtggcatggcctagctgctacaaagaagacatgttttagacaagtact

SEQ ID NO: 410919 - DNA, 443 bp, Homo sapiens
gtgcctgcaatgtgagcactcgtgaaacaggggctctgggaggaatgtgtgagggtgggcaccgcgtcaggggcttggtgtcatgggctgaggtgggttggccaagactcatgcgctgaaatcctaactctcatgccccaggatgtggccggacttggagacagggtcactacaaaagcaactgagttgaaatgaagccgttggagtggccctaatttgatctgactggcatcctatgagaagaggaggttaaggcatagagaggcacgcaaagggacaactgactgaggacatagggagaagacgtcatccactagccaggaagggaggcctctggaggaaccagccctgtggacagctggatctcggacgtccagcccccgagaagggagaggatcatgtctgtggcttaagccacccatctgcggcatttgttatgaagc

SEQ ID NO: 410920 - DNA, 625 bp, Homo sapiens
  misc_feature (616)..(616): n is a, c, g, or t
  misc_feature (619)..(619): n is a, c, g, or t
ctttcagtttgtgaatgctctctggaaccccagaagataaaagaataagtaactatgacagtcatttgtaacaatcgtctctttcccaatacactaccagcaagccgacccacaccgcctccagtcttagtgccttcccggtcacgccctcccttctcctgaagggggcggaatctctaatccacccaagacccggttcctcgattcccatccttacgaccgaggaaaaaagagtaaattttcctattatagccttctctcgcaccttccccgcttcccaccagccgtctccactgtcctcaccgtccccatcctcatccatggcgaaatcttcgcccccagcctcgtgaagatctagcacgtccgccatctcgccttcgatcgagatctcgtctgtgccgctcagacactagagtctcaccctgatgtccaggctggagtgcaatcactcagtctcggctcactgcaacctccacctcctgggttcagatgctgttgactggggcaaagaataatgggagaaaaacagctgggtcctaaataacagagggaaaccaactttcaataaagtattcaacaactaatccacaaagcagataactgaaatgagtctcantgncgccca

SEQ ID NO: 410921 - DNA, 549 bp, Homo sapiens
  misc_feature (540)..(540): n is a, c, g, or t
  misc_feature (543)..(543): n is a, c, g, or t
ctttcagtttgtgaatgctctctggaaccccagaagataaaagaataagtaactatgacagtcatttgtaacaatcgtctctttcccaatacactaccagcaagccgacccacaccgcctccagtcttagtgccttcccggtcacgccctcccttctcctgaagggggcggaatctctaatccacccaagacccggttcctcgattcccatccttacgaccgaggaaaaaagagtaaattttcctattatagccttctctcgcaccttccccgcttcccaccagccgtctccactgtcctcaccgtccccatcctcatccatggcgaaatcttcgcccccagcctcgtgaagatctagcacgtccgccatctcgccttcgatcgagatctcgtctgtgccgctcagacactagatgctgttgactggggcaaagaataatgggagaaaaacagctgggtcctaaataacagagggaaaccaactttcaataaagtattcaacaactaatccacaaagcagataactgaaatgagtctcantgncgccca

SEQ ID NO: 410922 - DNA, 388 bp, Homo sapiens
  misc_feature (379)..(379): n is a, c, g, or t
  misc_feature (382)..(382): n is a, c, g, or t
actgtcgcagaggggaaaggtcgccagtcaagctgaccaatcaaaggctaactctaaatccctccctctgcacggtaaaaacacgcaaattggggcgggcctagtgcggaaagataccggaagtgtttctgtggccatcttgaacagatcgcaagctaaatcatccatcttaggagagtctcaccctgatgtccaggctggagtgcaatcactcagtctcggctcactgcaacctccacctcctgggttcagatgctgttgactggggcaaagaataatgggagaaaaacagctgggtcctaaataacagagggaaaccaactttcaataaagtattcaacaactaatccacaaagcagataactgaaatgagtctcantgncgccca

SEQ ID NO: 410923 - DNA, 337 bp, Homo sapiens
tgtggccatcttgaacagatcgcaagctaaatcatccatcttaggaggtacagactacagggggccgtggcttcctcttaaccgcggcagctgctgataaatactgtactattaacagtgaggcccggcgtaatttccttattagagggcttctttacgtctcttcatcccaaactgggaaatggtaattgaagaaacccttttctttcaaaaatcccaggcctgtaccttgtctttaggcagcgtggtgtatgataggagcgtttttaaaaaatagtttgatcagcagtgagggcataaagagctgcttctggaacctgcagcaccaaatttctct

SEQ ID NO: 410924 - DNA, 626 bp, Homo sapiens
agggaaaccaactttcaataaagtattcaacaactaatccacaaagcagataactgaagtaatttagtatatgtaattacatctttttttttttttttttgaggcggattcttgctctgttacccaggctggagtacaatggcacaatctcagctcattgcaacctctgcctcccaggttcaagcaattctcctgcctcggcctcccgagtagctgggattacaggcgcccaccactgcgcccagctaacttttgtatttttagtagagatggggttttgccatgttagccaggctggtttcaaactcctggcctcagatgatccgcctgcctcagcctcccaaagtgctgggattacaggcatgagccactgcacctggcctgtaattacatcttaattaaatgcaaatagaacagatacttggtctgactattaatgaatttgtggagaggaaggaagatggcggtgttaatttctaagatgtaattaaattaagtcaacttgggttctaatcttggcgtgaccaattactagctatatcatgttaagcaacattccacttctgtgtttttagtctcctcatctgtaaaataggggtaataatagtacttacacctcataagat

SEQ ID NO: 410925 - DNA, 449 bp, Homo sapiens
  misc_feature (440)..(440): n is a, c, g, or t
  misc_feature (443)..(443): n is a, c, g, or t
actgtcgcagaggggaaaggtcgccagtcaagctgaccaatcaaaggctaactctaaatccctccctctgcacggtaaaaacacgcaaattggggcgggcctagtgcggaaagataccggaagtgtttctgtggccatcttgaacagatcgcaagctaaatcatccatcttaggaggtacagactacagggggccgtggcttcctcttaaccgcggcagctgctgataaatactgtactattaacagtgaggcccggcgtaatttccttattagagggcttctttacgtctcttcatcccaaactgggaaatgatgctgttgactggggcaaagaataatgggagaaaaacagctgggtcctaaataacagagggaaaccaactttcaataaagtattcaacaactaatccacaaagcagataactgaaatgagtctcantgncgccca

SEQ ID NO: 410926 - DNA, 713 bp, Homo sapiens
catgatgggttggaggtacctgtgagtcacatccaggtggatgtgtcctgtgggcagtgggacgcgagtctgaagctcaggcaagaggctagagttacatctttggagtcatcagcctaatggaggactgtggcatccaggtgccaaaagctagggaaacggctctggagagagaggggctttcttaattgacctcttgggccactaagatgtggttacatattttctctcacatctcctagaacgtttgcaaaacaattcccagtcctatgatcatttctcccttcttctgagaactaattatatatggcacttaatatctattcacatgtagcactcatggtgaggtgttttttttgtttgtttgtttttgttttttttttggttatcatctattgctgctgcacaaattaccagatttcataattggtttaaataagcctccaatttgtttatatttattaacatgtatgattttgtgcatgtagaataagcttggcatagaaatggcctaaatgctcctgtagctcttcattcctttgtcgttctcactctccatgccagtatgtctcatttctagatcccatagaactttcaattgaaagtaataaccaaggcaactcactttccatgagtaatacaccacacttctagaaatcagcctatattactgtcacactggggattaagtaaaaaaagagaaagaaggatgg

SEQ ID NO: 410927 - DNA, 379 bp, Homo sapiens
cccccgtttaaaaagatttattggaaatatcaacaaccttggcttgaatctcatagaccagagcttaatccatggccacactttggtgcaaggaaggctaggaatagtctattatttatttctttatttatttagagatggagccacatttacttttgttcaggctggagtgcagtagaatgatcttggctcactgcaacctctgcctcctggcttcaagcgattctcctgtctcagcctggccaacatggtgaaacctcatttctactaaaatacaaaaatgagctgggcgtggtggtgggtccctctactcccagctactctggaggctgaggcagcaggatcacttgaacccaggaggtggaggttgcagagagcc

SEQ ID NO: 410928 - DNA, 731 bp, Homo sapiens
cagaccctgatttgcaacttgtaatgtaaatcaactcaactgcatcatgtacttaccagccaccttctcccaactgtggccggggccgagaagcagcatgttctgtccatctgtaaaaggccttctttctctcttaagacgtcacaactggttgttactgagaactttagaaaaacgactagatcgtttggctctttctgggccttccacctacactccatgccctctctcctcccaagaaaacacgaattaaaatacagggagtatcaaccgcatcctgccaacacctcataagactccaaggctttaccgagatcttccaccttccccgggataaatgaagacaagtgcttcctagaatctttatggtgatggaaaagatatactaaaagaagacagatcagtctctctcctgataagaagagtcaccaagaggaacatctgcaacaactagatgctgctacaaagagaccaatcaacaactgctcagcagagatacagatctgaagcacagaagtgcaatagaccttcctgatgccttcgccaggagcatggaattcttcccagagtcacagaagatggcacagcctggggacaattgggaatcacctggaggatggcagacaacacgaacctgcaagtaatcatccgaccaacttcctctactgcttgggaattgcaaggttgtataatcttgggaggtcacttcaactatacaattggactaagaa

SEQ ID NO: 410929 - DNA, 751 bp, Homo sapiens
cagaccctgatttgcaacttgtaatgtaaatcaactcaactgcatcatgtacttaccagccaccttctcccaactgtggccggggccgagaagcagcatgttctgtccatctgtaaaaggccttctttctctcttaagacgtcacaactggttgttactgagaactttagaaaaacgactagatcgtttggctctttctgggccttccacctacactccatgccctctctcctcccaagaaaacacgaattaaaatacagggagtatcaaccgcatcctgccaacacctcataagactccaaggctttaccgagatcttccaccttccccgggataaatgaagacaagtgcttcctagaatctttatggtgatggaaaagatatactaaaagaagacagatcagtctctctcctgataagaagagtcaccaagaggaacatctgcaacaactagatgctgctacaaagagaccaatcaacaactgctcagcagagatacagatctgaagcacagaagtgcaatagaccttcctgatgccttcgccaggagcatggaattcttcccagagtcacagaagatggcacagcctggggacaattgggaatcacctggaggatggcagacaacacgaacctgcaagtaatcatccgaccaacttcctctactgcttgggaattgcaggcggaggttgcagcgagctgagattgcgccactgcactccagtttggtgacagaacaagactccgtctc

SEQ ID NO: 410930 - DNA, 350 bp, Homo sapiens
gcatatcagaaacagaaatttgttgaggataattttggatattcagcagtggctgtgaaattggatttgaattaccgggatacatgcatgcttcttggttacttccaggatagctgaaagaactctgagatgttgtggtaatttggtttattaaagactggtgcaaaaaaggtggctggcttttaggatacagtggtggtaatgtagcactctttggtttttcattccaattcattgtcggtttgatatagtagcagtgtattacaagtcagttataagtcagttacaagtcagttgtctgaatgtcaggaatctcaacatgtaggtgggtgactaactgacttgtaata

SEQ ID NO: 410931 - DNA, 665 bp, Homo sapiens
gcatatcagaaacagaaatttgttgaggataattttggatattcagcagtggctgtgaaattggatttgaattaccgggatacatgcatgcttcttggttacttccaggatagctgaaagaactctgagatgttgtggtaatttggtttattaaagactggtgcaaaaaaggtggctggcttttaggatacagtggtggtaatgtagcactctttggtttttcattccaattcattgtcggtttgatatagtagcagtgtattacaagtcagttataagtcagttacaagtcagttgtctgaatgtcaggaatctgtaagaaataaagatattttattaaaatgctgttttgcctagatagaatatctaagaaaattagtagctgactgtccatcctaattactgaatcttcagagcagcctcatctttaatttgggaagaagaggagcaatagaggatacaacaataaataaggcaagtgtcaatgaaatttctaacgtgtttaacagaaattcattccacacaatgacagctagctttttgttacatttaaatgccaatcaccttctgtttttacttatttttaacagactttcttgtaagtaatccatgctaactgcattttttaaaaaagctaacatgacaataaaaatgagaatttaaaa

SEQ ID NO: 410932 - DNA, 579 bp, Homo sapiens
ctgtctgcccgtggcctgtctgcccgtggcctgtctgcgcacagctattaaaagttcaataaacgtggtggcagcagctgaactggctaccacaggacgcagctggggtctggacgtgggcctgggggctggtggaaggcacgtgtgttgaggcgtgtactcagggcctgcctacttccccaggcctacggggacagatgtagctccccaggaaataccacaggcagaccccggccggcaagctgccccaagaagcagtgcgcctcccaaaatcagaagcagctaagctgacccccacctcatgtgaaagagccaggcaccagggagagggcacccacccagtctcctaatcataacagacattcacagcaacaccacgaaaaagaaactactgctctgacctggaaaaatgaaatttaaaacagaaaacacacaggttgtaactaaaaggcagacggaccaggtgcggtggttcatgcctgtaatcccaacaccttggaaggccgaggcaggcggatgacatgaggtcaggagttcaagaccagcctggccagcatggtgaaaccccatccctactaa

SEQ ID NO: 410933 - DNA, 1183 bp, Homo sapiens
gctttctctgatttcccctttccacaggtccaagttaactgccttgtctaggtcctcccatggccctctgaaggcctcctttcatagcaccatgtctgagtatactgtaataacacgcattgctctgtaatagcctgtttacttacctattgccaagtaatctatcaagtcttataaagggcggggctgcttttgttctagtcatttgtatctcttagtacccaatatagtgtttggcatatagaaaatacccaacaaggccagtcgcagtggctcatacctgtaatccgagcactttggtaggctgaggtgggcggatcacttgaggtcaggagtttgagaccagcctggccaacatggtgaaaccctgtctctactaaaaatacaaaaattagccaggcgtggtggcgggtgcctgtagtcccagctacttgggaggctgaggcaggagaatcacttgaactggggaggtggaggttgcagtgagctgagatcactccactgcactccagcctgggtgacagagtgagactccatcttaaaaaaaaaaaagactccatcttaaaaaaaaaaaaaaagaaaaaagaaagaaaatacccaataagtagttcctgaatgaatagatgagaatgctgtttagaaggttcatgaattggaaaccgtgattgctagggaggctttgagttgatggtattgtgttgaaccatgtgttacccaggatcaatttagattttacactttgttttctctgttcctttttatagtaattttctgtatgtggtgttttccccccatgagattgtataccatttctcagcgagaactgtgtgtaatgcttggtggctccctcatggtgccttgcatggaattggacttcgtttcagtggatctgatcccagttatgttaatgctcgatggagctaagtcttatctcgaagcagtccatgtcttcatcagctggccctgcctccatgccctgcacagaccatgccactctggagaggtagtttccctgtggcttattagtcttatgttccagtgtgctggccaagtatgagagacatcagtggtatgagagagtctctctcattcaaacttcgtaggttttgtagctgggactgaccagtgctgacaggaaatagaggcatttattaaaagccagagatttttcaagttgcaggaa

SEQ ID NO: 410934 - DNA, 338 bp, Homo sapiens
cactgcaaccactgcctcccgggctcaagcaattctcctgcctcagcctcccgagtagctgggattacaggggtgtgccaccatgcccggctaatttttgtatttttagcagagatggggtttcaccatgttggccaggctggtcttgaactcctaaccttaggtaatccacctgcctcggcctcccaaagtgctgggattacaggtgtgagccaccgtgcccgacctaactaacatcttctataaccatggaagagtcactgaaactaagaaattcactctagtacaataccattaactatactacacaatgaatttggatttcaccagtgtttcca

SEQ ID NO: 410935 - DNA, 343 bp, Homo sapiens
agcccctcccgctggagtcttctccgaggcgttcggtccggccgaggagcccctccccgctgggagtcttctccgaggcgttcgggtccggccccgatgggcgtctccttgggacaggcagcctccctcaggccgggcgtccccagacgcgccgcgatcaccgtgccccgctcccaccgtgcggatcaccccgagcctgagcgccggcgccccgggaccccctggccttgaccctgctcatctcgtccctgtctcgcccactccctactcatccacagtgcctagccctggcaccgagtgcgttctgagtactcaataaatagttaactaagtgaaaaaccta

SEQ ID NO: 410936 - DNA, 599 bp, Homo sapiens
accccctccatcactgtgaccctccctggtcttagaagataggaagcaaataaaggcagacccagtaatcactttggttttattgcttatgattgtctttcttctttttgttccttgagtgatctttttcatatcttcacctccttcaggacaccaggtaggaaatggttcactgggtagcttatggagccacaggtttcgtgaggagttagaagggtttatagcattactttaaccatattttcattcattccctatcagttagttgattacctgaaaaccaacccagactggttcaagcagaagaagaaaatgtattggcctatgtggttgaacaatctaggggtagattccggcctcaggtgaggctttacccagggctcagctgagatgccccaaaaccagtttttccagtggaaaaaaaaaaagacagcttccttgatgggccacccaaaggtctggaattgagtttagttgcccctgactgggttcccttggcccctgtgctcccctgaaacagttactgtctgagaggattggacaaattgagagattcagaagactcttgggaaagtagacagggtagttagtgaagctgg

SEQ ID NO: 410937 - DNA, 774 bp, Homo sapiens
atgaccccaacaccggcaggaggcatggcgggtcctgcccatgcatcccccactccatctttcccagtagaagaaactgctgctaatgagaggaatggcactgggggagggaggccagtgggtaatggcgggttgagactgcattttgcacagtttcactgcactttttctttggagatagtgaaggtgtcaatgtcagtcaaagctgggaagtgctgtgtagtaatgtctccccacatccctgctctttccaattctctcgagcagctcatccactgcctatgtgtcacacagactttcttctgtttaaatcagtgaacagatgtacattcctgtcacccaaggtgatatgccaggggagatgagaatttttttttttttttaggtatttctttataattaaacacagtgttcccagagatgggccagggacatccttggaaattttccacttacttacaagtgaggagagcaaattccccactgtctcagccactggaagagctactccgtccacatgcccattagccgacccctgcctcccctccgctggctgctgctggaggcaggtgcagttacactgaaggacgtggtcatgtcagtgggactcaggctcctgtatgggtctctgcgtgcgcacgtcctgctttgcaaacgccacagtgatgccctgcagaaaagctgtggcagaatccccttgatagtcccagcactcttcacatcactctcccatcaccagacaaccacatcagagcctgactgacgatgagatgc

SEQ ID NO: 410938 - DNA, 511 bp, Homo sapiens
actcctcacttccaaatcctcactatgctaatcctaaactattatgtcatgatttttacctaaacaagaccctgcatggaaagatcctctttatacaatctttcatttttttgtcctggctttaaaatgcaaagcccatatccttggaattccctctgtcttgggcaaagtgtgacagttggccaccctactccaaaatctcataattttcccaccttgcccctctagagactatcaatctctgttgaggtggttctctctttccagggtgagcaataaactccttgccagagctttccattgggggaggagggtttgaactactgccagagacaaacagatgtaaactagatgcaggagtttggaaattgagcagggtttgcagtctggaaaattgctccacaagagactgtcgttgaacgagtagtcctgagtgagtggtctaagagaacgtcagagtgaaagaaaatgcagcccacctgggtcagctgaaaaggtagagaataaaagg

SEQ ID NO: 410939 - DNA, 456 bp, Homo sapiens
atatattagttagctccttagttttattttcaaatttggtgattatgctgtgattgcttatccaaaatcaaagagttagtctgattattttcatctggacttagggaagtcaagacgtcttagcttactgtctttttatttggtcacccatgggtgctaaatgcttcttagtgcaagtgattagaaagtaaatatctggaccgagtgtggtggctcatgcctgtaattccagcactttgggaggccgaggacggcagatcactacctgaggtcagaagtttgagatcagcctggccaacatggcaaaacctcgtctctactaaaaatacaaaaattagccatcgtggtggcaaggcgcctgtaagtcccagctactcaggaggctgaggcgtgagaatcgctttatcctgggaggcagaggttgcctgagggatagcacgagactgtttaaaaaaa

SEQ ID NO: 410940 - DNA, 443 bp, Homo sapiens
ttacacagaacagattctagcagtgaatctaattgccacttcattttgaattgataagcgtaaacaatgctttgagatatctgctcaagcagttcataactgatgaaaatatgtgcagtttctattagcatcaaagtcgcaggtactgcgaatagtgtgatttgttacatttataattgaaggaaatgctaaatttcagtttgaggttagtgaagacaatagtgtagtttttctcctgttctaatttatgaccttcctgaatcctgttaatttgagggttccatttagtttaagaatctcagaatataggagagagcttctgttatttttggaaatgaggtgataatggaagtacctcatctgaggcttaaaactttaaagtggatacatagttttttgtttggagggttttgttttgccacagtagttttattaaaaaaaaa

SEQ ID NO: 410941 - DNA, 344 bp, Homo sapiens
actataaatcttgcttagttttatttgattctcaaaatgtggtccatggaatagcttcattagagtcacacaggatactctgtaaagtcaactctaacaggaacccaatcatactttcccgtacactgaagtttgagaaccataaccttattcagagtatctcatctcaattccatataaatgctcttgtaatatttgaagcaattactatgttctctttcctgagtcttctctagggaaaatatacctagctaactcaatgaataatcccttttctacactaataattttatataatggctcctctcattataaatttataaaatacagatataaaaaataaa

SEQ ID NO: 410942 - DNA, 455 bp, Homo sapiens
ccaacagatattctagcatataagaaatgtgatgctctctgtacattgaagagttggtctaatatttggcctggtggatacagaaattgcctgtctgctccgctctggttgaagaaaccagtccgactgtctctgaggctatggagcagtccatcaagaatgaaagccctcggctggcacgttggctcacacctgtaataccagcgctttgggaggctgaggcaggtggatcacttgaagtcacgaattcgacaccagcatggccaacatggtgaaaccctctctctacagaaaatagaaaaattagctgggcctagtgacgtgtgcctgtaatcccagctactcaggaggctgaggcaggagaatcacttgatcctgggaggcagagcttgcagtggggagctgagatcacaccactgccttccagcctgggcgacagagtgagactctctcca

SEQ ID NO: 410943 - DNA, 360 bp, Homo sapiens
cctgctcccctctttttagatgagtaaccattcattttcaatctgtaccccttttgaaagcatcctgaacctttgggactcctttgaaaaaacacctttcatttttcctttctcccccctcagttctctcttcactgataggcaattgtgtctccgtactacgggacactcccgtcagatgcatcctccaaactgggaagagtttaaaaccttaaactggtcagcttaggattgggctcaggggaagggaacccagaagcccaacatggcagctaaagggtagttttttttttttttttttttttttttttttttgccggttgggcttttggcctccctctccttgtgcaaactgataaa

SEQ ID NO: 410944 - DNA, 404 bp, Homo sapiens
aaccacaagcacagaggccctgcggcaggaacatgcactccacagagagctttgctgtggaggtcgtttatgtatttcactgctttttttaaaaaggagttgaagacggggcatggtggctcacacctgtaatcccaacactttgggaatctgaggcgggaggatcacttgagtccaggagtttgagaccagcctgggcaacacaagaccctgtctctacaaataatttttaaaaattagccaggcatggtagcacacacgtgtggtcccagctactcaagaggtggaggcaggaagatcacttgagcctgggatgtcaaggctgcagtgagctgtgattgtgccaccacactcccacactccagcctgggtaacagtgagaccatgtctaggaaaaaaaaaaa

SEQ ID NO: 410945 - DNA, 406 bp, Homo sapiens
cctccgacatggggattgagaatgctccggctatgaaaagcatggggtctgtctcaggacacagctcccacagccctaagtgggcaaatgccccaaagtgtcaagcatgagccacctctgaaggagcatttactatctcaagacctttgggcatgttgtcccttctacctggaatacccttccttcaaaactcagagccaaaagcaaaaagcgttcgctgatcgcagagggggagagggatgtgggagggcttggggcgcagaattagttgctacctcctctgggcgttcacaggccaaatttccttggtgtggcacctggcattctgtgattgtgcctgtttccctgtggtctggtcctgtgcctattggcccaattacactgggagtcatacagatctgcaaat

SEQ ID NO: 410946 - DNA, 496 bp, Homo sapiens
tcttagaagtgagaggcccagaacactctactttatgcaggaatagcagagatgactcatggttgggaagacactagaattcagccaggagaatatcattaaaagagggagaagggaaaacagactttttgtgtggtacaaaaacaaaaccctctgtatcattatgtgaacaacggtgcaaaaaagaggagacacagtttacccatgggtagctaactatgatagtgaaagttgccttgaaccttgttttagaaaaatggcaagtgtgggtctcactcttctagttcctgacttctctctctctctctctcgtttctctttttttttttttctctctctctctctctcacacacacacccatcttgggccaggtttgtaaagcctcatgggaaatggaacacggaagagtcttctgggaggttttaaaatttaattttagtcagatttagtaagatttcttcatacaaaacaaaacaaaaattctctaaaaaaaat

SEQ ID NO: 410947 - DNA, 297 bp, Homo sapiens
ttacaggtgtgagccaccgtgcccagccttgttgtattagtttttatacattttaattttaaagattccaatctaatgttttcttgattaaaattatggaaatatccaaattagatacagttagatgatggtagatgagattattgttatcagttaccattttaaatgctaagtattatggtaatcctttttagaaagaaatctttagaattagaattctagatggttcccaaatagctactagcattaatttttcattttcatctaataaagataggtagtaacgtcaaactatag

SEQ ID NO: 410948 - DNA, 354 bp, Homo sapiens
ctcatcacatatgtgcatcagagtgcagggatgcacataggaatcacaaatcacacacttgccatcacatttttcacacagtcttccgatagcaataccagtctgcttgcagcaaaagatcaaatcgggatgacgtttagccatagttcccaacgaagccagccaccggacgcttcaggccaatttttgtttatacttcagtgtatctgttattcatgtctctataaaagaaaacttaaaagaactcttgggttctactttatttcttccccatgtattcctttcatgtgttctataacaacagttgatgtaaaacaatttgtgtcaacaagaatcttaactgattaaaaggga

SEQ ID NO: 410949 - DNA, 637 bp, Homo sapiens
aggagactggataaacaaagtataatgtataatggaatatgttgtagcagttaaaataaataaagaaaagctacatgtatcattatagtctacgtagtatcaacttggataaacctcaaaagtcattagtagtgagcaaaaaaagcaggttgcagaaggatacatacaatatgataccagttatatacaatgtttatggttcaacttttccagtctggtttattgagctacaatttgcatacagtgaaattgactagtctttgtgtacagttttgtgagtctggcagaatgcatacctttaggtagacatcatcacaatcaagatataaaagggttccatcattccccaaaattgcacactgccctattgtagtcaagtcttacccccacctcacatctcctgtaatcatggagcacatggcattttgagtctgtcttcttccacttagcataatgcctttgagattcattcatgttgttgagtatctcaacagctttttttttaactgctgaatagtagtctactgtatggatgtaccaatttatccattctgtagttgaagtgcatttgacttgtttgtactttggggcaattataaataaactgaccataaatatttgtgaaccgaaaaaaaaa

SEQ ID NO: 410950 - DNA, 472 bp, Homo sapiens
cacagcggacagtgcgggcgcctccggtgtccagaggacaaagaagccccaccggccggggtgggggcgagggcggagtaggaaggagcccggccgcggaggggaggagggcgatgaagtcaccgcggggccgcctcacccagtcccgggggtgggggatccctcccgctccgcacggccccccgccggctcggccccgcaggtcgaggccccggcccgcactacccgctcgcaggaaagcggaccccgctgcggcccgggagtcccggaggtccgagttgcccgagtccccggggcccagagagggcgggggcgcctggctcacacagcaggacccacatccccgggccccacccacttcccacggcccccagctctggactcgcggggacagcgccgcggatggcctgggctcgggccccgccccgccgtccaaagtttggggacctcgacccaacttcgccaggcgccc

SEQ ID NO: 410951 - DNA, 439 bp, Homo sapiens
attattatcctcacattactcgttaaaaagctgaaataaaggcagtaaagtaatcgcttgaagccatgtgtttactaaggcttcagtccttatgttatctcagaatttggtatggcttaggtattattttgatcaagtttctcaaattttatgctacatgtatacgaggtgttagagttccacggggaaatggaatgtactagacgaagttttctttctcagctatttctcttctttttattatgaatattctgaaattttcatcatttccattttaagacttactttcgtctttttgtcctatatgtgaaatttctgtaccattttacagtttaccaaatgccatatatatgtagcagtttcatactcattctttttttttttttgatacagaatccagcctgggtaacaagagagaaactccatctccaaaaaaaaa

SEQ ID NO: 410952 - DNA, 452 bp, Homo sapiens
cagaatcaagaaatactctatttcaccagaggaatccttgcaaatacattttactccactatgcaaaatcctgtggaaccagttttttatacatatttttagctgaaagatcaaggaaatgtgtcacagttggggacctgtatcataattatctctgtaggttctacagcatccagcatgatgtccaaagtagcgagattggaaaatgccaaagcaattggggaaaaaaatactgttttctctgaaatgaagactcctcaagatcctgttgctggaatgagtattggactcttcggtctacttctacagtcaccagtacatctggcatacactatgatgcccaacagtaggaagatgaaagaaatgtagatgttggcatttctaaaagagatgttgtatcttttttcctacttaatagactattaggctataaatctcaatcttggccagca

SEQ ID NO: 410953 - DNA, 408 bp, Homo sapiens
agtacagcatccagtagtatttcacaccggttacactagacccaattcactttagtcatcatttaatttaatttaccactttttactttgttctttattgatgctctagatctaatgactatcaatcttgtattttcttcttggtttctcctgataggaaaatgccaaagcaattggggaaaaaaatactgttttctctgaaatgaagactcctcaagatcctgttgctggaatgagtattggactcttcggtctacttctacagtcaccagtacatctggcatacactatgatgcccaacagtaggaagatgaaagaaatgtagatgttggcatttctaaaagagatgttgtatcttttttcctacttaatagactattaggctataaatctcaatcttggccagca

SEQ ID NO: 410954 - DNA, 391 bp, Homo sapiens
cctctttctgaattactaaaccactgcctgagtttacttgtactaagcccctactgtgacagacccaatacgaagtactttacataaatgttcttccttacacaaaatgcagtatccggaaaacaggacttcaagtaatggcagcatgaaaacgatagtgaatgcactctacaaaaaagaaggggtaatcgcagcaactttgggaggccgaaggcaggtggatcacaaggtcaagagatatagatcatcctggtcaacatggtgaaaccccgtgcctactaaaaatacaaaaattagctggacatggtggtgcgcatctgtagtcccagctaccggagaggctgaggcaggacaatcacttgaagccaggaggcagaggttacagtgagcc

SEQ ID NO: 410955 - DNA, 572 bp, Homo sapiens
tgaactatagaaatagctacatgtcccttttcatgttgtttctttgccaggtaaactctttacattcttcttttcctgtttaattctcaccaaccaaggttcaccgtaggcaacatctattccttaaagctctcacccaccctcccagcatgactgaggcctcttgactgtgctcacacagcaactgtatcatgttcaataaatgaccttctgtgggatggtgtaatgtgaatagacacagatgatcaacttaacagtaattcttcaccttgctgttcccctaatgccaagttaaattagaatgttacagacatacattgtattttcaaggttatattagacatattgtttcatcaggtacataaactaatcatcttcaaaagtttctctggtaaggtgtacacacgattaaaagaaatgtttggacaacattcaccattgctataatttgttcaggcaacttctaaattttcttttctaattccttgctttgtattgcaccactaatttacctaattttactccaatactttagtttattgagctcactgtctttatcacaccccatccta

SEQ ID NO: 410956 - DNA, 486 bp, Homo sapiens
acctatgtttgaaaatggaattacagactttaaaggttatttaaagatttaaacaacttaaagattatttcatgtagctatcttatttaatagatgaagtccagggagatgaaatgacttattcaaggtagccaggactagaaacatgtcgtttaccctagatccaatgcaatgaagtttagagagttctttcctctttttccagctgcacttgctgtcgttatattagttttaacaatttgatatatcatttaacctggactgttccttccagccatgtaaattagttatgtatgacatcaaatagtccatccttccttcttagtgtgtgttccaaattcagtgcaaagctggaactaggagcttcttccaatacaattgagtggcaactgaggtcttccagcatttctaagaatttcagttctaaaatgaagtcccagcattttgggatgctgaggtggacggattgctcaagcccaggagttt

SEQ ID NO: 410957 - DNA, 681 bp, Homo sapiens
gggctcaagcaatctgcttgcctcagcctcaaagtgctgggattacagatgtgagccactgcgcccagcctccaatatctttttgtatattctttcctttcaaaactttttttatgttctatcacttatacttgcatcttcagtagtatcatattgtctccattgttttgatttatgctccacctcctcttgcacagtccttaataattattgtgaaaatatatatgcttaagaaaataattgtaatggtagagaatggtgagaagtaaaataaaattacctcattcctttgcaatatattcttctcagaagtagccatgtataaactctgtgtctgcataaactctatcataagtgttgttctgtaacttttacacataaagtacaattattccatgtcagtatctgacaatttacctcatttaaaaaattgctacttagtattttactggttagtaggatattatcccttttttgttaaccccaccgaccagcccccacacacatgcacacacattcataaagtgtagaaaggtaagcactaaattatcaaatgtggtcccttctgaggactaagattggtgcaggaattttttttaatttcatgcacttttgatctttggagttgttgtaatgaataataaatattaaatgtataattggaaatttttaaaaagtaac

SEQ ID NO: 410958 - DNA, 412 bp, Homo sapiens
gcccaagacgctgggccactgggacccgagcgcgcgaccccagccggaattcggagctaaggctgccgcgctccggcaaaacgcgcttgatgaggtcgttaaagatttccccctctggaaaatcgccagggaaaagtggtgaaaaacgaagccgggagggccctagtctcgggagtctaggaggagcccaacccccggacctaatgccgcagggagaaaagacagagcagcgagcgcaaataccatcctagctccaataaaagggaacgacttttaccgcaggaagaacctaggcctggaagccacgcgagatctgggggtcgggatcacgttgcgttgcctagcgacagcagggacgctcgtgggaccccaggctaaaccccgctgtagccttaaatctcctaccatggag

SEQ ID NO: 410959 - DNA, 362 bp, Homo sapiens
tggagaagttagggctggtaccaccatggaattaggtggagaggaagagagaatgtgtactcatcaagaaaaatggatagtccagcatgcagacatggaaatgccctcttcaccgtccttcctttcctaagaaattctgggttctaggccaggtgcagtggctcacacctgcaatctcagcactctgaggccaaggcatgtgggacacttgaggtcaggagttcaagaccaggctgggcaacatggcaagaccccatctctacaaaaaaattaaaaaattagccaggcgaggtagtgcacacctgtagtcccagctgctaggaagactgaggtgggaagatgacttgagcccaggagtttga

SEQ ID NO: 410960 - DNA, 484 bp, Homo sapiens
gcacgagactccatctctatcaaaatataaaaaatagccagatgtggtggcaccatgcctgtggtttcagctacttgggagggtgaggtgggaggatcgcttgagcccagaaggcagtggcttgcagtgagcctagatcgagccactgtacttcagtctgggtgacagagtgagaccccatctcgaaagaagaaaatgtgttataagtatagagagctttgcattcaacggaaaattcactttaaacaataacccaatttacaaaaactgtgtatttagaaaaaaaatttttttaagttgaaatcaactgattggaaaaaaaatgctacatatcaaaacttacaggaaggtgaggaacctgaagctcagctatgtgctaagtggcttgcccaaagtcatataaggggtaaaggagggccagaactagagtgctgtctgtctccagagtgttcagaataaatgtatgtcaatgtccaaaaaaaaa

SEQ ID NO: 410961 - DNA, 702 bp, Homo sapiens
agtagggaaaaggaaggttttagagttcacctccactccttcccctggctaacactctttacactcttctgccttcccttgagataattaaaatagactgtacaccggccctagtcggtgcccattccccctaactcttcactcaactacgtgtgtagtccgagggagtgaggaccccgggtccaagagctcaatcccggccccgccccgtcggcccaggccccggggctgggaggagaggatgccttcggaggcgcagaatccgaaaagatgtggttggagctggaagctgttatcctcagcaaactaatgcaggaggagaaaaccaaatactgcaagttctcacttataagtgggaactgaatgatgagaacatttggacatgaagctgggcagagaaatcgagctgcaaaatgacctacagatattacagttttattcttggaaaatggaggttgtctattagtgtgatggtaacaaccaactaataaaatttggagactagactgcttgtcatgtctggggttcactggaaatcaatgattcactggaacaattctcctgtcaaaaaaaatgtgaggtttgtaacttgccctaagtataacaagggatatattttaacaaaggatgtattttttcttaagaagcaaccatttctcagcttatacataatagcaataataaagtctttgaccctattaa

SEQ ID NO: 410962 - DNA, 572 bp, Homo sapiens
gtggttggagctggaagctgttatcctcagcaaactaatgcaggagaaaaccaaatactgcaagttctcacttataagtgggaactgaatgatgagaacatttggacatgatttttctgcatccctttaagtctatgtgtgtgatttcatgtgagatggatttcttgaagacagcttgccaatgggtcttggaatttaatcgaccttactaccctgtgccatttaattggggcatttggcctgtttaccttcaagaagctgggcagagaaatcgagctgcaaaatgacctacagatattacagttttattcttggaaaatggaggttgtctattagtgtgatggtaacaaccaactaataaaatttggagactagactgcttgtcatgtctggggttcactggaaatcaatgattcactggaacaattctcctgtcaaaaaaaatgtgaggtttgtaacttgccctaagtataacaagggatatattttaacaaaggatgtattttttcttaagaagcaaccatttctcagcttatacataatagcaataataaagtctttgaccctattaa

SEQ ID NO: 410963 - DNA, 480 bp, Homo sapiens
tagcaaatcaagtttcatcttatatacttttaatttgtaatataccaaagtcatttttgcaatactatattatgtactttcaagtatataattactgcttctttaaatacaaatgatcaagatattcagattattatgagttttttttggttatcatctattgctgctgcacaaattaccagatttcataattggtttaaataagcctccaatttgtttatatttattaacatgtatgattttgtgcatgtagaataagcttggcatagaaatggcctaaatgctcctgtagctcttcattcctttgtcgttctcactctccatgccagtatgtctcatttctagatcccatagaactttcaattgaaagtaataaccaaggcaactcactttccatgagtaatacaccacacttctagaaatcagcctatattactgtcacactggggattaagtaaaaaaaagagaaagaaggatggg

SEQ ID NO: 410964 - DNA, 518 bp, Homo sapiens
gcagagatggtagcattggatacatactacttacattgcattttttctatcacctatgtgttccatgtcagtacaaataaatctgccttgggattttttttattattattgttattgggatttttgtttgtttttgttttgcctcgttgtttttaagggctggagagttttctattatttgtttaaccatagttaaccagtcccctgttaataaacatcactgctttgaactcagtggttctttacctgggcggattttgccacccgggatcatttggcaatatctgaagacagaaaagggtggctgggcacggaggttcacgccttgggaggccgaggcaggcagatcactcaaggtcaggagttcaaaaccagcctggccaacatggtgaaaccctgtctctactgaaaatacaaaaattacccaggcatggtggtgcacgcctgtagtcccagctactcgggaagctgaggcaggggaatcacttgaacctgggagatggaggttgtagtgagcc

SEQ ID NO: 410965 - DNA, 527 bp, Homo sapiens
aacacaatctagctgatgcctgcaatcccagccctttggaaagcgaggtgggtggattgcttgaagctacgagtttgacactagcctgggcaacagggtacaaccgtgtctctacaaaaaaaaaaaaaaaaattaatggggcatggtgttacacaactggagtcccaagttctctggaggatgaggggagaggataatttgaacccaggaggtctaatctacagggaactgtgagggtgccactgtattcagcctgggtgacagagcaagaccctgtctcaaaaaaatacaaaagttcagagcaaattaagcatagactgtgatcattaaatattccatacattggtaatgagtaatgttgtacactattagaccatggttatttatgaggataaaacctcaaaacctttttgaaccacaagttcttcaatgcagctagcacataatcataaaatgtaatacaattctaataattgactaaccccttgaattgataaacgatgtacagactaacatacaaaaaaaaa

SEQ ID NO: 410966 - DNA, 386 bp, Homo sapiens
gctctacaaaaaataaaataaaatgaaataaaatttaaaaattagctgggtttggtggtgtgtgcctgtagtcccagctactgggaggctgaggtgagaggatcactggagcccaggaggtgaaggctgcagtgggctaaaaacaaccagaacaaccccccaaccccctccccgcaaaacactataaagaatagcaacacaaggttcaatgtaaactttgatatggtgttttacctctgaggagaggcttattgttaatattctttagccgtgtaaggggttcacagatgttcatacttttgttctttataccttatatgtattctataaatattgtttctactcaatagttaataaaaacataatttaaaagttctgtgaatgtt

SEQ ID NO: 410967 - DNA, 484 bp, Homo sapiens
atggcacgaacaaagcaaacagctcgcaagtccaccggcggcaaagcgccgcgcaagcagctggccaccaaggcggctcgcaagagcgctccggccaccggtggcgtcaagaagccccaccgctaccgccccggcaccgtggccctgcgcgagatccgccgctaccagaagtcgaccgagctgctaatccggaagctaccttttcagcgcttggtacgggagatcgcacaggactttaagaccgatctgcgcttccagagctcggcggtgatggcgctgcaggaggcttgcgaggcctacctggtggggctatttgaggataccaacctgtgcgccattcacgccaaacgcgtcactattatgcctaaagacatccagcttgcgcgccgcatccgaggggagagggcataaatattcctatcagcccaagaagtctgtccaaccccaaaaggctcttttcagagcccctcaattgtcaccaaaa

SEQ ID NO: 410968 - DNA, 677 bp, Homo sapiens
gtctcccaaagtgctggggttacaagcatgagctactgtttccagccatgtgtttaattttaaaaattgaagaaaaaagacactatgaggaaatgacatgtaaaacacaaatcttttgaggcaaatgtgaagtggcacctattgctcagtattgcccaaaactgtgggacatgatcaacagagagaatggaaaacctagtcatgatagttaaatttgaaattaaccatcttctgaccctagttttttattgttgttgttgcttttaaatgtaaatataatctggatttccagttattactgatatcttcagcagtcacaactggtttcctatgccagtgttaatgaaatcttttcttggccagttcttttaaaaaaacgtaacaggccaggtgcagtagctcacatctgtaatcctagcactttgggaagctgaggtgggcagatcacctgaggttgggagttcgagaccagcctgaccaacatggagaatcgccgtctctactaaaaatacaaaattagccgggtgtggtggcgcatgtctgtaatcccagctactcgagaggctgaggcaggagaatcgcttgaacccgggaggcggaggttgcggtgagcctagatcacgccattgcactccagcctgaacaacaagagcgaaactccatctcaaaacaaaacc

SEQ ID NO: 410969 - DNA, 644 bp, Homo sapiens
gcatgagaatacaaagaaccaggaaaagacaaagcaattttgacaaagaagagtgggggctaccagcactgcctgatttcaaatctcatattaaattagaagcagttaccaagacggtcggtcacacagaaaagtgacacagttagagtccacaaacagacccacgtatatggacaaccgatttgcgacaaagatgcaaagacaattcagtggagaaaagacagtctttgcaacaaatgtttccggaacaactggttctccatgtgcaaaaaaaagagaacttcaatctgcagcttgtaccatataccaaaaaatcagaaaggatcatagccctaaatgtaaaacctaaaaccatctatcttcaatgaggaaacccttgtgaccctggtttaagcaaagatttcttagatatgacaacaagagtactctggaaaagatctagctgataaactggactgcatgaaaattaacaattctactcctcggaaaacactgttaagagggctgaaaagacaaggcacagacttaaagaaagtatttacaaaccgtatctctgattaaggacttgtattcagaatatattagaaaaaggttacaggctgggcatggtgcctcatgcctataatcctaatgctttgggaggc

SEQ ID NO: 410970 - DNA, 285 bp, Homo sapiens
taatttacctagacatttaatgtttatatttttacactttaaaaacatacataagttgggccgggtgtggtggctcacacctgtaatcccagcactttgggaggccgaggcaggcagatcacttgaggtcaggagtttgagaacagactggccaacatggcgaaaacccatctctactaaaaatacaaaaattacccgggaatggtggcacaggcctgtgatcctggctactcaggaggctgaggcaggagaattgcttgaacacgggaggcagaggttgcagtg

SEQ ID NO: 410971 - DNA, 434 bp, Homo sapiens
aacattatcctttctagtcccaaatttattttgctgcttcaggggtttgaaaatttaaaaatcccacagaaatatgaactaccatcagagaatactataaacacctctacgcaaataaactagaaaatctagaagaaatggataaattccttgacacatacaccctcccaggactaaaccaggaagaagttgaatctctgaatagaccaataacaggctctgaaattgaggcaataatcaatagcttaccaaccaaaaaaagtccaggaccagatggattcacagccgaattccaccagaggtacaaggaggagctggtaccattccttctgaaactattccaatcaatagaaaaagagggaatcctccctaactcattttatgaggccagcatcatcctgataccaaagctgggcagagacacaacaaaaaaa

SEQ ID NO: 410972 - DNA, 327 bp, Homo sapiens
gcttagttgacagaggctgatagaatgggtgaagatagttgggatataggctcatgcctataatcccagctgcttgggaggcttaggcaggaggatcccttgaggccaagagttcaagaccagctgagcaacatagcaagacccagccccacacccatctctaaaagaataaaaaattagctgggcgtagtggcttgtgcctgtggtcctaactacttgggagattgaagcaggaggatcgcctgagctgaggaatttgaggttgtaataagctatgatcatgccactgctctccagcctgggcaacagagtgagaccgtatttctc

SEQ ID NO: 410973 - DNA, 523 bp, Homo sapiens
gttttttttttaatacatatagtgtatatatataaatatatatatacacacacacacactgtatgtattcctatgtagattaaatattttgatttacctctttctagtaaagcaaagttcattctgaaatccaaaatattcacttactagagcagaaaaaaattagctgtgcatttatgctgatcacagtgtagataattaatctttaagaaagtaggtttttatgtttatagttgataaagtgttagtggcaagaactttttctgttattgaatattatcatcagattactcgtgctttccattttattcctttaaaaaaatccaacttttgtaagccaccactattttctgaagattttatttctctctaagctaagaaaggatgtcaagaataaaccattttctccttttaaataaaaatgcattcactatagatattcatttgaaatctcaaacatacctgaattaagtatactcagttttgtgagtgaaaattaattattatttaaaacaaaacaaaa

SEQ ID NO: 410974 - DNA, 456 bp, Homo sapiens
gcagggtgtggtggctcacacctataatcctagcatttttgggaggtggactcagatggatgacttgaagtcaggagtttgaggtcagcttggccaacatggcaaaaccttgtctgtactaaaaatacaaaaattagccaggtgtggtggcgcatgcatgtaatcccagcaactccagaggctgagatgggagagtcccttgaatccaggaggcagacactgcagtgagctgagatcatgctactgcactctgtcctgggagatggagcgagacactgtctcaaaaacattatgagatttttctcaactttttgtgttgttgttcatcacctatcatcgctaatgtaagtgcattttatatgtagcccaagacaattcttccagtgtggcccagggaagccacaagattggacacccctgcagtttaaatgaacctttaaaatgaaaaaaaaaaaa

SEQ ID NO: 410975 - DNA, 628 bp, Homo sapiens
aatatcactgtattcataacttattttattacattctctaatattagattgattagctctattatcattttttactataaaagtaatacattctcatatagtagttcagaaaatacagaaaaacccaaagtgaggaaacaacaactgtaaacattttactccagatctttttggttgggtacggtggctcatgcctgtaatctcagcactttgggaggccgaggcagaaggatcacttgagcccaggagtgtgcgaccagcctgggcaacataatgagagctcatctttactaaaaataaattagccgggtctggtagtatgcacctgtagtcccagctacaggtccatgccaccacctgagacgggagcatagcttgaacccaggaggtcgaggctgcagtgatccgtgtttgcaccaccacattccaggctgagtgacagagtgagtccctgtctcacacacacacacacaatatatatatgtatatctccatccctcaaggcatatgcatatattcatatgtgttattttacccaccataacagaataacagtttgtaatgtaatatttttactcattatcatcaaataaagttctgtcatcactttttattgaagcatgtatca

SEQ ID NO: 410976 - DNA, 656 bp, Homo sapiens
tgggtctctaaatgttgaaatatcatagttacatacaaatgaacacagatgtttttcaaaatgattatcttaatgattaaacaatttagaagcatactgttctcttgccaaatcaatacttttcatctgtatttattatacaagggagacaattacaatttaattgaagagagaaatcacatttagcaggggtttatgcaactgtgtttcactccccacgatgaattagattattaattatggcaactgatcaagtatttcttctctattgctttctgcaaaataaagtgttgggctagcatatattttaaccactactgaaatagtatgaatttgtcttgaaaattcagcaagtcccatgagaggatggtttaaaacctccattcttttgatcttattctaatatgtatttgttttgttggctattatataaattgagtaaatacattccaaaatattttcatgatttttttctttcaaatgaaggaaacagaagaggtagaaaatatggataaaaatattaaataaaaactggtcagttaatgaaatgtattcctgtccaatgaaccaaagttttacctaatttttaaccagtattttatcctgaacagaacctgacatttaagaaaactaacaaacaaacaaaaacctgactt

SEQ ID NO: 410977 - DNA, 401 bp, Homo sapiens
aagccacaccatgatcatttgttgtttctcagtgacgatttaaagctttctgatgacaaaatacagaagtcccttctagggtgctttccaatcaggagttgacgagtggcttgatgaaggcaagaaatctgggtgtgggagccaacttaggctgcttggccctaaccactctaactaccacctccttccagccctccacctcccgggccagggtcaagtccaaacctgccatgccctcaggatgaccctgagatgtgtcatcagtgcagtgcagtgacaacttgttctagtttgcctgggaccatcctctggtttaaaactgaaagtcccggtcaggtgcaggagcactttgggaggcccatgcaggaggactgcttgagcccaggagttcaagaccagcc

SEQ ID NO: 410978 - DNA, 398 bp, Homo sapiens
taactctgagaacaagaaaatattttaaaagcataaaaactctggaaatgtgtaatgggtgtgtacgtgtctctatatgcctatgcaagcacacgtgtgtgtgtatatatacatatattacatatatacacacacaactggggatgtgtctatgtctatatgtgtttttgtatgtggttaattgcatgagcttcagtgccagacaaacccatacgtaaaccatggataactcatttaacctctataaacctcagttttcttctccatacaatgggggttaataatgcctatttcacaagattgttgtatggtttcattgaaataacatatgtacaatgcctaacacagctcataggacatagaaagcagtctataaaaggaagttgctctcagtgttg

SEQ ID NO: 410979 - DNA, 286 bp, Homo sapiens
ttcgcagtatgtacagatgtataatgtgtgtacactgatactgcccttctgggaatttatagacagatttgcttacaaatatgagaaattaaataataccaagatagtcactacaacattatttgcaaatgacaatagattggaagtaagtatctattaacagggatagtagaataagttatggttcactcacacaatgcaacagcctttacaaagaataaagagctctggccgggtgcggtggcttacgcctgtaatcctagcattttgggaggctgaggagggc

SEQ ID NO: 410980 - DNA, 381 bp, Homo sapiens
gtcctcatttgactgaggaccaaattattccaaagcttaactccctatctcccacggcagtctcctagagtgcctaccttgtgccaagtaccctagaggtgccataagagcatcctagactcgaaggtatgaggtcaaataaagctgattttttcaactgcccatatttacatcaccttataaagaggtgccatgctgcctagatctcttatctctacagactcagcagcaaaaatatgcccaggctgaaggacagatatcacatgttcttactttatttgaactcatggagatagagaatagaaggatggttaccagaggctgggaagggtagtgggaaggtggggggaggtggggatggtgaatgcatacaaaaaaaaa

SEQ ID NO: 410981 - DNA, 224 bp, Homo sapiens
gtgcctggcaggtagtaagtgctcgatacattttagttacaatttctttgtttccaggtaagggaggagagaatttagagccttgagcgcatttgacctctacagcctcagtgaaaacgaagccaagtttctctgttgtgtcagggattagggcttggagaaaataggcaagatctcaagaagcccctgtcaggcatggaggaaatacactgggcagaaagctg

SEQ ID NO: 410982 - DNA, 858 bp, Homo sapiens
aagatggacctgctcttatactgttgattactttcagtattaatatactattccccaattattttttgattggtatgtattaatgggtaattgaataatgaaaataagccaggtatttttgtgccggaagtttactagattgcatgttaccaaataccctgctcttcctctaattcccttcccccatctgactctattatcaactaaatgcattccaggcaaacagatggacactcacagcccttcccagccccacctccaagtagtatgcaaatggcactgagatttagcaaaaacgcggcgtctttgaaagttaacagacactaaggtagcagtgcctgtgtgttggagctcagttaggagttgaagttttctgcacctgtgataacaagcccaccagccacatgcatttcttcttcctgccactgtgactcggtggctgtagagccacatggcatttgtcagccaatctgtttcaagtcttttctttccaccaatagctttcttacagattttcttggctaaatgaggccattacctagattgtcccttcagtaggagcctgaatccttcgcttaccaggctgagagctatttgccatgataatgctgattctctcactcctcatgcagaatgtgcacctgcagccctttgatgcgttttgatttgggggcgatttttcaggctttgattagcaggctgcttgcaatgcagaagatcacagttcctttctggggcagcagcaaccagagcctcttcctgtgtcctgtgtgtctggtatgtttacaccttgctctgagtttttctcttgttttctttttttaattaagtttacattttagtttctttgacatcttg

SEQ ID NO: 410983 - DNA, 390 bp, Homo sapiens
atgatctatctaccaacaggagatggtgatatcaatatcacttctaaatgcatgcttctagttcaaaaagatctcaagacttgaaggaaatgaaaggtggggtacccagatataagcagtcctttcctgcaccaacatcctgtgattctatgagaagtacaactatggagagatggagcagcacactggtttagagtgccagctccagaatcagatgtgggtgcaaattcaccactttctagctgtatgactttggatttgtaaatgaatctttcagagcctcagtctctccatctgtcaaatgaagataataggggtgattgtgaggactaaatgacagggtgccttaaacatattaactattcaataaaagttaattcctctatatta

SEQ ID NO: 410984 - DNA, 314 bp, Homo sapiens
ggaagacttgatttatcccaaatcaccaactctacctaatgtccaaggctgccccttcttcctgcctgaaagccgaccagcccagagggaagggttttcactgcaggagatcaatttccccacccctcattgtctcttgacctacggtgagagtaagatctcagctgagcctgggcacctgttgctgagagacgaagattcacacaccaaaatgatttccaactgactaatgtatgtcagcaaaaacctcaagaacatatgtagatgtggattcttggagtattttataaagtagaaagagtataattttaaat

SEQ ID NO: 410985 - DNA, 179 bp, Homo sapiens
ttcccacttgtcgaaagaactcttattcatccgccagcaccccaatcaatgccccttcccagggcattcatcatcagctggtagacactggtgggtgctgtggattgtttacagccagtgtcctttctgattggtcagtgactgtgacaaacaggttattaaagatttaaactctcgcc

SEQ ID NO: 410986 - DNA, 446 bp, Homo sapiens
gcttaaaataaatctccatggtttacaatgcaaatggctgttgcaaggtgaagaaacaaagagaatatcattctgaaggcaacaaagagcattgcaatacctgataaaattctgacttctgcttcatttcctgttcttgagctggctggatttcgagctgagcatcggtaaattccaatgtcccccggttggagtcggctgatctgcaatgctccagagggcaagaccaccactcgggagtcacctgggattggagtcaggtcttgttggttcttctgccagtggattgttggcatgggctccccaatgacttcacacttgagtagcactgtgtctcccatgaaggctgtgacagattctgtctgtgaaaggaacctcagtggtcctaggagaaaaacaaagaaggaagaataagtcttccaaataaagcacaataatcgccaata

SEQ ID NO: 410987 - DNA, 511 bp, Homo sapiens
agtgcctacttaggagactgcttgcatactgaatgaaacgaaggaagaatgaatgaataatttgggaccccacctcccaacacacttccacatatcgaaatgcacacggaatgaggtacatcttctaaggagagtggcattgaagagtaatcaaaacaacaggatattcacaggaggactggaataaaacgaaatttccagtgaaaaagattactcaaaatatttattcaatacactctgaaattagaaactaagcaaatgtcttttggagatcccagttccctcacattccccacagatgaagatgagccaaacagaagtccaaaacttaaacattacaaaacaaataataaaataagacactgtgactgaaaatcagcacaaacaataaacggcagaaatatatcccccaaaacttcagaggcagagctcatttgattaaaaatttaaaattattacatttaaaatgtttaaggacatgatagatggaattaaaaacattatcaacaaa

SEQ ID NO: 410988 - DNA, 336 bp, Homo sapiens
agtgatgactcgatagcccagggaaggaagaactcactgtacaaaacaagactgagcatggaaaacaagaggactgcacagtcaaccaccaaagtgatttgaaatcaggtgcgttttgtttctttgactatataaatgaaaacattttcaccaagataaaaactgaaactaaagatgaatgttgcaggacaatggaaagagactcttcctgtcagtcctcaggcccctgctatgtgtatgtgctcaatgaatgtctttaggacaggggcgggaaaaacagagggtagaagatagaacatttgaaaaataataaagaagtacacagaataaaccaaa

SEQ ID NO: 410989 - DNA, 285 bp, Homo sapiens
actcctgtaatagcatctagcagacaaagagctgggagaatgacaggggcatgaacgagaagagccagcacttgcacagactgaatgagctcctgggagctggagtgagtgttctgtgcactttgagaaacagcacagatcattcagcttagtggtcatgatccagtcaacaaagaaactctctttattctcctcccccctacccccgagacctcacagatcccacatggattttgaaagcttttatctgccaaatacccgaatctgttatgttataatgtaatg

SEQ ID NO: 410990 - DNA, 493 bp, Homo sapiens
tggctttagattggagagtgacctaatttaaaaccggttctgagaaaaaacttcatgtgaccttgaacaatttattttaccatttttttgtttcttcacatagaagataaaatagaagataaaattattgaattggatctgtcactgcccagcaataatgcacattagacatggattttgtagaaacactatagtagatgatgcctaaaccatctttcaattctaagaggttgtcacatgcatctggaagagcctgagaatgcttttgagttatacgttgagcttgacaccaaatactgaccaacttggtaacatcccctctttccttacctccattccttttcaatacatatgtttctatgatatattgtatgtttttatgatataattgctaggcctcaaaattttgaatcctactctaagacatgtgaggtgtgactgatgcttagaaaattatgctgataaattataaaaacatcataaaaccaggatt

SEQ ID NO: 410991 - DNA, 427 bp, Homo sapiens
ctctggtcctcttgttacttaggtgtggaaagttagggttttcctttcgatttagttctaggaagtcagcgtgaaatggccttaggttccctgcctgcagactctattctcctacctcagttgggctaggtgaaagggaagagttgatcagaatgggaggatcattatgtaaagtatggagcttagttaataatagtgtaccaatgtcatgccctcagatttaaaaaaaattttttaattttttattcttttgccacctccttgtcgctggcagtgccccccagttatgcacaagcacaagctctgggtctgcagtctgaacccccggccaggccacgggtgtcttatcaacaatagaggaaacgaacagaactttgtagtatttttgcaacttttctgtaaaccaaaataaaaagtttactttaaa

SEQ ID NO: 410992 - DNA, 393 bp, Homo sapiens
ccttattttgtctctgttcatgtttatagaatatgaaatactcagtaaggcagacttagtacatatatgaagtctgtgtaatctcagggcttcaggaagactctacctgttctcccatacaacaaattctgccactcagctgctgcaggactgccttccacatatacatggcttttaatcttggtgccatcatgtaagaagtgcctttcacctctcaccatgattctgaggcctccccagagatgtggaactaagatgcagcaacaaggtatcatcttggaagcagagacagggccttcaccagacaccaaacccaaagatcccttcatcttggactttcagcctccagaactgtgagaaataaattcctattcttttaaaattacccagtct

SEQ ID NO: 410993 - DNA, 431 bp, Homo sapiens
tcttcaaataactgcaaccccagctgaaagcttgactgttgttgagagaccctaagccagaaccacagagctgagccacttctggatcactagacttctgaaacagactttgcttctccatgaccacgtatttcaacactcaatatgtcctagctccctctctgctactgtgtccacaaccaagcttaaatcataaactaaataagctgaggatgttctgaatctgatatgagaagaaaatactattggtcctgtggtcatcagaaattataacagaattggagaagattgctgccatttggtgcccagattgcttcaaaaaattgtaggagactgccatccagattattcctcagaagctataaaaccttttgtaatattggaagttgacaagccaagcgcattaaatgaaaactgtcaaaaatcctgct

SEQ ID NO: 410994 - DNA, 446 bp, Homo sapiens
ggccaaggcaggaggactgcttgaggccaggagtttgggaccagcctggacaacatagtaagacccgtctctacaaaaataaaaaaattccacacacaaaaactacagcaacaatagagaaatatgatgagccccagctcaacagggcaagtcagcaatggaagagaccaaagccttggggagcctggatggagacagcaagagaaggctccgggtccctgatggacaacggctgcacctgagccaggtgtgctcagacaggccttcagagaaaagacaggttccctaagaaggaaggaattctgcctccacactgcctttgaattgggactcacgccgcaccgccagcagcatctcttgctagaatttccagactgccctgcaaatttcagacttgccagtctcgattcttaaaataaatctctccctctctcaaaaaaaaaaaa
